United States Patent 11,098,302 (IDENTIFICATION OF POLYNUCLEOTIDES ASSOCIATED WITH A SAMPLE) - sequence listing, part 92

SEQ ID NO: 318101 - DNA, 671 bp, Homo sapiens
  misc_feature: GZ8MTXP01BFMQH.44.35.D02.1.454.CMB.2.raw
  modified_base (216)..(216): a, c, t, g, unknown or other
  misc_feature (216)..(216): n is a, c, g, or t
  modified_base (281)..(281): a, c, t, g, unknown or other
  misc_feature (281)..(281): n is a, c, g, or t
tcagacagtatatacacgaccggtgctcgatttagcacacgatagttgggtttgggggcctgggcctcaggaagcagcatcggaggtgcctcagccatggcatggatccctctcttcctcggcgtccttgcttactgcacagggtccgggcctcctctgacctgactcagccatcctcactgtccgtgtccccaggacacacagtcactattaccngctcgtagggaaaacttgagtgataaatttgcttctgtatcagcagagccaggccacgcccctangctggtcatcttcagataatagcgccctagaggactcccgtgacgcgtcttcctcgtaggcctaccgaacgtcgtacgggaaccaccgggtcccactcgtcgaaccatcgaacgccgaccgacccacgcctacgtagggaactggaacggtctacggtacttaactttaccgaggtacgtaacgggaaccgtaggggtaaaagtgtaaccgttaaaggtttcgggggtcgttccggggacgggtaacggggaaccccaaagggtcccgttacgggtaaccccgtttcgtacccggggttaccgaaccgggttccccgaaccgggggtcccttcccggcccccccgttacggggtccttaaccccttcccgtttccccggttaaccccccc

SEQ ID NO: 318102 - DNA, 546 bp, Homo sapiens
  misc_feature: GZ8MTXP01C0NKE.44.35.D02.1.454.CMB.2.raw
  modified_base (296)..(296): a, c, t, g, unknown or other
  misc_feature (296)..(296): n is a, c, g, or t
  modified_base (306)..(306): a, c, t, g, unknown or other
  misc_feature (306)..(306): n is a, c, g, or t
  modified_base (355)..(355): a, c, t, g, unknown or other
  misc_feature (355)..(355): n is a, c, g, or t
  modified_base (393)..(393): a, c, t, g, unknown or other
  misc_feature (393)..(393): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtgttacatcagtagttattatggagttggctgcggcagtccgcgggaaggctggagtggattgggcgnatctataacngtgcagcaccaactaccaaccccgcctacaaagcgtcgaacgtcaaccntgtcaaactagaacagtaccaaagaccagttcacctanaaacttgacttctgtcgtaccgcgcggtacacggccgtatacttatggtgcgagtagattctatcgatacagtagaggacgggggcaacgtgccgtcgacccgtcgggcgacgggaccttcggtcaccgtctcctcacgtcccgccgaacccg

SEQ ID NO: 318103 - DNA, 681 bp, Homo sapiens
  misc_feature: GZ8MTXP01BDIH0.44.35.D02.1.454.CMB.2.raw
  modified_base (218)..(218): a, c, t, g, unknown or other
  misc_feature (218)..(218): n is a, c, g, or t
tcagacagtatatacacgaccggtgctcgatttagcacacgatagttgggtttgggggcctgggcctcaggaagcagcatcggaggtgcctcagccatggcatggatccctctcttcctcggcgtccttgcttactgcacgagggtccggggcctcctctgacctgactcagccatcctcactgtccgtgtccccaggacacacagtcactattaccngcctcgtaggggaaaacttgagtgaattaatttgcttctggtatcagcagaggccaggcccacgcccctatcgctggtcatcttacgaggtataatagccggcctgaggactcccgtgacgccgtcttccactcggcctaccaacgtcgtacgggaaccaccgggccacctctcgaccctatccacgccgacccgaccccgacggtcccctcggtacggacgttcggaacgggccttacgaaccttatttacccgtagggttacgaagggtacggtaggggtaaacgttcgacgtttaaaggttggggtacgggttacggggacggggaacgggacccgtaacgggtcgttaccgggtacccggtttcgtacccggggttcaacccggcccgaacggggtccccgtcccggtccccccgttcgggtaccttcccggtttccgttaaccccggtttcccccccg

SEQ ID NO: 318104 - DNA, 644 bp, Homo sapiens
  misc_feature: GZ8MTXP01CHU25.44.35.D02.1.454.CMB.2.raw
  modified_base (264)..(264): a, c, t, g, unknown or other
  misc_feature (264)..(264): n is a, c, g, or t
tcagacagtatatacacgaccggtgctcgatttagcacacgatagttgggtttgggggcctgggcctcaggaagcagcatcggaggtgcctcagccatggcatggatccctctcttcctcggcgtccttgcttactgcacgagggtccgggcctcctctgacctgactcagccatcctcactgtccgtcgtccccaggacacacagtcactattacctgctcgtagggaaacttgagtgaattaattgcttctgtatcagcagngcaggccacgcccctatgctggcatcttcaggtataagtaacgcggccctgaggactcccgtgagcgtcttcctcgtggtcctaccgaacgtcgtacggggaaccaccgggtcccaacttccgagaaccctagtccgacgccgaccgacccctacgccctcgtaggacgttcggacggtctacgtactattaaccgttcgggtaccgaaggtaccgggttagggaaaagttcggtagttaaaggtttgggggtcgttacggggaccgggtaacgggaccgtaacggtcgttacggtacccggttcgtaccgggtacaccggcccgaacgggtcctcccggtccccgttcgggtccttacttccccgttccgttccccccg

SEQ ID NO: 318105 - DNA, 595 bp, Homo sapiens
  misc_feature: GZ8MTXP01AWLTN.44.35.D02.1.454.CMB.2.raw
  modified_base (307)..(307): a, c, t, g, unknown or other
  misc_feature (307)..(307): n is a, c, g, or t
  modified_base (339)..(339): a, c, t, g, unknown or other
  misc_feature (339)..(339): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtgttacatcagttagttattattggagttggctgcggcaggtccgcgggaggctggagtggatgggcgcatctataacngtggcagcaccaactacaaccccgctacaagngtcgacgtcacatgtcaaactagcagggtcccaaagaccctagttccaccctagaacttgtacttctgtcgacggcgacggacacggcctatacttagttgtggacgtagtagtacttaccgtatccgtatacgagtaggacgggacggggggacgaacggtcggccgtccggacccgtcgggggacccgacggggttacccgttcgggtaaccctaccggtccgtcccgtccgaccgtcccgttcccgaacccgg

SEQ ID NO: 318106 - DNA, 630 bp, Homo sapiens
  misc_feature: GZ8MTXP01EQE2L.44.35.D02.1.454.CMB.2.raw
  modified_base (246)..(246): a, c, t, g, unknown or other
  misc_feature (246)..(246): n is a, c, g, or t
  modified_base (272)..(272): a, c, t, g, unknown or other
  misc_feature (272)..(272): n is a, c, g, or t
  modified_base (295)..(295): a, c, t, g, unknown or other
  misc_feature (295)..(295): n is a, c, g, or t
tcagacagtatatacacgaccggtgctcgatttagcacacgatagttgggtttggggggggtcacaagaggcagcgctctcgggacgtctccaccatggcctgggctctgctgctcctcactctcctgactcaggacacagggacctgggcccagtccgccctgactcagccagcctccgtgtctgggtctcctggacagtcgctcaccctctcctgcactggaactaatactgatgtagaaaatntaaccttgtctcttggtaccaagtanacccaggtaaacccccctaaacncttacttatagtaagtactaactaagacggcccgtccggtcgtactttcttctactcgtcttccttcacgctaccccgaacgtctacggtaccaacgaaccggaccctcggttcgtacgttaactttctacggtcccttccgtcgtccctcgaccgacggacggaccgtaacgtacttacttgtctgtctcactactcggtcggtcgtagtacgtagttggttcgttcgggtcgggtacgggtccggccgtcggccgtccgtcgttcgtcgccgacgccgttccgccccgttccgtccctccgtccgtccgttcccgttcccttcccgttccgtc

SEQ ID NO: 318107 - DNA, 712 bp, Homo sapiens
  misc_feature: GZ8MTXP01DXSR1.44.35.D02.1.454.CMB.2.raw
  modified_base (290)..(290): a, c, t, g, unknown or other
  misc_feature (290)..(290): n is a, c, g, or t
tcagacagtatatacacgaccggtgctcgatttagcacacgatagttgggtttgggggcctgggcctcaggaagcagcatcggaggtgcctcagccatggcatggatccctctcttcctcggcgtccttgcttactgcacgaggggtccgggcctcctctgacctgactcagccatcctcactgtccgtcgtccccaggacacacagtcactattacctgctacgtagggaaaacttgagtagaattaaattgcttctgtatcagcgagagccaggcccacgccccctancgctggtcagttctttacgaaggaattaaacgtaacggccggtaccctacgaaggggtactccccgtagacgcgtcctttccctcgtacggtcctacccgtaacctccggtacgggaaccgacccgggaccctacctacgtacgacccacgttacaccgccgacccgaccccgacgccccttagtacggacttaggacggctacgaacttacttaccgtagggtacgaacgggtacgtaagggtaaacgtggtaacgttaaaggttggggttcgggtaccgggaacggggaccgggaaccgtaaggtccgttcgggtaacccgtttccgaccgggttaccgaaccgggaccccggttaacggtcccgtaccccggtcccccgttcgggtacccttaccgtcccctttaaccggttccccccc

SEQ ID NO: 318108 - DNA, 574 bp, Homo sapiens
  misc_feature: GZ8MTXP01ARP11.44.35.D02.1.454.CMB.2.raw
  modified_base (293)..(293): a, c, t, g, unknown or other
  misc_feature (293)..(293): n is a, c, g, or t
  modified_base (534)..(534): a, c, t, g, unknown or other
  misc_feature (534)..(534): n is a, c, g, or t
  modified_base (556)..(556): a, c, t, g, unknown or other
  misc_feature (556)..(556): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacggtgaagccttcggagaccctgtccctcacctgcaatgtctctggtgttacatcagtagttattattggagttggctgcggcagtcgcggaggctggagtggattgggcgnatctatacagtgcagcaccaactacaaccccgcctacgaagacgtcgacgtcacatgtacaactagcagggtaccaaagacctagttcctacccgtagaaattgtacttactgtacggaccgccgcggtacacggtccgtataacgttattgtaggcgtagagtacttacctatccgatacgacggtaggaggacggggggcgaacggtcggacgtcgacccgtggggccgacgggaccgngggtccaccggtcctccgtacnccgtccgttccgaacccg

SEQ ID NO: 318109 - DNA, 639 bp, Homo sapiens
  misc_feature: GZ8MTXP01BRAZE.44.35.D02.1.454.CMB.2.raw
  modified_base (347)..(347): a, c, t, g, unknown or other
  misc_feature (347)..(347): n is a, c, g, or t
tcagacagtatatacacgaccggtgctcgatttagcacacgatagttgggtttgggggcctgggcctcaggaagcagcatcggaggtgcctcagccatggcatggatccctctcttcctcggcgtccttgcttactgcacagggtccggggcctcctctgacctgactcagccatcctcactgtccgtgtccccaggacacacagtcactattacctgctctggggaaaacttgagtgataattgcttcctggtatcagcagacggccaggccacgcccctatcgctggtcatctttcaggataagtaagccggccctcgagggactcccgtgacgcgtcctttccnctcggcctaccgaactccgtacgggaacaccggcccactcctacgacccatcgacgccgccgaccccagtcccctcgtacgggattcggacgggtctgtaaccttagtttaaccgtggggtacgaagggtaccgggtaggggaaacgtggtacgttaagtttgggggtcgttccgggggacgggtaacgggacccgaaggtccgttacggtacccggttcgtaccgggtcgacggccccacgggtcctacccggccccgtacgggtccttaccgtccgttccgttccccccg

SEQ ID NO: 318110 - DNA, 610 bp, Homo sapiens
  misc_feature: GZ8MTXP01C1HJ7.44.35.D02.1.454.CMB.2.raw
  modified_base (343)..(343): a, c, t, g, unknown or other
  misc_feature (343)..(343): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtgttacatcagtagttattatggagttggctgcggcagtccgccgggaaggactgggagtggattgggcgcatctaataacagtggcagcaccaactacaaccccgcctacaagngtcgagtccacgatcgacaactagcagggtcccaaagaccctagttctaccctagtaaacttcgtaacttcgtgtcgacccggaccggcggacctacgggaccgtattaacttaagttcgtgggacgagagtacttcctaatcgtataacgtagtaggaggtacggggggacgaacgtcgggcgtccggaccccgtggggcccggacggggttaaccccgttgggtccgtacccggtctccgtccgacgtcccgttccgtaacccgg

SEQ ID NO: 318111 - DNA, 536 bp, Homo sapiens
  misc_feature: GZ8MTXP01AKK3Z.44.35.D02.1.454.CMB.2.raw
  modified_base (516)..(516): a, c, t, g, unknown or other
  misc_feature (516)..(516): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtgttacatcagtagttattattggagttggctgcggcagtccgcgggaaggactggagtggattgggcgcatctataacagtggcagcacaactacaaccccgctcaagatcgagtcacatgtcaactagcaggtccaaagacccagttctaccctagaaacttgacttctgtgaccgccgcggacacggccgtatacttattgtggcgagagattcctatcgatacagtacgaggacgggggcgaacgtgcgtcgacccgtggggcagggacccttggtcaccgtcncctcacgtccttcgaacccg

SEQ ID NO: 318112 - DNA, 614 bp, Homo sapiens
  misc_feature: GZ8MTXP01BEGB9.44.35.D02.1.454.CMB.2.raw
tcagacagtatatacacgaccggtgctcgatttagcacacgatagttgggtttgggggcctgggcctcaggaagcagcatcggaggtgcctcagccatggcatggatccctctcttcctcggcgtccttgcttactgcacagggtccgggcctcctctgacctgactcagccatcctcactgtccgtgtccccaggacacacagtcactattacctgctctaggggaaaacttgagtgataattgcttcctggtatcagcagaggccaggccagcccccctatgctggtcatctttcaggataataagccggccctcgagggactccctgacgcgtcttcctcgtggctaccaactcgtacgggaacacggccactctacgaccatcacgcgccgacccagccctcgtggatgaggctgactattacgtggtacaggaccgtagggaaagtgacgttaagttggggttgttcggggacggtacgggaccaaggtccgttacgggtacccgtttcgtaccggggttccaccgggttccccgaaacgggtcccttacccgggccccccgttacggggtcccttacccgttcccgtttccccgggtttccccccccg

SEQ ID NO: 318113 - DNA, 636 bp, Homo sapiens
  misc_feature: GZ8MTXP01ENEBZ.44.35.D02.1.454.CMB.2.raw
  modified_base (335)..(335): a, c, t, g, unknown or other
  misc_feature (335)..(335): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtgttacatcagtagttattattggagttggctgcggcaggtccgcgggaggactggagtggagttgggcgcatctatacagtgcagcaccaactaccacccgcctanaagagtcgacgtcacatcgtcaaactagcagggtacccaaaggaaccctagttcctaccgtagtaaacttgtacttcgtgtcgaccgtccgacggaccacggtaccgtattacttagttgtggcgtagtagtattcctagtcgaatacgaggtaggacggggtacggggggcgtaaacgtcgggaccgtcccgggacccggttacgggggcccgaaaccgggggttaccccgttacggggtaacccgtaacccggttccgtccccgttaccgacccggtccccgttaacccgaaccccggg

SEQ ID NO: 318114 - DNA, 548 bp, Homo sapiens
  misc_feature: GZ8MTXP01A529G.44.35.D02.1.454.CMB.2.raw
  modified_base (294)..(294): a, c, t, g, unknown or other
  misc_feature (294)..(294): n is a, c, g, or t
  modified_base (304)..(304): a, c, t, g, unknown or other
  misc_feature (304)..(304): n is a, c, g, or t
  modified_base (333)..(333): a, c, t, g, unknown or other
  misc_feature (333)..(333): n is a, c, g, or t
  modified_base (378)..(378): a, c, t, g, unknown or other
  misc_feature (378)..(378): n is a, c, g, or t
  modified_base (471)..(471): a, c, t, g, unknown or other
  misc_feature (471)..(471): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacggtgaagccttcggagccctgtccctcacctgcaatgtctctggtgttacatcagtagttattattggagttggctgcggcagtccgcgggaaggctggagtggattgggcncatcataacngtggcagcacactacaaccccgctcaagngtcgacgtcacatcgtcaaactagcaggtccaaagacccagttcnccctagaaattgacttctgtcgacccgcgcggacacggccgtatattattcgtgcgagagattcctatcgatacgagtaggaggtacgggggnaacgtggcgtccgacccgtggggcccacgggacccttcgggtccaccggtcctcctcgacgtcccgttccaacccgg

SEQ ID NO: 318115 - DNA, 702 bp, Homo sapiens
  misc_feature: GZ8MTXP01A301F.44.35.D02.1.454.CMB.2.raw
tcagacagtatatacacgaccggtgctcgatttagcacacgatagttgggtttgggggcctgggcctcaggaagcagcatcggaggtgcctcagccatggcatggatccctctcttcctcggcgtccttgcttactgcacagggtccgggcctcctctgacctgactcagccatcctcactgtccgtgtccccaggacacacagtcactattacctgctctaggggaaacttgagtgataaattgcttctggtatcagcagaggccaggccacgccccctatgactggtcatcttacaggataagtaacgcggaccctcgagggtactccctgacgcgcttcctaccgtcggcctccaaccgttcgacggggaaccacccgggcctaaccgtcgtacgaccctatccgacgccgacccgtaacccacggtcccctgtacgggattacgacgggtctacggtaaccttagtttaccgtcgggtaccgaagggtacccgggtagggtaaaacggttcggtaaccgttaaagggttgggggttccggttccgggggacgggtaaccggggaaccgtaaacgggtccgttccgggtaacccggttttccggaccgggtaccgaccgggcccgttaaacggggtcccctaccggtcccccccggttggttaccccggaccttcccgttaaccccggtttcccccccg

SEQ ID NO: 318116 - DNA, 781 bp, Homo sapiens
  misc_feature: GZ8MTXP01B5919.44.35.D02.1.454.CMB.2.raw
  modified_base (335)..(335): a, c, t, g, unknown or other
  misc_feature (335)..(335): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtggttacatctagttagttattagtggtagttggctggcggcgacggtcccggacggggaaggacgtgggaggtaggtaggttcgggcgactactactaaataacgnggtcgacacgaaccaacccaaaccctaaccccgaacccccgtccctaacgaaacgtacgtaccgaaccgtaccaactacgtacgtacctaaacgtaacgaaccgtacggtaaaccaaacgtaaccgtacgttaccctaccgtaaagttaacttcgtaccttcggtacgtacccggacccggaccccggtacgggtaacccgtacccgggtaaccgttaatttaacgtttaaggttcgtacgggggaacgttaaggtaccgttactttaacccgttaagtaccgtaagtaacggtaaggtaaggggacgggggaaccgggggtaactaaccggtcgggacccgtaccccgggttacccgggtacggggacccgttaaccggggttcccgttacggaaccctacccggtcctccgaccgttacccgtcccgttaacccgtaaccccgg

SEQ ID NO: 318117 - DNA, 648 bp, Homo sapiens
  misc_feature: GZ8MTXP01C6RUS.44.35.D02.1.454.CMB.2.raw
  modified_base (265)..(265): a, c, t, g, unknown or other
  misc_feature (265)..(265): n is a, c, g, or t
  modified_base (346)..(346): a, c, t, g, unknown or other
  misc_feature (346)..(346): n is a, c, g, or t
  modified_base (387)..(387): a, c, t, g, unknown or other
  misc_feature (387)..(387): n is a, c, g, or t
tcagacagtatatacacgaccggtgctcgatttagcacacgatagttgggtttgggggcctgggcctcaggaagcagcatcggaggtgcctcagccatggcatggatccctctcttcctcggcgtccttgcttactgcacgagggtccggggcctcctctgacctgactcagccatcctcactgtccgtgtccccaggacacacagtcactattacctgctcgtagggaaaacttgagtgtaattaatttgcttctggtatcagnagacggccaggccacgcccctatcgctggtcattctttacgaggtaataacgtaacgccggtacctaggacggactcccgngacgcgtctttcccacgtggcctacaactcgtacgggaacnccgcactctagaccatccgacgcgaccaccgagcccttcgaggtatcggaggtcctagtaaccttagttacgtcgggtacgaaggtaacggtaacgggtaaagtcgtacgtttagggttaggggttcggttacgggaccgggtaacgggtaaccctaagggtccgttacggttaccccgttcgtaccggggtccaccggcccgaacggtcccgtacccgtcccccgtcgggtacccttccgttcccggttcccttcccccg

SEQ ID NO: 318118 - DNA, 642 bp, Homo sapiens
  misc_feature: GZ8MTXP01CGP4Y.44.35.D02.1.454.CMB.2.raw
  modified_base (295)..(295): a, c, t, g, unknown or other
  misc_feature (295)..(295): n is a, c, g, or t
  modified_base (303)..(303): a, c, t, g, unknown or other
  misc_feature (303)..(303): n is a, c, g, or t
  modified_base (331)..(331): a, c, t, g, unknown or other
  misc_feature (331)..(331): n is a, c, g, or t
  modified_base (335)..(335): a, c, t, g, unknown or other
  misc_feature (335)..(335): n is a, c, g, or t
  modified_base (349)..(349): a, c, t, g, unknown or other
  misc_feature (349)..(349): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctccagatgggtcgtgtccgaggtgcagctgcaggagtcgggcccaggacgggtgaagccttcggagaccctgtccctcacctgcaatgtctctggtgttacatcagtagttattattggagttggctgcggcagtccgcgggaaggctggagtggattgggcnatcatacngtgcagcaccaactacaaccccgcctanaagngtcgacgtcacatncaactagcacgggtacccaaagaaccctagttcctacccgtagtaaacttcgtacctttctcggttcgacccggcccggacgggaccaccgggtaccttaattacttagttgtaggtacgtaagtacgtacttacctatccgtaatacgaggttaggacggggtacggggggacctaacggtcggccggtacccggacccggtcgggggaccgaacgggggttaaccccttcggggtccctacccggttccgtaccccgtccgaaccggtccccgttaacccgaaaccccggg

SEQ ID NO: 318119 - DNA, 549 bp, Homo sapiens
  misc_feature: GZ8MTXP01AYEIP.44.35.D02.1.454.CMB.2.raw
  modified_base (247)..(247): a, c, t, g, unknown or other
  misc_feature (247)..(247): n is a, c, g, or t
  modified_base (271)..(271): a, c, t, g, unknown or other
  misc_feature (271)..(271): n is a, c, g, or t
  modified_base (519)..(519): a, c, t, g, unknown or other
  misc_feature (519)..(519): n is a, c, g, or t
  modified_base (544)..(544): a, c, t, g, unknown or other
  misc_feature (544)..(544): n is a, c, g, or t
tcagacagtatatacacgaccggtgctcgatttagcacacgatagttgggtttgggggggtcacaagaggcagcgctctcgggacgtctccaccatggcctgggctctgctgctcctcactctcctgactcaggacacagggacctgggcccagtccgccctgactcagccagcctccgtgtctgggtctcctggacagtcgctcaccctctcctgcactggaactaatactgatgttaggaaaatntaaccttgtctcttgtacaagtanacccaggtaaacccccaactccttctttatgaagtcaaataagcggccctcgggcatttctcatcgcttctcaggctccaacgtctggcaacacggcctcgttgataatttctggcctcctgcctgacgacgaggcgactattatgctgctcatagtcgcgggggtcctagagtagttgggtcttcgggcggacgggaccgtcctgaccgtcgtaaggtcagcccaaggcctgcccccgttggttccncctctcgttcccgcccttcctcttnttaac

SEQ ID NO: 318120 - DNA, 707 bp, Homo sapiens
  misc_feature: GZ8MTXP01AVOT3.44.35.D02.1.454.CMB.2.raw
  modified_base (314)..(314): a, c, t, g, unknown or other
  misc_feature (314)..(314): n is a, c, g, or t
  modified_base (344)..(344): a, c, t, g, unknown or other
  misc_feature (344)..(344): n is a, c, g, or t
  modified_base (349)..(349): a, c, t, g, unknown or other
  misc_feature (349)..(349): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccagggacgggtgaagccttcggagaccctgtccctcacctgcaatgtctcgtggtgttacatcagtagttattattggagttggctgcggcaggtccggcgggaaggacgtggagtggattgggcgcatctaataacngtgcagcaccaactaccgaaccccgcctanaacgngtcgacgtccacgtatgtcaaactagaacacgggtacccaaagaaccctagttcctacccgtaagtaaacttcgtacttcgtcgtacgacccggacccggaccggtaaccgtaaccgggtacccgttaagttaacgtttagttacggtaggggtaccgtaaggtaacgtaccttacgtaacgtacgtaactaaccgtaggtaaagggacgggggtaaccggggggccggtaaacggtcggggaccggttacccggaccccgggtacggggggacccgaaccgggggttaaccccgttcgggtaacccgtacccggttcccgtcccgtcccgaccgccccgttaacccgaaaccccggg

SEQ ID NO: 318121 - DNA, 628 bp, Homo sapiens
  misc_feature: GZ8MTXP01BKAJK.44.35.D02.1.454.CMB.2.raw
  modified_base (304)..(304): a, c, t, g, unknown or other
  misc_feature (304)..(304): n is a, c, g, or t
  modified_base (325)..(325): a, c, t, g, unknown or other
  misc_feature (325)..(325): n is a, c, g, or t
  modified_base (334)..(334): a, c, t, g, unknown or other
  misc_feature (334)..(334): n is a, c, g, or t
  modified_base (399)..(399): a, c, t, g, unknown or other
  misc_feature (399)..(399): n is a, c, g, or t
tcagacagtatatacacgaccggtgctcgatttagcacacgatagttgggtttgggggcctgggcctcaggaagcagcatcggaggtgcctcagccatggcatggatccctctcttcctcggcgtccttgcttactgcacgagggtccgggcctcctctgacctgactcagccatcctcactgtccgtcgtccccaggacacacagtcactattacctgctcgtaggggaaaacttgagtgattaatttgcttctggtatcagcagagccagccacgcccctatgctgtcattcttcagataanagcgcctgaggctccgtgacncgtcttccnctggctccgaactcgtacgggaaccacggcccacttcgcgaacccatccgacgccgaccgacccncgcccttacgtcgggtaactgggaacggtcttacggtaacctttaagttaccgttggggtacgtaacgggtacgggtaaggggaaacgttggtaaccgtttaaggttgggggtcgttacggggacgggtaacggaaccgaagtcgttacgtaccggttccgcggtaccgacggccacgggtccctcccggccccgttcggtccttaccgttccgttccggtttcccccg

SEQ ID NO: 318122 - DNA, 575 bp, Homo sapiens
  misc_feature: GZ8MTXP01EMNCN.44.35.D02.1.454.CMB.2.raw
  modified_base (309)..(309): a, c, t, g, unknown or other
  misc_feature (309)..(309): n is a, c, g, or t
  modified_base (341)..(341): a, c, t, g, unknown or other
  misc_feature (341)..(341): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtgttacatcagtagttattattggagttggctgcggcagtccgcgggaaggactggagtggagttgggcgcatctataacngtggcagcaccaactacaaccccgctacaagntcgacgtcaccatgtacaaactagcagggtaccaaagaaaccctgtttcctccctagaaattgaacttctgtcgaccgccgacggacaccggaccgtatattagttgtggcgtagagacttcctatcgatacgagtagaacgggacgggggcaagtcggctccggacccgtggggaccgacgggaacccttcggtccaccgtccgtcctaccgacgtcccttaaccgaacccgg

SEQ ID NO: 318123 - DNA, 547 bp, Homo sapiens
  misc_feature: GZ8MTXP01A3BZE.44.35.D02.1.454.CMB.2.raw
  modified_base (496)..(496): a, c, t, g, unknown or other
  misc_feature (496)..(496): n is a, c, g, or t
  modified_base (524)..(524): a, c, t, g, unknown or other
  misc_feature (524)..(524): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtggttacatcagtagttattattggattggctgcggcagtccgcgggaggctggatggattgggcgcatctatacagtggcagcacaactacaaccccgctacaagagtcacgtcacagtcgtacaactagcaacgggtaccaaagaacccagttcctaccctagaaattcgaacttctgtcgaccgcgcgacacggacgtatatatgtgcgagagtatcctatcgatacagtaggaggacgggggcaacgtcggcgtccgacccggngggccacgggacccttggtccaccgtcncctcgacgtccttccgaacccgg

SEQ ID NO: 318124 - DNA, 609 bp, Homo sapiens
  misc_feature: GZ8MTXP01ETL53.44.35.D02.1.454.CMB.2.raw
  modified_base (297)..(297): a, c, t, g, unknown or other
  misc_feature (297)..(297): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggccacctcccagatgggtcgtgtccgaggtgcagctgcaggagtcgggcccaggacgggtgaagccttcggagaccctgtccctcacctgcaatgtctcgtggtgtacatcagtagttattatggagttggctgcggcagtccggcgggaaggactggagtggatgggcncgatactagtaacaggtgacagcaaccaaccgtaccaacccccggcctacgaagacgtcacgtcacatcgtccaaactagaacagggtaccaaaggaacctagttctaccctagaaacttgtacttctgtcgaccgtccgcgaacacggacgtatattattggtaggcgtaggtaatacttactatacgtataacgagtaggacgggacgggggacgtaacgtcggacgtccggaccccgtgggggcccaacggggttaaccccgttggttcccgacccgtccttcccgtcgacgcccttaacccgaacccg

SEQ ID NO: 318125 - DNA, 595 bp, Homo sapiens
  misc_feature: GZ8MTXP01DRLXF.44.35.D02.1.454.CMB.2.raw
  modified_base (284)..(284): a, c, t, g, unknown or other
  misc_feature (284)..(284): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtggttacatcagttagttattattggagttggctgcggcagtccgccgggaggacnggagtggattgggcgcatctataacagtggcagcaccaactacaaccccgcctacaagagtcgacgtcaccatgtcaactagcagggtccaaagaacccagttcctcccctagaaacttgacttctgtcgaccgccgcggacaccggccgtatacttattggtcgcgtagtagactttcctatccgattaacaggtagacgggacggggggcaaacgtgggccttccggaccccgttcgggggacccacgggggaaccccttgggtcccgacccgtcgtcccctcgaccgtccccgttccgaaaccccggg

SEQ ID NO: 318126 - DNA, 742 bp, Homo sapiens
  misc_feature: GZ8MTXP01BP4L7.44.35.D02.1.454.CMB.2.raw
  modified_base (237)..(237): a, c, t, g, unknown or other
  misc_feature (237)..(237): n is a, c, g, or t
  modified_base (260)..(260): a, c, t, g, unknown or other
  misc_feature (260)..(260): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtgttacatntagttattattagttggtagtgngtggcggcgacggtccggacgggaggtacggtggtaggtaggtaggttggcgatatactaagtaacgtggtcgacacgaccaacctaaccctaaccccgaccccgtaccctaagaacggtacgtacgtacctaccactagtctaccaaacgtacgaacgtacggtaacccaaacgtaacctacgttaccctaccgtaaagttaaacgttcgtaacctttcgtacggtacccggacccggtacccggacggtaaccgtccggggtaacttaatttaacgtttgttacggacgggtaacgggtaaacggtagtttaccttaccgttaaacgcgttaagtaacggtaagggtaacggggacggggggtacgggggaactaacgggtccggccgtaccccgggaccggtacggggacccgttaccgggttaccgttcggtaaccctaccggtcctacccgcgaccgtccccgttaaccgaacccgg

SEQ ID NO: 318127 - DNA, 601 bp, Homo sapiens
  misc_feature: GZ8MTXP01AG7DR.44.35.D02.1.454.CMB.2.raw
  modified_base (246)..(246): a, c, t, g, unknown or other
  misc_feature (246)..(246): n is a, c, g, or t
  modified_base (271)..(271): a, c, t, g, unknown or other
  misc_feature (271)..(271): n is a, c, g, or t
  modified_base (298)..(298): a, c, t, g, unknown or other
  misc_feature (298)..(298): n is a, c, g, or t
  modified_base (439)..(439): a, c, t, g, unknown or other
  misc_feature (439)..(439): n is a, c, g, or t
tcagacagtatatacacgaccggtgctcgatttagcacacgatagttgggtttgggggggtcacaagaggcagcgctctcgggacgtctccaccatggcctgggctctgctgctcctcactctcctgactcaggacacagggacctgggcccagtccgccctgactcagccagcctccgtgtctgggtctcctggacagtcgctcaccctctcctgcactggaactaatactgatgttagaaaatntaaccttgtctcttggtacaagtanacccagtaaacccccaatccttcttangaagtcaataagcgcctcggcatttctcatcgtcttctcaggctccaacgtctggcaacacggccttcgttgataatttctgcctctgcctgacgtacgaggccgacttattattgctgctcatagtgcgggggtctagtntagttgggtcgttcgggcggtacgggaccggtccgtcggtacccgtcccgtaaggtccaacggccccgaaacgggtcccgtccggccccccgttcgggttccctaacccgttcccgttcccggtttccccccggtccccttcccgttccttaacgttaaccg

SEQ ID NO: 318128 - DNA, 567 bp, Homo sapiens
  misc_feature: GZ8MTXP01CW024.44.35.D02.1.454.CMB.2.raw
  modified_base (346)..(346): a, c, t, g, unknown or other
  misc_feature (346)..(346): n is a, c, g, or t
  modified_base (387)..(387): a, c, t, g, unknown or other
  misc_feature (387)..(387): n is a, c, g, or t
  modified_base (401)..(402): a, c, t, g, unknown or other
  misc_feature (401)..(402): n is a, c, g, or t
  modified_base (413)..(413): a, c, t, g, unknown or other
  misc_feature (413)..(413): n is a, c, g, or t
  modified_base (425)..(425): a, c, t, g, unknown or other
  misc_feature (425)..(425): n is a, c, g, or t
  modified_base (521)..(521): a, c, t, g, unknown or other
  misc_feature (521)..(521): n is a, c, g, or t
tcagacagtatatacacgaccggtgctcgatttagcacacgatagttgggtttgggggcctgggcctcaggaagcagcatcggaggtgcctcagccatggcatggatccctctcttcctcggcgtccttgcttactgcacgagggtccgggcctcctctgacctgactcagccatcctcacttgtccgtcgtccccaggacacacagtcactatacctgctcgtagggaaaacttgagtgaattaaattgcttcctggtactcgagcgagacggccacggccacgcccctagtcgctggtcattcttacaaggtataacgtaagccgccctagtacggacttccgngacgtcgtcttcctcgtcgcctacctacgtcgaacggaacnccgacactcacacnncacgcgccacncgctgtagacgngacgtctagtactatacgtggacgaggtagaggtagtgtacgttaggtcggtcggtcggacggacgacgtaacgtcgttacgtcgttcgtcggacnccggccgacgtccgccgtcccgtcgtccttacctccgttccgtccc

SEQ ID NO: 318129 - DNA, 608 bp, Homo sapiens
  misc_feature: GZ8MTXP01CVQ45.44.35.D02.1.454.CMB.2.raw
  modified_base (356)..(356): a, c, t, g, unknown or other
  misc_feature (356)..(356): n is a, c, g, or t
  modified_base (417)..(417): a, c, t, g, unknown or other
  misc_feature (417)..(417): n is a, c, g, or t
tcagacagtatatacacgaccggtgctcgatttagcacacgatagttgggtttggggcctgggcctcaggaagcagcatcggaggtgcctcagccatggcatggatccctctcttcctcggcgtccttgcttactgcacagggtccggggcctcctctgacctgactcagccatcctcactgtccgtgtccccaggacacacagtcactatacctgctctagggaaacttgagtgataattgcttctgtatcagcagagcaggccagcccctatgctggtcatcttcaggataataagcggccctgagggactcccgtgagcgtcttcctctggcctaccaactcgtagggaaccncggccaactctgaccatccagcgacgacccagcctcgtggatgacggctgacttattaccngggtacgaggtacgtagggaaacgttggacgtttaaggttggggttcggttcggggacgggtacgggacccgtaaagggtcttacgggtacccgttcggtaccgggtccgaaccgggccccgaaacggggtccccttcccgggtcccccgttaccgggtccttacccgtttcccgttccggtttccccccc

SEQ ID NO: 318130 - DNA, 621 bp, Homo sapiens
  misc_feature: GZ8MTXP01AS4B7.44.35.D02.1.454.CMB.2.raw
  modified_base (297)..(297): a, c, t, g, unknown or other
  misc_feature (297)..(297): n is a, c, g, or t
  modified_base (303)..(303): a, c, t, g, unknown or other
  misc_feature (303)..(303): n is a, c, g, or t
  modified_base (307)..(307): a, c, t, g, unknown or other
  misc_feature (307)..(307): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctccagatgggtcgtgtccgaggtgcagctgcaggagtcgggcccagggacgggtgaagccttcggagaccctgtccctcacctgcaatgtctctggtgttacatcagttagttattattggagttggctgcggcaggtccgcgggaaggctggagtggatgggcnatctanaacngtggcagcaccaactaccaaccccgcctacaagagtcgacgtcaccatcgcaaacgtagaacagggtaccaaaggaacctgtttccaccctagtaacttgaacttctgtcgacccgccgcggacacggtccgtatattagttgtcggcgtagagtacttcctatacgataacgtagtaagggtagggaccggggggacaaacggtcgggccgtccggaccccggtgggggaaccccacgggggttaaccccttcggggtaacccacccgggttccctcccggtaccgaccggtccccgttcccgaaaccccggg

SEQ ID NO: 318131 - DNA, 588 bp, Homo sapiens
  misc_feature: GZ8MTXP01C24CU.44.35.D02.1.454.CMB.2.raw
  modified_base (300)..(300): a, c, t, g, unknown or other
  misc_feature (300)..(300): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtgttacatcagtagttattattggagttggctgcggcagtccggccgggaaggctgggagtggattgggcgnatctataacgagtggcagcaaccaacctaaccaaccccgcctacaagagtccgagtccacatcgtcaactagcaggtaccaaagaaccagttacctacccgtagaaacttgacttctagtcgacccgaccgccggacaccgggcctatacttattgtaggacgagtaagacttcctatcgtataacgagtaaggacgggacgggggacaacggtggcgtccggacccgtcggggccaacgggccttcggtccgtacccgtcgtcctcgacgtccgttcccgaacccgg

SEQ ID NO: 318132 - DNA, 570 bp, Homo sapiens
  misc_feature: GZ8MTXP01AUJRJ.44.35.D02.1.454.CMB.2.raw
  modified_base (298)..(298): a, c, t, g, unknown or other
  misc_feature (298)..(298): n is a, c, g, or t
  modified_base (312)..(312): a, c, t, g, unknown or other
  misc_feature (312)..(312): n is a, c, g, or t
  modified_base (465)..(465): a, c, t, g, unknown or other
  misc_feature (465)..(465): n is a, c, g, or t
  modified_base (481)..(481): a, c, t, g, unknown or other
  misc_feature (481)..(481): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtgttacatcagtagttattattggagttggctgcggcagtccgcgggaaggactggagtggattggggcncatctaataacagngcgagcaccaactaaccaaccccgaccctcaagagtacgacgtacacactgtcaactacgaacacgtaccgaaacgaaaccacgttactaccctacgtaaattagtacttactcgtcgaccgaccgacggacgacgacgtatattattgtggngagagatctatcatanagtagaggacgggggcgggaacgtaggcgtcgcccgtcgggccggacgggaccgttacgtcgaccgtcctctcacgccgttccgaaccg

SEQ ID NO: 318133 - DNA, 788 bp, Homo sapiens
  misc_feature: GZ8MTXP01EIGHR.44.35.D02.1.454.CMB.2.raw
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtgttacatcagtagttattattggagttggctgcggcgagtccggcgggaaggactggagtggagttgggcgctatctataacgagtggacagccaccaactaaccaaccccggccctacaacgagtcgacgtccaccatcgtacaactaagaacgacgggtaccaaacggtaaaccctacggtttaccctaccccgttaaggtaaactttcgtaaccgtttaccgttacggttaccggaaccccgtaccccggggtaccgggaacccggaacccgggttacccggttaacgtttaaacgtttaaacgttttccgggttaggggaacccggtaaaggggtacgttaaacgttttaccccttaaagttacccggtaaagttaaacccgtaaagggttaacggggtaacgggggaaaccggggggggtcgtaaaaccggtcggggttacccggttacccgggaaccccggttcggggggacccgaaccgggggttaccccttaggggtaacccaacccggttccgtcccgtacgaccgtccccgttaacccggaaccccggg

SEQ ID NO: 318134 - DNA, 606 bp, Homo sapiens
  misc_feature: GZ8MTXP01AL61U.44.35.D02.1.454.CMB.2.raw
  modified_base (297)..(297): a, c, t, g, unknown or other
  misc_feature (297)..(297): n is a, c, g, or t
  modified_base (443)..(443): a, c, t, g, unknown or other
  misc_feature (443)..(443): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtgttacatcagtagttattattggagttggctgcggcaggtccgcgggaggctggagtggagttgggcncgatctaataacgagtggcagccaccaactaccaaccccgcctacaagcgtcgacgtcaccatcgtcaactagcaggtccaaagaccagttcacctagaaattgacttctagtcgaccgccggcgacacggcttaatattattagnggtacgagtagtacttactaatcggaattacgaggtaacggaggggacggggggcaaacggtcggccgtccggaaccccggtcgggggacccgttacgggggaacccgttgggaacccacccgggttccgttcccctacgaccgtcccgttaacccgaaccgg

SEQ ID NO: 318135 - DNA, 567 bp, Homo sapiens
  misc_feature: GZ8MTXP01DALJT.44.35.D02.1.454.CMB.2.raw
  modified_base (301)..(301): a, c, t, g, unknown or other
  misc_feature (301)..(301): n is a, c, g, or t
  modified_base (346)..(346): a, c, t, g, unknown or other
  misc_feature (346)..(346): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtgttacatcagtagttattattggagttggctgcggcaggtccgccgggaagggactggagtggattgggcgnatctataacagtggcagcaaccaactacaaccccgcctacaaagngtccgacgtcaccatcgtcaactagaacaggtacccaaagaaccagttcctacctagaaattgacttctgtgaacccgcgcggacacggtcgtatattattgtggcgagagtattcctatcgatacagtagaggacgggggcgaaagtggcgtccggacccgtcggggccgacggggaacccttcgggtccaccggtctcctcacgtcccttccgaacccg

SEQ ID NO: 318136 - DNA, 596 bp, Homo sapiens
  misc_feature: GZ8MTXP01E2P0X.44.35.D02.1.454.CMB.2.raw
  modified_base (307)..(307): a, c, t, g, unknown or other
  misc_feature (307)..(307): n is a, c, g, or t
  modified_base (334)..(334): a, c, t, g, unknown or other
  misc_feature (334)..(334): n is a, c, g, or t
  modified_base (338)..(338): a, c, t, g, unknown or other
  misc_feature (338)..(338): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtgttacatcagtagttattattggagttggctgcggcaggtccgcgggaaggactggagtggattggcgcatcataacngtgcagcaccaactacaaccccgctanaagngtcgagtcacatgtcaaactagaacaggtccaaagacctagttccacctagtaaattgacttcgtgtcgaccgccgacggacgacggtcctattacttagttgtcggacgtaagagtaacttcctatcgaatacgaggtagggaagggacggggggcaaacgtcgggcctaccggaccccgtgggggacccgacggggaaccccttgggtaacccaccggtcctcccgtacgaccggtccccttcccgaaaccccggg

SEQ ID NO: 318137 - DNA, 678 bp, Homo sapiens
  misc_feature: GZ8MTXP01AEUX0.44.35.D02.1.454.CMB.2.raw
  modified_base (298)..(298): a, c, t, g, unknown or other
  misc_feature (298)..(298): n is a, c, g, or t
  modified_base (308)..(308): a, c, t, g, unknown or other
  misc_feature (308)..(308): n is a, c, g, or t
  modified_base (337)..(337): a, c, t, g, unknown or other
  misc_feature (337)..(337): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtgttacatcagtagttattattggagttggctgcggcaggtccgcgggaaggctggagtggattgggcgnatctataacngtggcagcaccaactaccaaccccgctanaagacgtcgacgtcacatcgtacaaactaagaacagggtaccaaagacccagtttccaccctagaaacttgactttctgtacgaccgccggacgacgaccggtctatacttagttgtacggacgtagtacgtacttaccgtaatacggaacttaacggaacggttaagggaacgggggaacggggggtaaccgtaaacggttccgggttaccggtaccccggttaaccccgggttacgggggaacccgttaaacgggggttacccccttacgggggtaaccctaaccccggttcccttccccgttacgacccggtaaccccgttaaccccgaaaccccggg

SEQ ID NO: 318138 - DNA, 587 bp, Homo sapiens
  misc_feature: GZ8MTXP01AO9VK.44.35.D02.1.454.CMB.2.raw
  modified_base (297)..(297): a, c, t, g, unknown or other
  misc_feature (297)..(297): n is a, c, g, or t
  modified_base (309)..(309): a, c, t, g, unknown or other
  misc_feature (309)..(309): n is a, c, g, or t
  modified_base (327)..(327): a, c, t, g, unknown or other
  misc_feature (327)..(327): n is a, c, g, or t
  modified_base (330)..(330): a, c, t, g, unknown or other
  misc_feature (330)..(330): n is a, c, g, or t
  modified_base (333)..(333): a, c, t, g, unknown or other
  misc_feature (333)..(333): n is a, c, g, or t
  modified_base (339)..(339): a, c, t, g, unknown or other
  misc_feature (339)..(339): n is a, c, g, or t
  modified_base (343)..(343): a, c, t, g, unknown or other
  misc_feature (343)..(343): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccagggacgggtgaagccttcggagaccctgtcccctcacctgcaatgtctctggtgttacatcagtagttattatggagttggctgcggcagtccgcggggaggctggagtggattgggcncatctataacgngtgcagcacacaccaccncanagntcgacncacntcgcaacagaacacgtaccaagactgttactactataattcgtacttctagtcgaccgaccgacgacgtacggtacgttatattagtgtaggacgagtagtacttactagtacgtagtacgaggtagggacggggacgggggcgtaacggtcggccgtaccggaccggtcggggaccgaccgggttacccgttcggtaacccgtaccgttcctcccgtccgaccgtcccgttaacccgaaccgg

SEQ ID NO: 318139 - DNA, 568 bp, Homo sapiens
  misc_feature: GZ8MTXP01EY2NB.44.35.D02.1.454.CMB.2.raw
  modified_base (308)..(308): a, c, t, g, unknown or other
  misc_feature (308)..(308): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtgttacatcagtagttattattggagttggctgcggcagtccgcgggaaggactggagtggattgggcgcatctataacngtggcagcaccaactacaacccccgcctacaagagtcgacgtcaccatcgtccaaactagcagggtccaaagaccagttctaccctagaaacttgacttctgtgaccgccgacggacacggccgtactattattgtggcgagagtattctatcgatacgagtagacggacgggggtcgaacgtggctcggacccgtcggggccgacgggacccgttcgggtcccaccggtcctaccgtcgacgtcccgttccgaacccgg

SEQ ID NO: 318140 - DNA, 532 bp, Homo sapiens
  misc_feature: GZ8MTXP01DVWHX.44.35.D02.1.454.CMB.2.raw
  modified_base (487)..(487): a, c, t, g, unknown or other
  misc_feature (487)..(487): n is a, c, g, or t
  modified_base (515)..(515): a, c, t, g, unknown or other
  misc_feature (515)..(515): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtgttacatcagtagttattatggagttggctgcggcagtccgcgggaaggactggagtggattgggcgcatctataacagtgcagcacaactacaaccccgcctacaagagtcgacgtcacatgtcaactagcaggtacccaaagaaccagttctaccctagtaaattgacttctgtgaccgaccgcgacacgggacctatattatactggcgagagattctatcatacagtagagcgggggcaagtcggctcgaccgnggggcagggacccttgtccacgtctccngacgccttccaacccgg

SEQ ID NO: 318141 - DNA, 709 bp, Homo sapiens
  misc_feature: GZ8MTXP01ASW8V.44.35.D02.1.454.CMB.2.raw
  modified_base (312)..(312): a, c, t, g, unknown or other
  misc_feature (312)..(312): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctcgtggtgttacatcagtagttattagttggagttgctgcggcagtccggcgggaaggctggagtggagttgggcgcatctagtaacgngtggcagcaaccaactaccaaccccgcctacaagacgtacgacgtaccacatcgacaaactagaacgaggtaccaaagaaccctagttaccctaccctaagtaaacttcgacctttcgtcggtacggacccgcccggaccggaaccgtaccgggtacccgttaattaacgtttagtttggtacgggtcggtaaagtacgtactttcccgtaagtcgtaagtaaccgtagggttaacgggaacgggggtaccggggggaccgtaaacggtcggggaccgtacccgggaccccgggttcgggggaacccgaaccgggggttaccccgttcggggtaaccccgtacccgggtcccttacccggtaccgttacccgtccccgttaacccgaacccccgggg

SEQ ID NO: 318142 - DNA, 548 bp, Homo sapiens
  misc_feature: GZ8MTXP01AQOEZ.44.35.D02.1.454.CMB.2.raw
  modified_base (333)..(333): a, c, t, g, unknown or other
  misc_feature (333)..(333): n is a, c, g, or t
  modified_base (337)..(337): a, c, t, g, unknown or other
  misc_feature (337)..(337): n is a, c, g, or t
  modified_base (348)..(348): a, c, t, g, unknown or other
  misc_feature (348)..(348): n is a, c, g, or t
  modified_base (376)..(376): a, c, t, g, unknown or other
  misc_feature (376)..(376): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtggttacatcagtagttattatggagttggctgcggcagtccgcggaggctggagtggatgggcgcatctataacagtggcagcaccaactacaaccccgcctanaagngtcgagtcacntcgtcaactagcaggtcccaaagacccngttcctcctagaaattgacttctgtcgacccgcgacgacacggccgtatacttattgtggcgagagtattcctagtacgatacgagtaggaggacggggggcaacgtggcgtcggacccgtggggccacgggacccttggccaccggtctccgtcacgtccgttcgaacccg

SEQ ID NO: 318143 - DNA, 644 bp, Homo sapiens
  misc_feature: GZ8MTXP01DPJ3O.44.35.D02.1.454.CMB.2.raw
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtgttacatcagtagttattattggagttggctgcggcaggtccgcgggaaggctggagtggattgggcgcagtctaagtaacagtggacaagccaaccaaactaccgaacccccgcctacaaagacgtcgaacgtcaacagtcgcaaactagaacaggtacccaaagaaccctagttcctacctagtaaacttgtaacttcgtgtacgacccgaccggacggaaccaccgggtacctaatattagttgtgggtacgtaagtagtacttcctagtcgaagttaacaggtacggagggacgggggctaaacgtcggcgtaccggacccggtacggggacccgaacggggttaacccgttcgggtaacctaacccggtccttcccgaccgttacgccccgttaacccgtaaaccccggg

SEQ ID NO: 318144 - DNA, 666 bp, Homo sapiens
  misc_feature: GZ8MTXP01EJWL8.44.35.D02.1.454.CMB.2.raw
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtggttacatcagtagttattattggagttggctgcggcagtccggccgggaagggactgggagtggagttgggcgcatctataacgagtggcagcaccaactacaccccgcctcaagcgcgacgtcacatcgtcaactagaacaggtaccaaacgaacctagttacctaccctagtaaacttgtaacttcgtcgtacgacccgtaccggccggaacgaccgggtaccttagtatttaattcgtgggtacgtagtagtactttaccgtatacggtataaaccgtaggtaagggaacggggaccggggggcgtaaacggtcggaccgttacccgggaccccggttagggggacccgaaccgggggttaccccgttacgggttaacccgaccccggttcgttccccgaccgttacggtcccccgttaacccgaaccccggg

SEQ ID NO: 318145 - DNA, 556 bp, Homo sapiens
  misc_feature: GZ8MTXP01BIOU0.44.35.D02.1.454.CMB.2.raw
  modified_base (305)..(305): a, c, t, g, unknown or other
  misc_feature (305)..(305): n is a, c, g, or t
  modified_base (337)..(337): a, c, t, g, unknown or other
  misc_feature (337)..(337): n is a, c, g, or t
  modified_base (382)..(382): a, c, t, g, unknown or other
  misc_feature (382)..(382): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacggtgaagccttcggagaccctgtccctcacctgcaatgtctctggtggttacatcagtagttattattggagttggctgcggcagtccgccgggaaggctggagtggattgggcgcagtctanaacagtggcagcaccaactacaaccccgcctnaagagtcgagtcacatgtcaactagcaggtccaaagaccagttcnccctgaaattgacttctgtcgaccgccgcggacacggcctagtattaattgtggcgtaagagtattcctatcgataacgagtaggaggcggggggcgaaacgtggcgtcggaccccgtggggccagggaaccccttggtccaccggtctcccgtcgacgtcccttccgaacccg

SEQ ID NO: 318146 - DNA, 659 bp, Homo sapiens
  misc_feature: GZ8MTXP01EYX0G.44.35.D02.1.454.CMB.2.raw
  modified_base (244)..(244): a, c, t, g, unknown or other
  misc_feature (244)..(244): n is a, c, g, or t
  modified_base (249)..(249): a, c, t, g, unknown or other
  misc_feature (249)..(249): n is a, c, g, or t
  modified_base (282)..(282): a, c, t, g, unknown or other
  misc_feature (282)..(282): n is a, c, g, or t
  modified_base (286)..(287): a, c, t, g, unknown or other
  misc_feature (286)..(287): n is a, c, g, or t
  modified_base (292)..(292): a, c, t, g, unknown or other
  misc_feature (292)..(292): n is a, c, g, or t
  modified_base (362)..(362): a, c, t, g, unknown or other
  misc_feature (362)..(362): n is a, c, g, or t
tcagacagtatatacacgaccggtgctcgatttagcacacgatagttgggtttggggggggtcacaagaggcagcgctctcgggacgtctccaccatggcctgggctctgctgctcctcactctcctgactcaggacacagggacctgggcccagtccgccctgactcagccagcctccgtgtctgggtctccgtggacagtcgctcaccctctcctgcactgaactatactgatgtagaaatntactntctctgacagtacaccacgtaaccccaactctnttannaagtnaatacgcgcctcggctatttctcatcgtcttctcacgctacaacgtctaggacaacgacgtccttcgttnattaacttcgtcgtcctctcgcctgacgacgacgccgacttattatcgctcgctactattacgtcggtcgggggttaccttaaggtagtttacggtttcggggttccgttaccgggggacgggttaacccgggggacccggtcccgttacgggtaccccgttccggtaagggttcccgaacgggtaccccgaaacgggtcccgttccccggttccccccgttcgggttaccccttaaccggttccctttcccgttaccccctaccccttaccgttaacccgtttaacgtttaacccg

SEQ ID NO: 318147 - DNA, 789 bp, Homo sapiens
  misc_feature: GZ8MTXP01BNEYS.44.35.D02.1.454.CMB.2.raw
tcagacagtatatacacgaccggtgctcgatttagcacacgatagttgggtttgggggcctgggcctcaggaagcagcatcggaggtgcctcagccatggcatggatccctctcttcctcggcgtccttgcttactgcacgagggtccgggcctcctctgacctgactcagccatcctcactgtccgtgtccccaggacacacacgtcactattaccctgctacgtaggggaaaacttgagtagtaattaaatttgctttccgtggtactcgagcgagacggccacggccctacgccccctagtcgcctcggtcattcctttacgaaggtaataaacgtaacggccggtccctacgaacgggtacctcccgtgacgccgtcttccccctcggtcggtaccctacccgtaacgttacccggtacgggaaccgacccgggtaccccaaaccggttccctaccgggaacccaaacgttcccgacgggtcccgacccggaaccccgacgtccccgttaggtacgggtatacgggaacggtcctaacgtaacttacgttaccgttacggggtacgtaacgggtaaccgggttaaggggaaacggttcggtaaccggtttaaggtttcgggggttacggtttcccgggggacggtaaccggggaacccgtaagggtcccggttaccgggtacccgtttaccgggtccgggtaacccaccgggttacccggaacggtccccgtcccggtcccccggttcggtcccgttacccttccggtttccccggttaaccccc

SEQ ID NO: 318148 - DNA, 560 bp, Homo sapiens
  misc_feature: GZ8MTXP01BUS7R.44.35.D02.1.454.CMB.2.raw
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtggttacatcagtagttattattggagttggctgcggcaggtccggcgggaagggactgggagtggagttgggcgcatctataacagtgcagcaccaactacaaccccgcctcaagagtcgacgtcacatgtcaactagcaggtacccaaagaaccagttctccctagaaattgtacttctgtcgaccgccgcggacacggccgtatattattgtggcgagagtattcctatcgatacagtaggagggacggggggcgaacgtgggcgtcggacccgtggggccgacgggacccttcggtccaccggtctcctcacgtcccttccgaacccg

SEQ ID NO: 318149 - DNA, 766 bp, Homo sapiens
  misc_feature: GZ8MTXP01ALSDJ.44.35.D02.1.454.CMB.2.raw
  modified_base (299)..(299): a, c, t, g, unknown or other
  misc_feature (299)..(299): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacggtgaagccttcggagaccctgtccctcacctgcaatgtctctggtgttacatcagtagttattattggagttggctgcggcagtccgcgggaaggactggagtggattgggcgcanctataacagtgcagcaccaactaccaaccccgcctacaagacgtcgacgtccacatcgtcaactagcagggtaccaaagaaccctaggttcctaccccgtagaaactttgaacctttcgtagttaccggacccgaccccggcgggaaacccgaccggggacccgttaagtaacgtttaagtttcggtacgggggtaccgtaagggtaacggtactttacccgtaacgttcccgtaaattaaccgtaaggttaaaggggaaccggggggtaaccgggggggggcggtaaaaccggtttcgggggacccggttaccccgggggttaaaccccccggttacgggggggaaccccggttaaccggggggttaaaaccccgttccgggggtttcccccgaaacccgggtttcccccgtaccccggttaccgacccgggtaacccccgtttaaccccggaaaaccccccgggg

SEQ ID NO: 318150 - DNA, 586 bp, Homo sapiens
  misc_feature: GZ8MTXP01BPC3N.44.35.D02.1.454.CMB.2.raw
  modified_base (310)..(310): a, c, t, g, unknown or other
  misc_feature (310)..(310): n is a, c, g, or t
  modified_base (343)..(343): a, c, t, g, unknown or other
  misc_feature (343)..(343): n is a, c, g, or t
  modified_base (405)..(405): a, c, t, g, unknown or other
  misc_feature (405)..(405): n is a, c, g, or t
  modified_base (421)..(421): a, c, t, g, unknown or other
  misc_feature (421)..(421): n is a, c, g, or t
  modified_base (437)..(437): a, c, t, g, unknown or other
  misc_feature (437)..(437): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacggtgaagccttcggagaccctgtccctcacctgcaatgtctcgtggtgttacatcagttagttattattggagttggctgcggcaggtccggcgggaaggctggagtggattgggcgcatctataacnggtgcagcaccaactacaacccccgctacaagngtcacgtcacatgtcaaactagcaggtcccaaagacctagttccacctagaacttgacttcngtcgaccgccgcgacncggctatattactggnggacgtagagtacttcctagtccgtataacgagtaggagggtacgggggcaacgtcggccgtaccggcccggttaggggcccgaacggggacccgttcggtaaccctaccgtccgtccgtaccgaccgtcccgttaaccgaaccccggg

SEQ ID NO: 318151 - DNA, 570 bp, Homo sapiens
  misc_feature: GZ8MTXP01BO0V4.44.35.D02.1.454.CMB.2.raw
  modified_base (297)..(297): a, c, t, g, unknown or other
  misc_feature (297)..(297): n is a, c, g, or t
  modified_base (307)..(307): a, c, t, g, unknown or other
  misc_feature (307)..(307): n is a, c, g, or t
  modified_base (334)..(334): a, c, t, g, unknown or other
  misc_feature (334)..(334): n is a, c, g, or t
  modified_base (338)..(338): a, c, t, g, unknown or other
  misc_feature (338)..(338): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtgttacatcagtagttattagttggagttggctgcggcagtccgcgggaggactggagtggattgggcnatctataacngtgcagcaccaactacaaccccgctanaagngtcgacgtcacatgtacaactagcacggtccaaagaaccctagttctaccctagaaacttgtacttctgtcgaccgccgcgacgacggcgtatacttagtgtggcgagtagtacttctatcgatacgagtaggagggacgggggcaacgtggcgtccggacccgtgggggcccgacggggacccttcggtccgacccgtccgtcccgtcgaccgtcccgttcccgaacccgg

SEQ ID NO: 318152 - DNA, 630 bp, Homo sapiens
  misc_feature: GZ8MTXP01A47MN.44.35.D02.1.454.CMB.2.raw
  modified_base (297)..(297): a, c, t, g, unknown or other
  misc_feature (297)..(297): n is a, c, g, or t
  modified_base (307)..(307): a, c, t, g, unknown or other
  misc_feature (307)..(307): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccagggacgggtgaagccttcggagaccctgtccctcacctgcaatgtctctggtgttacatcagttattattattggagttggctgcggcagtccgcgggaaggctggagtggattgggcncatctatacngtgcagcaccaactaccaaccccgcctacaagcgtacgacgtccacatcgtacaactagaacaggtacccaaagaccctgttaccaccgtagtaaacttcgaacttcgtcgtacgaccgtccggacggtaccgaccggtaccgttagtattacgttacggtggacgtagtacgtacttaccgtagtcgtaataacgtacggtaggacgggtacgggggacgaacgtacgggccgtaccggacccggtcgggggacccgaacggggacccgttcgggtaacccgacccggtcctcccgtcaccggtcccttaaccgaaccccgg

SEQ ID NO: 318153 - DNA, 670 bp, Homo sapiens
  misc_feature: GZ8MTXP01A7Q6T.44.35.D02.1.454.CMB.2.raw
  modified_base (199)..(199): a, c, t, g, unknown or other
  misc_feature (199)..(199): n is a, c, g, or t
  modified_base (246)..(246): a, c, t, g, unknown or other
  misc_feature (246)..(246): n is a, c, g, or t
  modified_base (258)..(258): a, c, t, g, unknown or other
  misc_feature (258)..(258): n is a, c, g, or t
  modified_base (269)..(269): a, c, t, g, unknown or other
  misc_feature (269)..(269): n is a, c, g, or t
  modified_base (300)..(300): a, c, t, g, unknown or other
  misc_feature (300)..(300): n is a, c, g, or t
tcagacagtatatacacgaccggtgctcgatttagcacacgatagttgggtttggggggggtcacaagaggcagcgctctcgggacgtctccaccatggcctgggctctgctgctcctcactctcctgactcaggacacagggacctgggcccagtccgccctgactcagccagcctccgtgtctgggtctcctggacngtcgctcaccctctcctgcactggaactaatactgatgttagaaatntaaccttgtctntggtacaatanaccacgtaaccccaactcttcttatgaatanaatacgcgtcctcggctattcgcatcgtcttctcacggtctccgaacgtcgtacgacaaaccgcggtaccttacggttcgtacttaaacgtttcctcggtcctctcgtcctagacgacgacggtccgtaacttatttagttcgtctggtcttactagttacgttacggtcggggttaccgtaaggttacttaggtttcgggttaccgttcggggtacggggtaccggggtccggtaaccgtcggtacccggttccgtaacgggttccgaccggtcccgaaacggtcccgttcccggttcccccggttcggttcccgtaaccgttccgttcccgttccccggtccctttaccctcgttaactttaacccgg

SEQ ID NO: 318154 - DNA, 701 bp, Homo sapiens
  misc_feature: GZ8MTXP01AM9GH.44.35.D02.1.454.CMB.2.raw
  modified_base (263)..(263): a, c, t, g, unknown or other
  misc_feature (263)..(263): n is a, c, g, or t
  modified_base (291)..(291): a, c, t, g, unknown or other
  misc_feature (291)..(291): n is a, c, g, or t
  modified_base (331)..(331): a, c, t, g, unknown or other
  misc_feature (331)..(331): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacggtgaagccttcggagaccctgtccctcacctgcaatgtctctggtgttacatcagtagttatagttggagttgctgcggnagtcgcggaggctggagtggattgggcncatctatacagtgcagcaccgaactaccaaccccgcctanaagcgtcgacgtccacaatcgtacaaactagaacagggtcccaaaggaccctagttcctccctagtaaactttcgaactttcgtacgtcgacccggacccgacgggacctaacccgggccgttaattagtttaagttcgtaggggtccggtaaaggtacgtacgtttacctaacgttacgaacgttaaccgtaaggggttacggaacgggggtaacccgggggggggaccgtaaaccggtttcggggacccgttaccccgggaccccgggttacgggggacccggttaaccgggggttaccccgttcgggggtaaccctacccgggttccttaccccggtccgttacggccccttcccgaaacccccggg

SEQ ID NO: 318155 - DNA, 653 bp, Homo sapiens
  misc_feature: GZ8MTXP01DBB5G.44.35.D02.1.454.CMB.2.raw
  modified_base (302)..(302): a, c, t, g, unknown or other
  misc_feature (302)..(302): n is a, c, g, or t
  modified_base (570)..(570): a, c, t, g, unknown or other
  misc_feature (570)..(570): n is a, c, g, or t
  modified_base (627)..(627): a, c, t, g, unknown or other
  misc_feature (627)..(627): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgacaatgtctcgtggtgttacatcagttagttattatggagttggctgcggcaggtccgcgggaaggctggagtgggattgggcganagtctaaagtaaacgagtcggacaagacctaaccaaaccttacccgaacccccgcctacaaagtacgtccgaacgtccaactagtcgtaccaaaacttacgaacgaaacgggtaacccaaaacgtacccgtagtttacccctaccgtaaagtaaacttacgtaacttcgttgtacgacccgaccgacgacgaccggacgttatacttagtcgtaggacgagtaagtacttactagtacgtacaacgtaagtagggaggaccggggganaacgtcggcgtaccgacccgtggggacccgacgggttacccgcggtccacccggtcncctcgaccgtcccttaacgaaacccg

SEQ ID NO: 318156 - DNA, 703 bp, Homo sapiens
  misc_feature: GZ8MTXP01E0VQO.44.35.D02.1.454.CMB.2.raw
  modified_base (335)..(335): a, c, t, g, unknown or other
  misc_feature (335)..(335): n is a, c, g, or t
  modified_base (365)..(365): a, c, t, g, unknown or other
  misc_feature (365)..(365): n is a, c, g, or t
tcagacagtatatacacgaccggtgctcgatttagcacacgatagttggggtttgggggcctgggcctcaggaagcagcatcggaggtgcctcagccatggcatggatccctctcttcctcggcgtccttgcttactgcacgaggggtccgggcctcctctgacctgactcagccatccctcactgtcccgtcgtccccaggacacacagtcaacttattacctgtaccttcggtaagggggtaaaacttggaagttagtaaattaaagttttgcctttccgtaggtactcgagcaggacgccacggccaccgcccctagcgctgctattcttanaggaataagacgccgcctagaggtactcgngagccgtcttcccgtcgtcgtacctaccgtaacgtacggtacgggaacccgtccgggccctaactcgtaaccggacctacgtacccgacggacccgacccggaccctaacggtccccgttagtacggagtcggacgtcgtacgtacttaacttacgttagggtaccgtaggtaacggtagggaacgtgtaacggtttaggttacggggtcggttcgggacgggacggaacggtaacggtcggttaccgtaccggtttccgaccggtcggaccgcccggaacggtccccgtcccgttaaccccgtcgtaccttaccgttcccttaacccgttaaccccc

SEQ ID NO: 318157 - DNA, 636 bp, Homo sapiens
  misc_feature: GZ8MTXP01EM2BB.44.35.D02.1.454.CMB.2.raw
tcagacagtatatacacgaccggtgctcgatttagcacacgatagttgggtttggggatactttctgagactcatgggcctcctgcacaagaacatgaaaacacctgtggttcttcctcctcctggtggcaccctcccagatgggtcgtgtccgaggtgcagctgcaggagtcgggcccaggacgggtgaagccttcggagaccctgtccctcactgcaatgtctcgtggtgttacatcagtagttattattggagttggctgcggcagtccggcgggaagggactgggagtaggagtttggggcgcataccgtagtaaacaggtggacagtccaaccaaaccctaccaacccccgcctacgaagacgtcgaacgtccacagtcgtacaaactagaacagggtccaaacgaacctacgttcctacctagtaaacttgacttctggtacgcccgaccgcgaccgacggccgttatagttattggtaggggtacgtagtacgtacttactagtacgtagtaaacgacggtaagagggtaccggggggacaacggttcggcgtccgacccgtggggacccgacggggaccttcggtaaccaccggtcctccgtacgccgtaacccgttccgaacccggg

SEQ ID NO: 318158 - DNA, 641 bp, Homo sapiens
  misc_feature: GZ8MTXP01CQFK6.44.35.D02.1.454.CMB.2.raw
  modified_base (255)..(255): a, c, t, g, unknown or other
  misc_feature (255)..(255): n is a, c, g, or t
  modified_base (292)..(292): a, c, t, g, unknown or other
  misc_feature (292)..(292): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtgtacatcagtagttatatggagttgntgcggcagtccgcgggaaggctggagtggagtggcgnatctataacagtggcagcacaactacaaccccgctacaagcgtcgacgtcacatcgtacaactaacgaacaacggtaccaaagaacctagttcctacccgtagtaaacttgacttcgtacgtacgacccgaccgaccggaacgtaccgggtacccgttagttaatttacgttagttgggacggtaaggtacgtaacgtttaccctaagtacgtaacgtaaacgtaggtaacgggacgggaaccggggggacgtaaacgttcgggaccgttccggaaccccggtgggggacccgacgggacccgttcggtccacccgttccgtcctcgaccgtcccgaaccgaaccccgg

SEQ ID NO: 318159 - DNA, 525 bp, Homo sapiens
  misc_feature: GZ8MTXP02F72NW.44.35.D02.1.454.CMB.2.raw
  modified_base (355)..(355): a, c, t, g, unknown or other
  misc_feature (355)..(355): n is a, c, g, or t
  modified_base (376)..(376): a, c, t, g, unknown or other
  misc_feature (376)..(376): n is a, c, g, or t
tcagacagtatatacacgaccggtgctcgatttagcacacgatagttgggtttggggcctgggcctcaggaagcagcatcggaggtgcctcagccatggcatggatccctctcttcctcggcgtccttgcttactgcacagggtccggggcctcctctgacctgactcagccatcctcactgtccgtgtccccaggacacacagtcactattacctgctctgggaaacttgagtgataaattgcttctggtatcagcagaggccaggccagccccctatgctggtcatctttcaggataataagcggccctcgagggatcccctgagcgcttcctctggctccaactctgggacncggccactctgaccatcagcncgacccagcctctggactgaggctgactatactgtcagacgtgggaaagtgctaagttgggtgttcggcggaggaccaaggctggaccgttcgtcggtcacgcccgaaggcctcggcccccctcggtccaccgtccgttcgttcccccg

SEQ ID NO: 318160 - DNA, 551 bp, Homo sapiens
  misc_feature: GZ8MTXP02F0F4H.44.35.D02.1.454.CMB.2.raw
  modified_base (354)..(354): a, c, t, g, unknown or other
  misc_feature (354)..(354): n is a, c, g, or t
  modified_base (387)..(387): a, c, t, g, unknown or other
  misc_feature (387)..(387): n is a, c, g, or t
tcagacagtatatacacgaccggtgctcgatttagcacacgatagttgggtttggggcctgggcctcaggaagcagcatcggaggtgcctcagccatggcatggatccctctcttcctcggcgtccttgcttactgcacagggtccggggcctcctctgacctgactcagccatcctcactgtccgtgtccccaggacacacagtcactattacctgctctggggaaaacttgagtgataaattgcttctggtatcagcagaggcaggccagccccctatgctggtcatctttcaggataataagcggccctcagggatccctgagcgcttcctctggctccaactctgggacncggccactctgaccatcagcgcacccagccctntggactgaggctagactattactgtcagacgtgggaaatgactaagttgggtgttcggacgggtaggggacccaaggccgtaggacccgtttcgtcggtaccgacggccccaaagggccttccggcccccgttcgggtacctaccgttccgttcgtttcccccc

SEQ ID NO: 318161 - DNA, 548 bp, Homo sapiens
  misc_feature: GZ8MTXP02GDCAF.44.35.D02.1.454.CMB.2.raw
  modified_base (329)..(329): a, c, t, g, unknown or other
  misc_feature (329)..(329): n is a, c, g, or t
tcagacagtatatacacgaccggtgctcgatttagcacacgatagttgggtttggggggtcacaagaggcagcgctctcgggacgtctccaccatggcctgggctctgctgctcctcactctcctgactcaggacacagggacctgggcccagtccgccctgactcagccagcctccgtgtctgggtctcctggacagtcgctcaccctctcctgcactggaactaatactgatgttggaaatataaccttgtctcttggtaccaagtatacccaggtaaaccccccaaactccttacttatgaagtcaataagcgcctcggcatttcncatcgcttctcagctccaagtctgcaacacggcctcgttgataattctgcctctgcctgacgacgaggccgactattatcgctgctcatatgcgggtctagattagttgggtacttcgggcgggtacgggaccggtccgtaggacccgtcctacgggtccacggccccgaaaggcctcgcccccgtggtccaactctcgttccccacctcctctactac

SEQ ID NO: 318162 - DNA, 546 bp, Homo sapiens
  misc_feature: GZ8MTXP02GXHB9.44.35.D02.1.454.CMB.2.raw
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtgttacatcagtagttattattggagttggctgcggcagtccgccgggaaggactgggagtggattgggcgcatctataacagtggcagcaccaactaccaaccccgccctcaagagtcgacgtcaccatgtcactagcaggtccaaagaaccagttctccctagaaattgacttctgtcgaccgccgcggacacggccgtatattattgtgcgagagtattcctatcgatacagtagaggacgggggcgaacgtggctcggacccgtcggggaccgacgggaaccctggccgaccgtctcctcacgcctaccaaccg

SEQ ID NO: 318163 - DNA, 514 bp, Homo sapiens
  misc_feature: GZ8MTXP02G9G7S.44.35.D02.1.454.CMB.2.raw
  modified_base (388)..(388): a, c, t, g, unknown or other
  misc_feature (388)..(388): n is a, c, g, or t
  modified_base (406)..(406): a, c, t, g, unknown or other
  misc_feature (406)..(406): n is a, c, g, or t
  modified_base (445)..(445): a, c, t, g, unknown or other
  misc_feature (445)..(445): n is a, c, g, or t
  modified_base (469)..(469): a, c, t, g, unknown or other
  misc_feature (469)..(469): n is a, c, g, or t
tcagacagtatatacacgaccggtgctcgatttagcacacgatagttgggtttggggcctgggcctcaggaagcagcatcggaggtgcctcagccatggcatggatccctctcttcctcggcgtccttgcttactgcacagggtccggggcctcctctgacctgactcagccatcctcactgtccgtgtccccaggacacacagtcactattacctgctctgggaaacttgagtgataaattgcttctggtatcagcagagcaggccagccccctatgctggtcatctttcaggataataagcggccctcagggatccctgagcgcttcctctggctccaactctgggacacggccactctgaccatcagcgcgacccagcctctggntgaggctagactattacngtacagacgtgggaaatgactaagttgggtagttcgggnggagggaccaagcgtgacccgttnacggtcacgccgaaggctcgccccgtcggcactcgtcgttccccg

SEQ ID NO: 318164 - DNA, 550 bp, Homo sapiens
  misc_feature: GZ8MTXP02G00HT.44.35.D02.1.454.CMB.2.raw
  modified_base (384)..(384): a, c, t, g, unknown or other
  misc_feature (384)..(384): n is a, c, g, or t
  modified_base (401)..(401): a, c, t, g, unknown or other
  misc_feature (401)..(401): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtgttacatcagtagttattattggagttggctgcggcagtccgccgggaaggactggagtggattgggcgcatctataacagtggcagcaccaactacaaccccgccctcaagagtcgagtccaccatgtcactagcaggtccaaagaccagttcnccctgaaattgacttcngtgaccgccgcggacacggccgtatattattgtgcgagagattcctatcgatacagtagaggacgggggcgaacgtggctccggacccgtgggggcccacggggaacccgtgggtccacccggtctacccgtcacggccctcgaacccg

SEQ ID NO: 318165 - DNA, 520 bp, Homo sapiens
  misc_feature: GZ8MTXP02IGWMB.44.35.D02.1.454.CMB.2.raw
  modified_base (429)..(429): a, c, t, g, unknown or other
  misc_feature (429)..(429): n is a, c, g, or t
tcagacagtatatacacgaccggtgctcgatttagcacacgatagttgggtttgggggtcacaagaggcagcgctctcgggacgtctccaccatggcctgggctctgctgctcctcactctcctgactcaggacacagggacctgggcccagtccgccctgactcagccagcctccgtgtctgggtctcctggacagtcggtcaccatctcctgcactggagccagcggtaatattcttagtcttaacttgtctcctggtatcacatcatccagtaaagccccaaactcatcatctatgagctataagaggcctcagggtttctaatcgcttccactgcctccaagtccggcacacggccctccctgaccaatctctgggctcccaggctgagacgaggctgattatattgttgctcagtatgtcgtcnatctacttatcgtcgtaggtaacgtacggacgtacggtacctaccgtcgtacgtacacgaaccgaacgacccacccactcgtacctactcg

SEQ ID NO: 318166 - DNA, 543 bp, Homo sapiens
  misc_feature: GZ8MTXP02GHTBX.44.35.D02.1.454.CMB.2.raw
  modified_base (393)..(393): a, c, t, g, unknown or other
  misc_feature (393)..(393): n is a, c, g, or t
  modified_base (439)..(439): a, c, t, g, unknown or other
  misc_feature (439)..(439): n is a, c, g, or t
tcagacagtatatacacgaccggtgctcgatttagcacacgatagttgggtttgggggcctgggcctcaggaagcagcatcggaggtgcctcagccatggcatggatccctctcttcctcggcgtccttgcttactgcacagggtccggggcctcctctgacctgactcagccatcctcactgtccgtgtccccaggacacacagtcactattacctgctctgggaaacttgagtgataaattgcttctggtatcagcagaggcaggccagccccctatcgctggtcatctttcaggataataagcggccctcagggatcccctgagcgcttcctctggctccgaactctgggacacggccacgtctgaccatcagcgcgacccagcctctgntgagctgactattactgtcagacgtagggaaatgactaagttgggngttcgggcggaggggaccaaggtcgtacggaccgttcgtccggtacacggccccgaaaggccgtcggcccccgtacggtccctacgttcctacgtttccccccg

SEQ ID NO: 318167 - DNA, 548 bp, Homo sapiens
  misc_feature: GZ8MTXP02GGCG7.44.35.D02.1.454.CMB.2.raw
  modified_base (335)..(335): a, c, t, g, unknown or other
  misc_feature (335)..(335): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctatccctcacctgcaatgtctctggtggttacatcagtagttattattggagttggctgcgcagtccgcgggaaggctggagtggattgggcgcatctatacagtggcagcaccaactacaaccccgccctnaagagtcgacgtccaccatcgtcaactagacaggtccaaagaaccagttctccctagaaattgaacttctgtcgaccgccgcggacacggccgtatattattgtgcgagagattcctatcgatacagtagaggacgggggacaacgtggctcggacccgtggggaccgacgggaaccctggccgaccgtcgtcctcgacgccctaccaacccg

SEQ ID NO: 318168 - DNA, 539 bp, Homo sapiens
  misc_feature: GZ8MTXP02JCA7H.44.35.D02.1.454.CMB.2.raw
  modified_base (387)..(387): a, c, t, g, unknown or other
  misc_feature (387)..(387): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtgttacatcagtagttattattggagttggctgcggcagtccgccgggaagggactggagtggattggggcgcatctataacagtggcagcaccaactacaaccccgccctcaagagtcgagtcaccatgtcactagcaggtcccaaagaaccagttcnccctagaaattgacttctgtgaccgcgcggacacggccgtatattattgtgcgagagattacctatcgatacagtagagacgggggcaacgtggctcgacccgtcgggccgacggggaccctggtcgaccgtctcctcacgtcctacaaccg

SEQ ID NO: 318169 - DNA, 653 bp, Homo sapiens
  misc_feature: GZ8MTXP02I4BX2.44.35.D02.1.454.CMB.2.raw
  modified_base (291)..(291): a, c, t, g, unknown or other
  misc_feature (291)..(291): n is a, c, g, or t
  modified_base (327)..(327): a, c, t, g, unknown or other
  misc_feature (327)..(327): n is a, c, g, or t
  modified_base (331)..(331): a, c, t, g, unknown or other
  misc_feature (331)..(331): n is a, c, g, or t
  modified_base (335)..(335): a, c, t, g, unknown or other
  misc_feature (335)..(335): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcatgtctctggtgtacatcagtattattatggagttgctgcggcaggtccgcgggaaggctggagtggatgggcncatcataacgagtggcagacaccaaactccaacccncctnaagngtcgacgtcaccatcgtacactacgacgtacgtaccaaagaccctagttccacccgtagtaaaacttcgtaaccttcgtacgtacgacccgccggaccggaacgtaccgggtaccgttaagttactttaagttggttacgacggtagaacgtacgtttacctaagttaccgaataacgaaggttagggaaggggaccggggggacgtaaacggtcggtaccgtacccgggtaccccggacgggggtaccgaaccggggtaacccgtacggggtcctaccccggtactcccgtaccgaccggaccctacccgaacccgg

SEQ ID NO: 318170 - DNA, 551 bp, Homo sapiens
  misc_feature: GZ8MTXP02GZJHJ.44.35.D02.1.454.CMB.2.raw
  modified_base (300)..(300): a, c, t, g, unknown or other
  misc_feature (300)..(300): n is a, c, g, or t
  modified_base (536)..(536): a, c, t, g, unknown or other
  misc_feature (536)..(536): n is a, c, g, or t
  modified_base (544)..(544): a, c, t, g, unknown or other
  misc_feature (544)..(544): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcagggagtcgggcccaggacgggtgaagccttcggagaccctgtccctcacctgcaatgtctctggtgttacatcagtagttattatggagttggctgcggcagtccgccgggaaggactgggagtggattggggcncatctataacagtggcagcaaccaactaccaaaccccgcctacaagacgtcgacgtcaccatcgtcactagcaggtacccaaagaaccagttctaccctagaaacttgaacttctgtcgaccgccgcgacacggccgtatattatgtgcgagagatccatcgatacagtagaggacgggggcaacgtggctcgaccccgtggggccacgggaacccgtggccgaccggtctacccncacgcccncaacccg

SEQ ID NO: 318171 - DNA, 566 bp, Homo sapiens
  misc_feature: GZ8MTXP02J0NHY.44.35.D02.1.454.CMB.2.raw
  modified_base (246)..(246): a, c, t, g, unknown or other
  misc_feature (246)..(246): n is a, c, g, or t
  modified_base (345)..(345): a, c, t, g, unknown or other
  misc_feature (345)..(345): n is a, c, g, or t
  modified_base (366)..(366): a, c, t, g, unknown or other
  misc_feature (366)..(366): n is a, c, g, or t
tcagacagtatatacacgaccggtgctcgatttagcacacgatagttgggtttggggggtcacaagaggcagcgctctcgggacgtctccaccatggcctgggctctgctgctcctcactctcctgactcaggacacagggacctgggcccagtccgccctgactcagccagcctccgtgtctgggtctcctggacagtcgctcaccctctcctgcactggaactaatactgatgttaggaaaatntaaccttgtctcttggtaccaagtataccccacggtaaaccccccaaactccttcttatgaagtcaataagcggccctcgggctattctcatcgcttcncaggctccaagtctggcaacncggctcgttgattaattctgcctcctgccctcgacgacgacggcgtacgtattattgctgactctatagtgcggttaccgtagtagttagttcggttcggtcggtcgggacgggaccggccgtcgtaccggtccgtacgtcgacgaccgaccgccgtccgtccccgtccgtccgtcctccttccgtccctaccctacctc

SEQ ID NO: 318172 - DNA, 557 bp, Homo sapiens
  misc_feature: GZ8MTXP02F4DU2.44.35.D02.1.454.CMB.2.raw
  modified_base (381)..(381): a, c, t, g, unknown or other
  misc_feature (381)..(381): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtggttacatcagtagttattatggagttggctgcggcagtccgcgggaaggctggagtggattgggcgcatctataacagtggcagcaccaactaccaaccccgcctcaagagtcgagtcaccatgtcactagcaggtccaaagaccagttcnccctagaaattgacttctgtcgaccgccgcggacacggaccgtatattacttgtgcgagagtacttacctactacgtatacaggtagaggacggggggacgaacgtggctccggaacccgtcggggtacccgacgggacccgtggccgaccgtctccgtcgacgcctaccaacccg

SEQ ID NO: 318173 - DNA, 541 bp, Homo sapiens
  misc_feature: GZ8MTXP02GWXKP.44.35.D02.1.454.CMB.2.raw
  modified_base (387)..(387): a, c, t, g, unknown or other
  misc_feature (387)..(387): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtgttacatcagtagttattattggagttggctgcggcagtccgcgggaaggactgggagtggattgggcgcatctaataacagtggcagcaccaactacaaccccgccctacaagagtcgacgtcaccatgtcactagcaggtccaaagaaccagttcnccctagaaattgacttctgtgaccgcgcggacacggccgtatattatgtgcgagagattcctatcgatacagtagaggacgggggacaacgtggcgtcgacccgtcggggccgacgggacccgtggcgaccgtccgtctcgacgcctacaaccg

SEQ ID NO: 318174 - DNA, 537 bp, Homo sapiens
  misc_feature: GZ8MTXP02GQ01F.44.35.D02.1.454.CMB.2.raw
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtgttacatcagtagttattatggagttggctgcggcagtccgccgggaaggactggagtggattgggcgcatctataacagtggcagcaccaactacaaccccgcctcaagagtcgagtcaccatgtcactagcaggtccaaagaacccagttctccctgaaaattgacttctgtgaccgccgcggacacggccgtatacttattgtgcgagagattcctatcgatacagtagagacgggggcgaacgtggctcgacccgtggggccacgggaaccctggtccaccggtctcctcacgccctcaacccg

SEQ ID NO: 318175 - DNA, 594 bp, Homo sapiens
  misc_feature: GZ8MTXP02H4P6A.44.35.D02.1.454.CMB.2.raw
  modified_base (241)..(241): a, c, t, g, unknown or other
  misc_feature (241)..(241): n is a, c, g, or t
  modified_base (397)..(397): a, c, t, g, unknown or other
  misc_feature (397)..(397): n is a, c, g, or t
tcagacagtatatacacgaccggtgctcgatttagcacacgatagttgggtttggggggtcacaagaggcagcgctctcgggacgtctccaccatggcctgggctctgctgctcctcactctcctgactcaggacacagggacctgggcccagtccgcctgactcagccagcctccgtgtctgggtctcctggacagtcgctcaccctctcctgcactggaactatactgatgtagaaatntaccttgtctctgacagtataccagtaaacccccaatcctcttatgaagtcaaataacgcggccctcgggcatttctcatcgtcttctcaggtcctacctaacgtctggcaacacggtcttcgtgattaattctgcctccgtacctgaccgtacgngccgacttatattgactgtactctatagtggcggttcctagtattagttcggggttctttcgggaccgggtaacggggccccggtccgtacggaacccgttcccgacgggttcaaccggcccgtaaacggtccgtccgccccccgtcggtccctaccgttccgtccgttccccacccgttcctacctacttacttcg

SEQ ID NO: 318176 - DNA, 572 bp, Homo sapiens
  misc_feature: GZ8MTXP02HKT5C.44.35.D02.1.454.CMB.2.raw
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtgttacatcagtagttattattggagttggctgcggcagtccgcgggaggctggagtggattgggcgcatctataacagtggcagcaccaactaccaacccccgcctacaagagtcgacgtccaccatcgtcactagcaggtccaaagaccagttccaccctagaaacttgacttctgtcgacccgcgcggacacggccgtatattatgtgcgtagagattcctatcgatacagtaggaggacgggggcaacgtggcgtccggacccgtcggggacccgacggggtaaccccgtcggggtaaccacccggttcctcccgtaccgaccgccctacccgaacccgg

SEQ ID NO: 318177 - DNA, 542 bp, Homo sapiens
  misc_feature: GZ8MTXP02HOL6O.44.35.D02.1.454.CMB.2.raw
  modified_base (87)..(87): a, c, t, g, unknown or other
  misc_feature (87)..(87): n is a, c, g, or t
  modified_base (280)..(280): a, c, t, g, unknown or other
  misc_feature (280)..(280): n is a, c, g, or t
  modified_base (317)..(317): a, c, t, g, unknown or other
  misc_feature (317)..(317): n is a, c, g, or t
  modified_base (329)..(329): a, c, t, g, unknown or other
  misc_feature (329)..(329): n is a, c, g, or t
  modified_base (458)..(458): a, c, t, g, unknown or other
  misc_feature (458)..(458): n is a, c, g, or t
tcagacagtatatacacgaccggtgctcgatttagcacacgatagttgggtttgggggcctgggcctcaggaagcagcatcggaggngcctcagccatggcatggatccctctcttcctcggcgtccttgcttactgcacagggtccggggcctcctctgacctgactcagccatcctcactgtccgtgtccccaggacacacagtcactattacctgctctagggaaacttgagtgataaatttgcttctgtatcagcagaggccaggccagcccctangctggtcatcttcagataatagcgcctgaggatcccngacgcgcttccnctggctccaactcgtagggaccacggccacgtcctagaccatcacgcgccgacccagccctgtggactggacggctagacttattactgtacgagacgtaggggaaatgacgttagtgggtgttcgggnggacggacagcgtcggaccgttcgtcggtcacggtacccgaggtccgtccgcccccgtcggcctccgtcgttccggttcccccg

SEQ ID NO: 318178 - DNA, 520 bp, Homo sapiens
  misc_feature: GZ8MTXP02F43NK.44.35.D02.1.454.CMB.2.raw
  modified_base (409)..(409): a, c, t, g, unknown or other
  misc_feature (409)..(409): n is a, c, g, or t
tcagacagtatatacacgaccggtgctcgatttagcacacgatagttgggtttggggcctgggcctcaggaagcagcatcggaggtgcctcagccatggcatggatccctctcttcctcggcgtccttgcttactgcacagggtccgggcctcctctgacctgactcagccatcctcactgtccgtgtccccaggacacacagtcactattacctgctctggggaaaacttgagtgataattgcttcctggtatcagcagaggccaggccagccccctatgctggtcatctttcaggataataagcggccctcagggatccctgagcgcttcctctggctccaactctgggacacggccactctgaccatcagcgcgacccagcctctggactgaggctgactattacngtcagacgtgggaaatgctaagttgggtagttcgggcggtaggggaccaaggcgtgaaccgttctcggtcacgcccaaggcctcgccccctcggccactctcgttcccccg

SEQ ID NO: 318179 - DNA, 556 bp, Homo sapiens
  misc_feature: GZ8MTXP02FZ864.44.35.D02.1.454.CMB.2.raw
  modified_base (277)..(277): a, c, t, g, unknown or other
  misc_feature (277)..(277): n is a, c, g, or t
tcagacagtatatacacgaccggtgctcgatttagcacacgatagttgggtttgggggcctgggcctcaggaagcagcatcggaggtgcctcagccatggcatggatccctctcttcctcggcgtccttgcttactgcacagggtccggggcctcctctgacctgactcagccatcctcactgtccgtgtccccaggacacacagtcactattacctgctctgggaaaacttgagtgataattgcttctggtatcagcagagcaggccagcccctangctggtcatcttcaggataataagcggccctcgaggactccctgagcgtcttccctctggctccaactcgtagggaccacggccactcctagaccatcagccgccgacccacgccctcgtggatgacggctacgacttattactgtacagtacgtagggaaagtcgtacgtaagttggggtagttcgggacgggagggaccgaaggcgtaggtacccgttcgtcggtcacgcccgtaaggccgtccggcccctcgggtcctacgtccgtcgttaccccc

SEQ ID NO: 318180 - DNA, 552 bp, Homo sapiens
  misc_feature: GZ8MTXP02JVCBI.44.35.D02.1.454.CMB.2.raw
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtggttacatcagtagttattattggagttggctgcggcagtccgccgggaagggactggagtggattgggcgcgatctataacagtggcagcaccaactacaaccccgcctcaagagtcgacgtcaccatgtcactagcaggtccaaagaccagttcctccctagaaacttgacttctgtcgacccgccgcggacacggccgtatattatgtgcgagagattcctatcgatacagtagaggacgggggcgaacgtggctcggaccccgtggggcccacgggaaccctggtccgaccgtctccgtacgacgtcctaccgaacccg

SEQ ID NO: 318181 - DNA, 557 bp, Homo sapiens
  misc_feature: GZ8MTXP02FRBPK.44.35.D02.1.454.CMB.2.raw
  modified_base (335)..(335): a, c, t, g, unknown or other
  misc_feature (335)..(335): n is a, c, g, or t
  modified_base (384)..(384): a, c, t, g, unknown or other
  misc_feature (384)..(384): n is a, c, g, or t
tcagacagtatatacacgaccggtgctcgatttagcacacgatagttgggtttgggggggtcacaagaggcagcgctctcgggacgtctccaccatggcctgggctctgctgctcctcactctcctgactcaggacacagggacctgggcccagtccgccctgactcagccagcctccgtgtctgggtctcctggacagtcgctcaccctctcctgcactggaactaatactgatgttaggaaaatataaccttgtctcttggtaccaagtatacccaggtaaaccccccaaactccttacttatgaagtcaaataagcggccctcggcatttcncatcgctttctcaggctcaagtctggcaacacggcctgttgataattcngcctctgcctgacgacgagccgactattatgctgctcatagtgcgggtcctagtactagtttgggtcttcgggacggtagggacccgtctcggacccgtcgtaaggtccaagccccgaaaggcctcgcccccctggtccaaccttctcggttcccccaccctcctctacttac

SEQ ID NO: 318182 - DNA, 655 bp, Homo sapiens
  misc_feature: GZ8MTXP02JAU0E.44.35.D02.1.454.CMB.2.raw
  modified_base (217)..(217): a, c, t, g, unknown or other
  misc_feature (217)..(217): n is a, c, g, or t
tcagacagtatatacacgaccggtgctcgatttagcacacgatagttgggtttgggggcctgggcctcaggaagcagcatcggaggtgcctcagccatggcatggatccctctcttcctcggcgtccttgcttactgcacagggtccggggcctcctctgacctgactcagccatcctcactgtccgtgtccccaggacacacagtcactattaccngctctaggggaaacttgagtgataaattgcttctggtatcagcagaggccaggccacgccccctatcgctggtcatctttcaggataatagcgcctgagggactccgtgacgcgtcttcctacgtcggcctaccaacgtcgtagggaccacggccaactcgtacgaccatccacgccgacccgacccacgccctacgtcggactaggaccggtctacgactttaacttaccgtacgtttacgaacggtaccgggttaggggaaaacgtggtaacgttaaggtttgggggtacggtttccggggacggggacgggaacccgtaaggtccgtacggtaacccggttcggtaaccgggttccgaaccggtcccccgaaaggtccccgtccggtcccccgttacgggtacccgtaccttcccggttacccgtttaccccccg

SEQ ID NO: 318183 - DNA, 550 bp, Homo sapiens
  misc_feature: GZ8MTXP02F1BGF.44.35.D02.1.454.CMB.2.raw
  modified_base (385)..(385): a, c, t, g, unknown or other
  misc_feature (385)..(385): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtgttacatcagtagttattatggagttggctgcggcagtccgcgggaaggctggagtggattgggcgcatctataacagtggcagcaaccaactaccaaccccgcctacaagagtcgagtcaccatgtcactagacaggtaccaaagaccagttccnccctagaaattgtacttctgtcgaccgcgcgacacggccgtatattatgtgcgagagtagttcctatcgatacgagtaggaggacgggggcgaacgtggctaccgacccgtcggggaccgacggggaccctggtccgaccgtctaccctcgacgcctcgaacccg

SEQ ID NO: 318184 - DNA, 602 bp, Homo sapiens
  misc_feature: GZ8MTXP02H9GE6.44.35.D02.1.454.CMB.2.raw
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtgttacatcagtagttattattggagttggctgcggcagtccgcgggaaggactggagtggattgggcgcatctataacagtggcagcaaccaataccaaccccgcctacaagacgtcgacgtcaaccatgtacactagacaggtaccaaagaacccagttccaccctagaaattcgaacttcgtgtcgacccgccgacggacacggccgtatacttattgtgcgagagtattcctatcgatacgagtagagggacgggggacgtaacgtcggccgtccggaaccccggtcgggggacccgaacggggtaaaccccgtcgggtaacccgtacccggtccgtcccgtaccgaccggtccctacccgaaaccccgg

SEQ ID NO: 318185 - DNA, 600 bp, Homo sapiens
  misc_feature: GZ8MTXP02ILKNG.44.35.D02.1.454.CMB.2.raw
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtgttacatcagttagttattattggagttggctgcggcaggtccggccgggaagggctgggagtggagttggggcgcatctataacagtggcagccaaccaaactaccaaccccgcctacaagacgtcgacgtcaccatcgtacactaagcacggtaccaaagaacccagttcctaccctagaaacttgacttcgtcgtcgacccgccgacggacacggccgtatacttattgtgacgagagtacttactatcgatacagtaggaggacgggggacgaacgtcggcctaccggaccccggtcggggacccgacggggtaacccgtcgggtccgaacccgtccgtcccgtacgaccgccctacccgaacccgg

SEQ ID NO: 318186 - DNA, 685 bp, Homo sapiens
  misc_feature: GZ8MTXP02IGUKF.44.35.D02.1.454.CMB.2.raw
  modified_base (262)..(262): a, c, t, g, unknown or other
  misc_feature (262)..(262): n is a, c, g, or t
  modified_base (278)..(278): a, c, t, g, unknown or other
  misc_feature (278)..(278): n is a, c, g, or t
tcagacagtatatacacgaccggtgctcgatttagcacacgatagttgggtttgggggcctgggcctcaggaagcagcatcggaggtgcctcagccatggcatggatccctctcttcctcggcgtccttgcttactgcacagggtccggggcctcctctgacctgactcagccatcctcactgtccgtgtccccaggacacacagtcactattacctgctctagggaaaacttgagtgataatttgcttctgtatcagcagngcaggccagcccctancgctggtcatctttcgaggtataataacgcggccctagaggtactcccgtagacgcgtcttccgtccgttcggcctacccaaacttccggtacgggaacccgaccgggtaccctaaccgttccctacgaacccattacccgaacgcccgacccgaccccacggccccttcgtacggtacgtcggaacgggtccgtacggtaaccttaacgtttaccgtacggttaccgaaaggtacccgggtttaaggggaaaacgttcggtaacgttaaagggtttcgggggtcggtttaccgggacggggtacgggaacctaacggtccgttacggtaccgttcgtaccggttacgacgtacccgaaggtcccgtccggacccccgtcggtacctccgttctacccggttccccc

SEQ ID NO: 318187 - DNA, 540 bp, Homo sapiens
  misc_feature: GZ8MTXP02HVJQ9.44.35.D02.1.454.CMB.2.raw
  modified_base (339)..(339): a, c, t, g, unknown or other
  misc_feature (339)..(339): n is a, c, g, or t
  modified_base (523)..(523): a, c, t, g, unknown or other
  misc_feature (523)..(523): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtgttacatcagtagttattattggagttggctgcggcagtccgcgggaaggctggagtggattgggcgcatctataacagtggcagcaccaactacaaccccgcctcaagngtcgagtcaccatgtcactagcaggtccaaagacccagttctccctagaaattgacttctgtgaccgccgcgacacggcctatacttattgtgcgtagagtattcctatcgatacagtagaggacgggggcaacgtggctccgacccgtcggggaccgacgggaaccctggccaccgtctaccncgacgcctaccgaaccg

SEQ ID NO: 318188 - DNA, 558 bp, Homo sapiens
  misc_feature: GZ8MTXP02FT4BJ.44.35.D02.1.454.CMB.2.raw
  modified_base (265)..(265): a, c, t, g, unknown or other
  misc_feature (265)..(265): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtggttacatcagtagttattatggagttggctgcggnagtccgcgggaaggactggagtggattgggcgcatctataacagtggcagcaccaaactacaaccccgccctacaagagtcgagtcaccatgtacactagcaggtccaaagaaccagttctaccctagaaattgaacttctgtagacccgccgcggacacggccgtatattattgtgcgagagattcctatcgatacagtagaggacgggggacaaacgtggactcggaacccgtggggaccgacgggaccctaggtccgaccggtcctcctcgacgcccgtaccaaacccgg

SEQ ID NO: 318189 - DNA, 742 bp, Homo sapiens
  misc_feature: GZ8MTXP02IU7EJ.44.35.D02.1.454.CMB.2.raw
  modified_base (338)..(338): a, c, t, g, unknown or other
  misc_feature (338)..(338): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtggttacatcagtagttattattggagttggctgcggcagtccgcgggaaggactggagtggattgggcgcatcataacagtggcagcaccaactacaaccccgccctanaagagtcgacgtcaccatgtccaactacgactaggggtacccaaaggaacccctagttcctacccgtagtaaaactttgtaacctttctacggttcgaacccgccggacccgggaaccgaccggggtacccgttaacgttaactttaaagtttggtacggtaccggtaaggtaggtaacgtttacccctaagttaccggtaacttaaccgtaaaggttaaggtaaacgggggaaccgggggggggacggtaaaaccgggtacggggtcccggttacccgggtaaacccccgggttcggggggaccccgaaaaccgggggtaacccccggttacggggtccccgtaaaccccgggttcctttaccccgtccggaaccggtccccgttacccccgaaacccccggg

SEQ ID NO: 318190 - DNA, 544 bp, Homo sapiens
  misc_feature: GZ8MTXP02GNUH5.44.35.D02.1.454.CMB.2.raw
  modified_base (437)..(437): a, c, t, g, unknown or other
  misc_feature (437)..(437): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttaggagaccctgtccctcacctgcaatgtctctggtggttacatcagtagttattattggagttggctgcggcagtccgccgggaagggctggagtggattgggcgcatctataacagtggcagcaccaactaccaaccccgcctacaagagtcgacgtcaccatgtcactagcaggtccaaagaccagttctccctagaaattgacttctgtcgaccgcgcggacacggccgtatattattgngcgagagattcctatcgatacagtagaggacgggggacgaacgtggctccgacccgtcggggaccgacgggaccctggccgaccgtctcctcacgcctccgaacccg

SEQ ID NO: 318191 - DNA, 563 bp, Homo sapiens
  misc_feature: GZ8MTXP02G4W7P.44.35.D02.1.454.CMB.2.raw
  modified_base (294)..(294): a, c, t, g, unknown or other
  misc_feature (294)..(294): n is a, c, g, or t
  modified_base (305)..(305): a, c, t, g, unknown or other
  misc_feature (305)..(305): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtgttacatcagtagttattattggagttggctgcggcagtccgcgggaggctggagtggatgggcncatctataacngtggcagcaccaaactaccaaccccgcctacaagagtcgagtcaccatgtcactagcaggtccaaagaacccagttcctaccctagtaaacttcgtaacttctgtcgacccgccgacggacacggccgtatacgttatgtgcgagagtattcctatcgatacagtagaggtacgggggacaacgtggctccggacccgtgggggacccacggggaaccctggtaaccgaccgtccgtcctcgacgtcctacgaacccg

SEQ ID NO: 318192 - DNA, 532 bp, Homo sapiens
  misc_feature: GZ8MTXP02JT7Y1.44.35.D02.1.454.CMB.2.raw
  modified_base (340)..(340): a, c, t, g, unknown or other
  misc_feature (340)..(340): n is a, c, g, or t
  modified_base (379)..(379): a, c, t, g, unknown or other
  misc_feature (379)..(379): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtgttacatcagtagttattattggagttggctgcggcagtccgccgggaaggactggagtggattgggcgcatctataacagtggcagcaccaactacaacccgcctcaagngtcgagtcaccatgcactagcaggtcaaagaccagttcnccctgaaattgacttctgtgaccgccgcgacacggccgtatattatgtgcgagagattcattcgatacagtagagtacgggggcaacgtgggctcgacccgtcggggccacgggaaccctggtccgaccgtctactccgacgccctcaaccgg

SEQ ID NO: 318193 - DNA, 770 bp, Homo sapiens
  misc_feature: GZ8MTXP02I3KXO.44.35.D02.1.454.CMB.2.raw
  modified_base (284)..(284): a, c, t, g, unknown or other
  misc_feature (284)..(284): n is a, c, g, or t
tcagacagtatatacacgaccggtgctcgatttagcacacgatagttgggtttgggggcctgggcctcaggaagcagcatcggaggtgcctcagccatggcatggatccctctcttcctcggcgtccttgcttactgcacagggtccggggcctcctctgacctgactcagccatcctcactgtccgtcgtccccaggacacacagtcactattacctgctcgtaggggaaaacttgagtgataaattgcttctggtatcagcagagccaggccagccccctangctggtcatctttcaggataataagcggccctacgaggactccctgacgcgtcttcctcgtcggcctaccaactccgtacggggaaccgtaccgggaccctaaccgttccgtacgaacccctaacgttccgaaaccgggcccggaccccggaacccccgaacgggccccttacccggttagggaccgttacgggaccggggtaccttacggtaaaccttaaacgtttaaccgttacggttaaccgtaacgggtaaccgggttaagggggtaaaaacgttcggtaaaccgtttaaaaggttcggggggtttacggtttccgggggtaaccggggtacggggaacccgtaaaacggtccggttacggggtaaccccggtttacggttaccgggttaccgaaccggtaccccgtaaacggggcccgttaccccggtccccccgttacggggtaccctacccggtttcccgtcccggtttaacccccccg

SEQ ID NO: 318194 - DNA, 522 bp, Homo sapiens
  misc_feature: GZ8MTXP02G8A8C.44.35.D02.1.454.CMB.2.raw
  modified_base (210)..(210): a, c, t, g, unknown or other
  misc_feature (210)..(210): n is a, c, g, or t
  modified_base (246)..(246): a, c, t, g, unknown or other
  misc_feature (246)..(246): n is a, c, g, or t
  modified_base (330)..(330): a, c, t, g, unknown or other
  misc_feature (330)..(330): n is a, c, g, or t
  modified_base (378)..(378): a, c, t, g, unknown or other
  misc_feature (378)..(378): n is a, c, g, or t
tcagacagtatatacacgaccggtgctcgatttagcacacgatagttgggtttggggggtcacaagaggcagcgctctcgggacgtctccaccatggcctgggctctgctgctcctcactctcctgactcaggacacagggacctgggcccagtccgccctgactcagccagcctccgtgtctgggtctcctggacagtcgctcaccctntcctgcactggaactaatactgatgttaggaaaatntaaccttgtctcttggtaccaagtatacccaggtaaaccccccaaactccttcttatgaagtcaataagcgcctcggcatttcncatcgcttctcaggctccaagtctgcaacacggcctcgtgataattcngcctctgccctgacgacgagccgactattatgctgctcatatgcggtcctagatagttgggtcttcggcggtagggaccgctgaccgtctaggtcagccaaggctcgcccctggccaacgtcgtcgttcccgcctactctatac

SEQ ID NO: 318195 - DNA, 793 bp, Homo sapiens
  misc_feature: GZ8MTXP02F3S3C.44.35.D02.1.454.CMB.2.raw
  modified_base (297)..(297): a, c, t, g, unknown or other
  misc_feature (297)..(297): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtgttacatcagtagttattattggagttggctgcggcagtccgcgggaaggctggagtggattggggcncatctataacgagtggcagcaccaactaccaaccccgcctacaagagtcgagtccaccatcgtacactagacacggtacccaaaggaaccctagtttacctaccccgtagtaaaactttcgtaacctttcgtacggttacggaccccggtacccggacccggggtaacccgaacccgggggtaccccgttaaagttaacgttttaaacgtttgggttacggacccgggtaaggtaacgggttaacttttaccccgttaaacgttacccggtaaagttaacccggtaaacgggtttaagggaaacgggggtaaacccgggggggggggaaccgtaaaaccggggttcggggacccggtttacccggggaaccccccgggttacggggggacccccggaaaccggggggtaacccccgttacgggggtaacccggtaaccccgggttaccttacccccgttccggaacccggtccccgttaccccgaaacccccgggg

SEQ ID NO: 318196 - DNA, 573 bp, Homo sapiens
  misc_feature: GZ8MTXP02JDUGZ.44.35.D02.1.454.CMB.2.raw
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtgttacatcagtagttattattggagttggctgcggcagtccgcgggaaggctggagtggattgggcgcatctataacagtgcagcaccaactaccaaccccgcctacaagacgtcgacgtcaccatcgtcaactagcaggtccaaagaaccagttcaccctagaaacttcgaacttctgtcgtacccgcgcggacacggccgttatacttattgtgcgagagtattacctatcgaatacgagtagagggacgggggcgaaacgtggacgtccggacccgtcggggaccgaacgggacccgtcggtccgacccgtcctccgtacacggtccctacccgaacccgg

SEQ ID NO: 318197 - DNA, 752 bp, Homo sapiens
  misc_feature: GZ8MTXP02GFQCH.44.35.D02.1.454.CMB.2.raw
  modified_base (303)..(303): a, c, t, g, unknown or other
  misc_feature (303)..(303): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtggttacatcagttagttattattggagttggctgcggcaggtccgcggggaaggactgggagtggattggggcncagtctataacagtggcagcaccaactaccaaccccgcctacaagacgtcgacgtcaccatcgcactagacaggtaccaaagaaccctagtttccacccgttagtaaaactttcgtaacctttcgtaggttacgaccccggtacccgacccgggtaacctaacccggggtacccgttaattacgtttaaagtttggtacggtacggtaaggtaacggttaactttacccgttaacgttaccgtaacgtttaaccgaaagggttaagggaaacgggggtaccggggggggtaaccgtaaacggttcggggtacccgttacccggggtaaacccccgggttcgggggaaccccggtaaccgggggtaaacccccgttcggggtaaccccgtaaccccggttcccgttaccccgtacccgtaccggtaccccgttaccccgaaacccccggg

SEQ ID NO: 318198 - DNA, 545 bp, Homo sapiens
  misc_feature: GZ8MTXP02GBTEC.44.35.D02.1.454.CMB.2.raw
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtggttacatcagtagttattattggagttggctgcggcagtccgccgggaaggactggagtggattgggcgcatctataacagtggcagcaccaactaccaaccccgccctcaagagtcgagtcaccatgtcactagacaggtaccaaagaaccagttctaccctgaaattgacttctgtgacccgccgcggacacggtccgtatacttattgtgcgagagattccatcgatacagtagaggacgggggcaacgtggctcgacccgtggggaccacgggaaccctggccgaccgtctccctcgacgcctccaacccg

SEQ ID NO: 318199 - DNA, 548 bp, Homo sapiens
  misc_feature: GZ8MTXP02HWN3G.44.35.D02.1.454.CMB.2.raw
  modified_base (310)..(310): a, c, t, g, unknown or other
  misc_feature (310)..(310): n is a, c, g, or t
  modified_base (337)..(337): a, c, t, g, unknown or other
  misc_feature (337)..(337): n is a, c, g, or t
  modified_base (341)..(341): a, c, t, g, unknown or other
  misc_feature (341)..(341): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtgttacatcagttagttattattggagttggctgcggcagtccggcgggaaggactggagtggattgggcgcatctataacngtggcagcaccactacaaccccgcctnaagngtcgacgtcaccatcgtacactagacaggtccaaagacccagttccacctagaaacttgacttctgtcgacccgcgcggacacggccgtatacttattgtagacgagagtattcctatcgatacagtagaggtacgggggcaacgtggctcggacccgtcgggaccgacgggacctggaaccgacgtctccgtcacgcctacacccg

SEQ ID NO: 318200 - DNA, 532 bp, Homo sapiens
  misc_feature: GZ8MTXP02HXGKA.44.35.D02.1.454.CMB.2.raw
  modified_base (321)..(321): a, c, t, g, unknown or other
  misc_feature (321)..(321): n is a, c, g, or t
tcagacagtatatacacgaccggtgctcgatttagcacacgatagttgggtttggggcctgggcctcaggaagcagcatcggaggtgcctcagccatggcatggatccctctcttcctcggcgtccttgcttactgcacagggtccgggcctcctctgacctgactcagccatcctcactgtccgtgtccccaggacacacagtcactattacctgctctgggaaaacttgagtgataattgcttctgtatcagcagaggtcaggccagccccctatcgctggtcatctttcaggataataagcggccctcagggatcccngacgcgcttctctgctccaactctgggacacggccactctgaccatcagcgccgacccagccctcgtggatgaggctagacttattctgtactagacgtagggaaagtgacgtaagttgggtgttcggacgggtaggaccgaaggctagaccgttcgtcggtcacgcccaaggccgtcgaccccgtcggaccaccgttcgtcgttcccccg

SEQ ID NO: 318201 - DNA, 710 bp, Homo sapiens
  misc_feature: GZ8MTXP02IRQD7.44.35.D02.1.454.CMB.2.raw
tcagacagtatatacacgaccggtgctcgatttagcacacgatagttgggtttgggggcctgggcctcaggaagcagcatcggaggtgcctcagccatggcatggatccctctcttcctcggcgtccttgcttactgcacagggtccggggcctcctctgacctgactcagccatcctcactgtccgtcgtcccaggacacacagtcactattacctgctcgtaggggaaaacttgagtgtaattaaatttgcttcctggtatcagcagaggccaggccacgcccctatcgctggtcattctttacgaggtataagtaacgccgccctcgagggtactcccgtgacgcgtccttcctcgtcggcctacctaacgtcgtacgggaccgaccggtaccaccgtctacgaccatccgacgccgccgacccacgtcccgttgcggtacgtcggtacggccttacgtaactttaacttccgtacggtacgtaacgggtacgggtaaggggaaacgttcggtacgttaaaggtttcgggggttacggttaccgggggacggggtaaacggaacccggtaaacgggtccgttaccggggtacccgtttccggtaccgggtaccgaacccggtacccgtaaaccggggtcccgttcccccggtaccccccggtttccgggtccctacccgtttcccggtttcccccgtttccccccgg

SEQ ID NO: 318202 - DNA, 664 bp, Homo sapiens
  misc_feature: GZ8MTXP02G4NRR.44.35.D02.1.454.CMB.2.raw
  modified_base (279)..(279): a, c, t, g, unknown or other
  misc_feature (279)..(279): n is a, c, g, or t
  modified_base (318)..(318): a, c, t, g, unknown or other
  misc_feature (318)..(318): n is a, c, g, or t
  modified_base (354)..(354): a, c, t, g, unknown or other
  misc_feature (354)..(354): n is a, c, g, or t
  modified_base (372)..(372): a, c, t, g, unknown or other
  misc_feature (372)..(372): n is a, c, g, or t
tcagacagtatatacacgaccggtgctcgatttagcacacgatagttgggtttgggggcctgggcctcaggaagcagcatcggaggtgcctcagccatggcatggatccctctcttcctcggcgtccttgcttactgcacagggtccggggcctcctctgacctgactcagccatcctcactgtccgtgtccccaggacacacagtcactattacctgctcgtaggggaaaacttgagtgataattgcttctgtatcagcagagcaggccagcccctangctggcatcttcagataatagcgcctcgaggactcccgngacgcgtcttctcgtgctaccaactcgtagggaccncggccactctagacctanccacgccgccgacccacgccctacgtggactcggaacggtccgtacgacctttaacgttaccgtagttacccgaaggtaccgggttaaggggtaaaacgtcgtaaccgttaaagggtttggggtcgggtttaccggggacggggacggggaaccccgtaagggtaccgttacgggtaacccgttcggttaccgggttaccgtaaccggcccggtaaaaccggtccgttaccccggtaccccccggttacgggtcccctaacccgtttcccggttaacccggtttcccccccg

SEQ ID NO: 318203 - DNA, 641 bp, Homo sapiens
  misc_feature: GZ8MTXP02IAKH6.44.35.D02.1.454.CMB.2.raw
tcagacagtatatacacgaccggtgctcgatttagcacacgatagttgggtttgggggcctgggcctcaggaagcagcatcggaggtgcctcagccatggcatggatccctctcttcctcggcgtccttgcttactgcacagggtccggggcctcctctgacctgactcagccatccctcactgtccgtgtccccaggacacacagtcactattacctgctctaggggaaacttgagtgataatttgcttctgtatcagcagaggccaggccacgccccctatgctggtcattctttcaggtataataagccggcctcgagggtatccccgtgacgccgtcttcctcgtcggcctaccaactcgtacgggaccaccgggcccaactctcgaccatccacgccgcccgacccacgccctcgtaggactggacggcttagacttaattacgtgtaccgaggtacggtagggaaagtgtaacgttaaggtttggggtggtttaccggggacgggtaacggggaaccctaaaggtccgttacggtacccgtttcggtaccgggttacgaccggtaccccgaaagggtccccgtccggtaccccccgttcgggtaccctaccgtttccgttcccggtttccccccg

SEQ ID NO: 318204 - DNA, 535 bp, Homo sapiens
  misc_feature: GZ8MTXP02FIAQL.44.35.D02.1.454.CMB.2.raw
  modified_base (389)..(389): a, c, t, g, unknown or other
  misc_feature (389)..(389): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtgttacatcagtagttattattggagttggctgcggcagtccgccgggaagggactgggagtggattggggcgcatctataacagtggcagcaccaactacaaccccgccctcaagagtcgacgtcaccatgtcactagcagggtccaaagaaccagttcnccctgaaattgacttctgtgaccgccgcggacacggccgtatattatgtgcgagagattctatcgatacagtagagacggggggcaacgtggctcgacccgtggggccacgggaaccctggtcaccgtctcctcacgcctcaaccg

SEQ ID NO: 318205 - DNA, 553 bp, Homo sapiens
  misc_feature: GZ8MTXP02IGT9V.44.35.D02.1.454.CMB.2.raw
  modified_base (190)..(190): a, c, t, g, unknown or other
  misc_feature (190)..(190): n is a, c, g, or t
  modified_base (237)..(237): a, c, t, g, unknown or other
  misc_feature (237)..(237): n is a, c, g, or t
  modified_base (430)..(430): a, c, t, g, unknown or other
  misc_feature (430)..(430): n is a, c, g, or t
  modified_base (460)..(460): a, c, t, g, unknown or other
  misc_feature (460)..(460): n is a, c, g, or t
tcagacagtatatacacgaccggtgctcgatttagcacacgatagttgggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactggagccagcggtaaatnttcttagtcttaactttgtctcctggtatcaacatcatccagtaaacgcccccaaatcatcatcatgagcctaataagagccctgagggtttcaatcgcttccactgcctcaagtccggactaccacggccctccctagacctaatctcgagggtctaccgaggctgaggacgaggctagattattattgttncttcagtattgtcgtcgctatctactttangttacttacggaacggttgggaaaccaaggttccgaccgttaccgtaggtccaacgcccgaaaggaccccaacccatcgtaccaactttcccg

SEQ ID NO: 318206 - DNA, 558 bp, Homo sapiens
  misc_feature: GZ8MTXP02G189F.44.35.D02.1.454.CMB.2.raw
  modified_base (361)..(361): a, c, t, g, unknown or other
  misc_feature (361)..(361): n is a, c, g, or t
  modified_base (543)..(543): a, c, t, g, unknown or other
  misc_feature (543)..(543): n is a, c, g, or t
tcagacagtatatacacgaccggtgctcgatttagcacacgatagttgggtttgggggcctgggcctcaggaagcagcatcggaggtgcctcagccatggcatggatccctctcttcctcggcgtccttgcttactgcacagggtccgggcctcctctgacctgactcagccatcctcactgtccgtgtccccaggacacacagtcactattacctgctctgggaaacttgagtgataattgcttctgtatcagcagaggcaggccagccccctatcgctggtcatctttcaggataataagcggccctacacgggacttcccgagagccgtcttcctctggctccaactcgtacgggacncggccactcctgaccatcacgcgaccgacccacgccctcgtagggactaggacggtctacgacttacttactgtacgagtacggtaggaaagtcgacttaaggttgggtcgtcgggacggacggggaccaagcgtgaccggttctcggtcgaacgcccaaggccgtcgccccgttacggccncttccgtcgtccccc

SEQ ID NO: 318207 - DNA, 575 bp, Homo sapiens
  misc_feature: GZ8MTXP02FV2MY.44.35.D02.1.454.CMB.2.raw
  modified_base (265)..(265): a, c, t, g, unknown or other
  misc_feature (265)..(265): n is a, c, g, or t
  modified_base (304)..(304): a, c, t, g, unknown or other
  misc_feature (304)..(304): n is a, c, g, or t
  modified_base (308)..(308): a, c, t, g, unknown or other
  misc_feature (308)..(308): n is a, c, g, or t
  modified_base (336)..(336): a, c, t, g, unknown or other
  misc_feature (336)..(336): n is a, c, g, or t
  modified_base (376)..(376): a, c, t, g, unknown or other
  misc_feature (376)..(376): n is a, c, g, or t
  modified_base (381)..(381): a, c, t, g, unknown or other
  misc_feature (381)..(381): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtgttacatcagtagttattattggagttggctgcggnaggtccgcggaaggctgggagtggattgggcgcatctanaacngtggcagcaccaactacaccccgcctanaagacgtcgagtcaccatgtcactagcagccaaagaaccngttcncctagaaattgacttctgtcgaccgccgcggacacggcctagtacttagttgtgcgagagtacttctagtcgatacgagtaggagggacgggggacaacgtcggacgtccggaacccggtcggggaccgaacggggacccgtacgggtaaccgtacccggtccgtaccgtccgaacgtcccgtaccaaacccgg

SEQ ID NO: 318208 - DNA, 575 bp, Homo sapiens
  misc_feature: GZ8MTXP02HCE8H.44.35.D02.1.454.CMB.2.raw
  modified_base (344)..(344): a, c, t, g, unknown or other
  misc_feature (344)..(344): n is a, c, g, or t
tcagacagtatatacacgaccggtgctcgatttagcacacgatagttgggtttggggggggtcacaagaggcagcgctctcgggacgtctccaccatggcctgggctctgctgctcctcactctcctgactcaggacacagggacctgggcccagtccgccctgactcagccagcctccgtgtctgggtctcctggacagtcgctcaccctctcctgcactggaactaatactgatgttaggaaaatataaccttgtctcttggtacaagtatacccacggtaaacccccaactccttcttatgaagtcaatagcggccctcggctatttctcatcgcttctcngctcacgtctgcacacgcctcgttgattaattcgtgtcctctcgcctgacgacgacgccgtactattatgctcgctcagtacgtggtcggtctagattagttcgggttcgttcgggcgggtacggggacccggtccgtacgaccgttcccgtaacggtccgacgacccgacggcctccgccccctcggtcctaaccgtccgtccgttcccctaccctcctacctacttacg

SEQ ID NO: 318209 - DNA, 740 bp, Homo sapiens
  misc_feature: GZ8MTXP02G9KTQ.44.35.D02.1.454.CMB.2.raw
  modified_base (298)..(298): a, c, t, g, unknown or other
  misc_feature (298)..(298): n is a, c, g, or t
  modified_base (308)..(308): a, c, t, g, unknown or other
  misc_feature (308)..(308): n is a, c, g, or t
  modified_base (336)..(336): a, c, t, g, unknown or other
  misc_feature (336)..(336): n is a, c, g, or t
  modified_base (340)..(340): a, c, t, g, unknown or other
  misc_feature (340)..(340): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggccacctcccagatgggtcgtgtccgaggtgcagctgcaggagtcgggcccaggacgggtgaagccttcggagaccctgtccctcacctgcaatgtctctggtgttacatcagttattattattggagttggctggcgcaggtccgcgggaaggctgggagtggatgggcncatctatacngtgcagcaacaactaccaccccgcctanaagngtcgacgtccaccatcgacactagacctaggtacccaaagaaccctagtttaccctacccgttaagtaaacttacgtaacctttacgtacggttacggaaccccggtccggaccgggaaccgtaacgggttaccgttaattaagtttacgtttggtacggacggtaagtaaggttaacttacccgttaagtaccgtaacgtaacgtaacggttaagggtaaacgggggaaaccgggggggaacgtaaaaccggttcggggtacccggttaccccgggtaaacccccgggttacgggggaccccggtaaaccgggggtaaaccccggtaaccgggtaacccggtaaccccggtcccgttaccccgtaccgacccggtaccccgtaacccgaaacccccggg

SEQ ID NO: 318210 - DNA, 697 bp, Homo sapiens
  misc_feature: GZ8MTXP02JEWCC.44.35.D02.1.454.CMB.2.raw
  modified_base (423)..(423): a, c, t, g, unknown or other
  misc_feature (423)..(423): n is a, c, g, or t
tcagacagtatatacacgaccggtgctcgatttagcacacgatagttgggtttgggggcctgggcctcaggaagcagcatcggaggtgcctcagccatggcatggatccctctcttcctcggcgtccttgcttactgcacgagggtccgggcctcctctgacctgactcagccatcctcactgtccgtcgtccccaggaccacacagtccactattacctgcctcgtaggggaaaacttgagtagtaattaatttgacttctggtatcagcagacggcacggccacgcccctagcgctcggtctacttcgtttacgaaggtaattaaacgtaacggcccggaccctacgggacggggtacctcccggtagtaccgccggtccttacccgtcgtcggtcctaacccgtacgtcgaacgggaccnccggtctaacctcgacgaccatcgacgcccgacccgaccacgtccgtacgcgaacgtcggacggtactacgtaactttaagttacccgtaggtaccgaagggttacggtaagggggtaaacgttggtaacggttaagggtttgggggtacggttacggggacggggaacggaccgtaaggtccgtaacggtaccggtttcgaccggtccgaccgaccggaaccgttccgccccgtccccggtcggtacctcccgtttccggtcctttccccccg

SEQ ID NO: 318211 - DNA, 817 bp, Homo sapiens
  misc_feature: GZ8MTXP02JAGLJ.44.35.D02.1.454.CMB.2.raw
  modified_base (298)..(298): a, c, t, g, unknown or other
  misc_feature (298)..(298): n is a, c, g, or t
  modified_base (338)..(338): a, c, t, g, unknown or other
  misc_feature (338)..(338): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtgttacatcagttagttattattggagttggctgcggcagtccgcgggaaggactggagtggattgggcncagtcatacagtggcagcaccaactaccaaccccgcctanaagagtcgacgtcaccatcgtacactagccgaggtacccaaaggtaaccctagttacctacccctaaggtaaaactttcgtaacctttcgttacggttaccggtaacccggtcccggtaccggggaaccgtaacccgggggtaccccggtttaaacttaaagttttaacgttgggtttacgggacccggtaaaggtaacggtaaacgttttccccttaaacgttaccgggtaaactttaaacccgggaaacggtttaaacgggggtaaacgggggtaaacccggggggggggtaacccgtaaaaccggggtttaacgggggcccggtttaacccccggggaaaccccccgggttcgggggggtaccccggaaaaccggggggtaacccccgtttacgggggaaccccgtaaaccccggggttcccttacccccggttaccggaacccggtcccccgttaaccccgtaaaacccccgggg

SEQ ID NO: 318212 - DNA, 693 bp, Homo sapiens
  misc_feature: GZ8MTXP02ICJAR.44.35.D02.1.454.CMB.2.raw
  modified_base (266)..(266): a, c, t, g, unknown or other
  misc_feature (266)..(266): n is a, c, g, or t
  modified_base (342)..(342): a, c, t, g, unknown or other
  misc_feature (342)..(342): n is a, c, g, or t
tcagacagtatatacacgaccggtgctcgatttagcacacgatagttgggtttgggggcctgggcctcaggaagcagcatcggaggtgcctcagccatggcatggatccctctcttcctcggcgtccttgcttactgcacgagggtccgggcctcctctgacctgactcagccatcctcactgtccgtcgtccccaggacacacagtcacttatacctgctcgtagggaaaacttgagtgtaataaatttgcttcgtggtatcagnagcggcaggccacgcccctatcgctggtcattctttcaggtaataagtaacgccggaccctgacgggtactcccgngacgccgcttccctcgtcggcctccgaacttcggtacgggaccacggcctactccgtacgaccatccgaacgcccgacccacccgacgtccctcgttacgggagttcggaacgggtccttacgtaacttaacgtttacgtcgtacgtaaacggtacgggtttaaggggaaagttggttaacgttaagggtttcgggggttacgggttaccggggacggggtaacggggaaaccgtacggtccggttaccggtaaccgtttccggccggttaccgaccggtacccgtaacgggtcccgttcccggacccccgttcggggtaccctacccggtcctttacccgggtccccccg

SEQ ID NO: 318213 - DNA, 541 bp, Homo sapiens
  misc_feature: GZ8MTXP02HXEVN.44.35.D02.1.454.CMB.2.raw
  modified_base (313)..(313): a, c, t, g, unknown or other
  misc_feature (313)..(313): n is a, c, g, or t
  modified_base (384)..(384): a, c, t, g, unknown or other
  misc_feature (384)..(384): n is a, c, g, or t
  modified_base (441)..(441): a, c, t, g, unknown or other
  misc_feature (441)..(441): n is a, c, g, or t
tcagacagtatatacacgaccggtgctcgatttagcacacgatagttgggtttgggggcctgggcctcaggaagcagcatcggaggtgcctcagccatggcatggatccctctcttcctcggcgtccttgcttactgcacagggtccggggcctcctctgacctgactcagccatcctcactgtccgtgtccccaggacacacagtcactattacctgctctggggaaaacttgagtgataattgcttctggtatcagcagaggccaggccagcccctatcgctggtcatctttcaggataataagcggcctnaggatcctgagcgcttctctgctcactctgggacacggccactctgaccatcagcgaccgacccagccctntcggatggaggctagactattactgtcagacggtagggaaagtgactaagtttgggngtttacggggcggagggtaccaaggctggtacccgttcgtcggttaccacgtccccgaaggtccgtcgcccccgtcggtccaccttccgtcgttcccccg

SEQ ID NO: 318214 - DNA, 589 bp, Homo sapiens
  misc_feature: GZ8MTXP02HSOES.44.35.D02.1.454.CMB.2.raw
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtggttacatcagtagttattattggagttggctgcggcagtccgcgggaaggactggagtggagttgggcgcatctaataacagtggcagcaaccaactaccaaccccgcctacaaagcgtcgacgtcaccatgtacactagcaggtaccaaagaacctagttcctaccctagaaattgaacttctagtcgacccgtccgacgacacggccgtatattattgtgacgtagagtacttcctatcgatacaggtaggagggacgggggacgaacgtcggctccggacccggtcggggcccgtacggggaacccgtcggtaaccgacccgtccgttccgacgtaccgcccgtacccaaacccgg

SEQ ID NO: 318215 - DNA, 562 bp, Homo sapiens
  misc_feature: GZ8MTXP02FLJKY.44.35.D02.1.454.CMB.2.raw
  modified_base (553)..(553): a, c, t, g, unknown or other
  misc_feature (553)..(553): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtgttacatcagttagttattatggagttggctgcggcagtccggccgggaaggctggagtggattgggcgcatctataacagtggcagcaccaactaccaaccccgccctacaagagtcgacgtcaccatcgtcactagccaggtaccaaagaacccagttctaccctagaaattgacttctgtgacccgccgcggacacggccgtatattatgtgcgagagtattctatacgatacagtaggaggacgggggacaacgtggcgtccggacccgtcggggaccgaacgggaacccgtcggtcgaccgtccgcctaccgacgtccncccaaccgg

SEQ ID NO: 318216 - DNA, 702 bp, Homo sapiens
  misc_feature: GZ8MTXP02ING04.44.35.D02.1.454.CMB.2.raw
tcagacagtatatacacgaccggtgctcgatttagcacacgatagttgggtttgggggcctgggcctcaggaagcagcatcggaggtgcctcagccatggcatggatcccctctcttcctcggcgtccttgcttactgcacagggtccggggcctcctctgacctgactcagccatccctcactgtccgtgtccccaggacacacagtcactattacctgctctagggaaacttgagtgataattgcttcctggtatcagcagaggccaggccacgccccctatcgctggcagtctttacgaggtataactagcggcccctagagggactcccgtgacgcgtacttccgtcgtggcctccgaactcgtacgggaccgtcggaccctacgtccacgtaccatccacgccgacccgtacccacgccctagtacgggacttacggacgggtacctacggaacctttaactttacccggtagtaaccggtaacgggtacgttagggggaaaacgttcgtaaccgtttaaaggttcggggttacggttccggggacggggaaacggggtaacccctaaaggtccgtacggtaacccgggttttaccgcggggttaccaaaccggttaccccgaaaacggggtccttaaccccgggtcccccgttaccgggtaccgtaaccctttacccgtcccggtttacccccccg

SEQ ID NO: 318217 - DNA, 560 bp, Homo sapiens
  misc_feature: GZ8MTXP02G6H2B.44.35.D02.1.454.CMB.2.raw
  modified_base (295)..(295): a, c, t, g, unknown or other
  misc_feature (295)..(295): n is a, c, g, or t
  modified_base (385)..(385): a, c, t, g, unknown or other
  misc_feature (385)..(385): n is a, c, g, or t
  modified_base (402)..(402): a, c, t, g, unknown or other
  misc_feature (402)..(402): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtgttacatcagtattattattggagttggctgcgcagtccgcgggaaggactggagtggattgggcncatctataacagtggcagcaaccaactaccaaccccgccctacaagacgtcgacgtcaccatgtcactagcaggtccaaagaccagttcnccctagaaatgacttcngtcgacccgcgcgacacggtcgtactattatgtgacgtagagtacttctatcgatacagtacgagggacgggggacgaaacgtggacgtccggacccgtacggggccgacgggaccccgtcggtccgacccgtcgtcctcgaccgcctaccgacccgg

SEQ ID NO: 318218 - DNA, 646 bp, Homo sapiens
  misc_feature: GZ8MTXP02HSQRA.44.35.D02.1.454.CMB.2.raw
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttaggagaccctgtccctcacctgcaatgtctctggtggttacatcagtagttattattggagttggctgcggcagtccgcgggaggactggagtggattgggcgcatctataacagtggcagcacaactacaacccgcctacaagagtcgagtcaccatcgtcactagacgaggtaccaaagaaccctaagttctacccgtagtaaacttacgtaaccttctcggtcgtacccgccgaccgggaccgaccggtccgtataactttagttgttggacgtaagagtacttacctagtacgaactacaggtaacggaaggggacggggggtacgtaaacggtgggaccgtaccggaacccggttcgggggacccgacggggtaaaccccggtcggggtaaccgtaaccccggtcctttacccgtacgaacccggtcccgttacccggaaaccccgg

SEQ ID NO: 318219 - DNA, 735 bp, Homo sapiens
  misc_feature: GZ8MTXP02IOR8W.44.35.D02.1.454.CMB.2.raw
  modified_base (293)..(293): a, c, t, g, unknown or other
  misc_feature (293)..(293): n is a, c, g, or t
  modified_base (304)..(304): a, c, t, g, unknown or other
  misc_feature (304)..(304): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggccaggacgggtgaagccttcggagaccctgtccctcacctgcaatgtctctggtgttacatcagtattattattggagttggctgcggcagtccgcgggaaggctggagtggatgggcncatctataacngtggcagcaccaactaccaaccccgccctacaagacgtccgagtccaccatgtccaacttagactaggtacccaaaaggaaccctaggtttcctaccccgtagtaaaactttgaactttcgtagttacggaacccgcccggaccgggaacgaccgggtacccggttaatacgtttaaacgtttggttacggtaccggtaaggtaacggtacgtttacccccttaagttaccggaacttaaccgtaaagggttacggtaaacgggggtaccggggggggacgtaaaacggttcggggtacccgtacccggggtaacccccggttacggggggaccccgaaaccgggggtaaccccgttacggggttaacccgaaccccggttacccgttccccgttaaccgaccggtacccccttaacccgaaacccccggg

SEQ ID NO: 318220 - DNA, 649 bp, Homo sapiens
  misc_feature: GZ8MTXP02I9D2P.44.35.D02.1.454.CMB.2.raw
  modified_base (294)..(294): a, c, t, g, unknown or other
  misc_feature (294)..(294): n is a, c, g, or t
  modified_base (335)..(335): a, c, t, g, unknown or other
  misc_feature (335)..(335): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtgttacatcagtagttattatggagttggctgcggcagtccgcgggaaggctggagtggatgggcncatcataacagtggacagcaaccaactacaaccccgcctanaagcgtcgacgtccaccatcgtacaactaagaccgtacggtacccaaaaggtaaccctagtttaccctacccgtaagtaaacttgtaacttcgtagtacgacccgaccgccggacgaccggtaccgtaataatttacgttgtagacgagtacgtacttacctaagttacgaattaacgaggtaggaacggggacggggggactaaacggttcggacgtcccggaacccggtacggggaccggaaccgggtaacccgtacgggtaacccgtaccgtcccgttaccgtaccgaccggtaccctacccgaaacccgg

SEQ ID NO: 318221 - DNA, 599 bp, Homo sapiens
  misc_feature: GZ8MTXP02HY9BU.44.35.D02.1.454.CMB.2.raw
  modified_base (264)..(264): a, c, t, g, unknown or other
  misc_feature (264)..(264): n is a, c, g, or t
  modified_base (339)..(339): a, c, t, g, unknown or other
  misc_feature (339)..(339): n is a, c, g, or t
  modified_base (542)..(542): a, c, t, g, unknown or other
  misc_feature (542)..(542): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtgttacatcagtattatattggagttggctgcggcngtcgccgggaaggactgggagtggattgggcgcatctataacaggtggcagcaaccaactaccaaccccgccctnaaagacgtcgacgtccacctatgtacacttaagaccaggggtacccaaaagaaccctagttccctaccctaggtaaaacttcgtaaccttcgttacgtccgaacccggtcccggaccgggaaccgaaccgggtcccgttagttattaagttgttagacgtagagtacttcctatacgatacagtagaggacgggggacaacgnggctcggcccgtcgggccgacggaccgtgtccgaccgctccgcgacgcctaccaccg

SEQ ID NO: 318222 - DNA, 568 bp, Homo sapiens
  misc_feature: GZ8MTXP02GMSAT.44.35.D02.1.454.CMB.2.raw
  modified_base (297)..(297): a, c, t, g, unknown or other
  misc_feature (297)..(297): n is a, c, g, or t
  modified_base (338)..(338): a, c, t, g, unknown or other
  misc_feature (338)..(338): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtgttacatcagttagttattattggagttggctgcggcagtccgcgggaaggctggagtggattgggcncatctataacagtggcagcaccaactaccaaccccgcctanaagagtcgacgtcaccatgtcactagcaggtaccaaagaccagttcaccctagaaattgacttctgtcgaccgccgcgacacggccgtatattattgtgacgagagtattcctatcgatacgagtagaggacgggggacgaacgtggccgtccgacccggtcggggacccgacgggaacccgtgggtaaccgaaccggtcctcccgtacgacgtaccctaccgaacccgg

SEQ ID NO: 318223 - DNA, 554 bp, Homo sapiens
  misc_feature: GZ8MTXP02HWYYE.44.35.D02.1.454.CMB.2.raw
  modified_base (444)..(444): a, c, t, g, unknown or other
  misc_feature (444)..(444): n is a, c, g, or t
  modified_base (461)..(461): a, c, t, g, unknown or other
  misc_feature (461)..(461): n is a, c, g, or t
  modified_base (536)..(536): a, c, t, g, unknown or other
  misc_feature (536)..(536): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtacctcacctgcaatgtctctggtgttacatcagtagttattattggagttggctgcggcagtccgccgggaaggactgggagtggagttgggcgcatctaataacagtggcagcaccaactacaaccccgcctcaaagagtcgacgtcaccatcgtcactagcaggtaccaaagaccagttccacctagaaacttgacttctgtcgacccgccgcggacacggccgtatacttattgngtcgagtagattcctancgatacgagtagagggacgggggtacacgtggcctcggacccgtcgggccgacggtacccgtggtccgaccgtcncgtcacgcctacaacccg

SEQ ID NO: 318224 - DNA, 627 bp, Homo sapiens
  misc_feature: GZ8MTXP02GTRWI.44.35.D02.1.454.CMB.2.raw
tcagacagtatatacacgaccggtgctcgatttagcacacgatagttgggtttgggggggtcacaagaggcagcgctctcgggacgtctccaccatggcctgggctctgctgctcctcactctcctgactcaggacacagggacctgggcccagtccgccctgactcagccagcctccgtgtctgggtctcctggacagtcgctcaccctctcctgcactggaactaatactgatgttaggaaaatataaccttgtctcttggtaccaagtactacccaacggtaaaccccccaaactccttactttatgtaagtacaataaacgccggtccctcgggctattttctcatcgctttctcacggctccaagtctggcaacacggtcctcgttgattaaactttctcggccttccgtgtccctagaccgacgacggccgaacttattattcgctgctacattatggtcgggttacctagtagttagtttggggtcgttcgggcgggacggggtaccggtctacggacccgtccgttaggtccgacgcccgaacggtccttccggcccccttgggtccctaaccgttccgttccggttcccccgcccttacccttccttaactttaaccg

SEQ ID NO: 318225 - DNA, 710 bp, Homo sapiens
  misc_feature: GZ8MTXP02JY10X.44.35.D02.1.454.CMB.2.raw
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtggttacatcagttagttattattggagttgctgcggcagtccgccgggaaggactgggagtggagttggggcgcatctataacaggtggcagcaaccaactaccaaccccgcctacaacgacgtcgacgtcaccatcgtcactagacaggtacccaaagaacctagttccctaccctagtaaaactttcgtaacctttacgtcggttacgaacccccggtccggacccgggtaaccgaacccggggtacccgttaatttaacgtttaacgttggttacggacggtaggtacgtactttacccgtagttaccgattaaccgtaggttaaggacgggggaacggggggactaaacggtcggggaccgtacccgggtaaccccgggtcgggggaacccgaacgggggtaaacccccgtcggggtaacccgtaaccccgggttccacccggttccgaaccgtccccgtacccgaaaaccccgggg

SEQ ID NO: 318226 - DNA, 710 bp, Homo sapiens
  misc_feature: GZ8MTXP02FN41H.44.35.D02.1.454.CMB.2.raw
  modified_base (300)..(300): a, c, t, g, unknown or other
  misc_feature (300)..(300): n is a, c, g, or t
  modified_base (311)..(311): a, c, t, g, unknown or other
  misc_feature (311)..(311): n is a, c, g, or t
  modified_base (340)..(340): a, c, t, g, unknown or other
  misc_feature (340)..(340): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtggttacatcagttagttattatggagttggctgcggcagtccgcgggaaggactgggagtggattggggcncatctataacnggtgcagcaccaactaccaaccccgcctnaagagtcgagtccaccatgtcactagacaggtaccaaagaaccctagttacctaccctagtaaacttcgaactttctcgtcgaacccgcccggacggaaccaccggggtaccgttaacgttagtttaacgtttggtacggtaccgtaaggtaggtactttaccctaagttaccgtaaacgttaaccgtaaggttaagggaacgggggtaaccggggggggaccgtaaaacggttcggggacccgttacccgggaacccccgggttacgggggacccccgaaacgggggtaacccccgttacggggtaaccccgtaacccggttacccgttccccgtaccgaccggtacccccttacccgaaacccccggg

SEQ ID NO: 318227 - DNA, 570 bp, Homo sapiens
  misc_feature: GZ8MTXP02JCHFF.44.35.D02.1.454.CMB.2.raw
  modified_base (260)..(260): a, c, t, g, unknown or other
  misc_feature (260)..(260): n is a, c, g, or t
  modified_base (405)..(405): a, c, t, g, unknown or other
  misc_feature (405)..(405): n is a, c, g, or t
tcagacagtatatacacgaccggtgctcgatttagcacacgatagttgggtttgggggcctgggcctcaggaagcagcatcggaggtgcctcagccatggcatggatccctctcttcctcggcgtccttgcttactgcacagggtccgggcctcctctgacctgactcagccatcctcactgtccgtgtccccaggacacacagtcactattacctgctctaggggaaacttgagtagattaaattgacttctggtatcngcagagccaggccagcccctatgctgtcatctttcgagtataagtacgcgcctacgaggactacccgtgacgcgtcttcctcgtaggctaccactcgtagggaccaccgggtccacgtctacgaccatccgacgcgccgaacccngccctgacgatggacgtcagactttagtcctcggtacaggacggtagggaatgacgttaagtgggtacgttcgggacgacgggtaccgaacgtcgtacggtaccgttcgtacggtaccacggcccgtaagccgtccgccccgtggcctacgtcctccgtaccccc

SEQ ID NO: 318228 - DNA, 589 bp, Homo sapiens
  misc_feature: GZ8MTXP02F7LOW.44.35.D02.1.454.CMB.2.raw
  modified_base (347)..(347): a, c, t, g, unknown or other
  misc_feature (347)..(347): n is a, c, g, or t
  modified_base (401)..(401): a, c, t, g, unknown or other
  misc_feature (401)..(401): n is a, c, g, or t
  modified_base (573)..(573): a, c, t, g, unknown or other
  misc_feature (573)..(573): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtgttacatcagtagttattatggagttggctgcggcaggtccgcgggaaggactgggagtggattggggcgacatctaataaacgagtggcagccaaccaactaccaaccccgccctanaagagtcgagtcaccatcgtacactagcgaggtaccaaagtacccagtttaccncccgtataaacttgtaacttcgtgtcgaaccgccgacggacgacggtaccgtatacttattcgtagcggagagtattacctagtcgatacgtaagtaggaggacgggggcaacgtggcctacgaccccgtggggacccgaacgggaaccgtcggtaacgacccgtcgtcccncgacgcctaccgaccg

SEQ ID NO: 318229 - DNA, 687 bp, Homo sapiens
  misc_feature: GZ8MTXP02G5U7Z.44.35.D02.1.454.CMB.2.raw
  modified_base (317)..(317): a, c, t, g, unknown or other
  misc_feature (317)..(317): n is a, c, g, or t
  modified_base (338)..(338): a, c, t, g, unknown or other
  misc_feature (338)..(338): n is a, c, g, or t
tcagacagtatatacacgaccggtgctcgatttagcacacgatagttgggtttgggggcctgggcctcaggaagcagcatcggaggtgcctcagccatggcatggatccctctcttcctcggcgtccttgcttactgcacgagggtccgggcctcctctgacctgactcagccatcctcactgtccgtcgtccccaggaccacacagtcactattacctgctcgtagggtaaacttgagtagaattaaattgacttcgtggtaactcagcagacggccaggccacgcccctatcgctggtcatcttcgaagtataanacgcgacctgaggactcccgngacgccgtcttcccgtcgtcggtcctaccgtaacgttccggaacggggaacccgaccgggaccctaaccgtccgttaccggaaccctaacgtccgaaaccggcccgaccccgaacccgacggtccccttacggtaggaacgtcggtaaccggtcctacggtaaccttaacgttaccgtcgtaaccgtaaggaccggtaaggggtaaagtcgttaacgtaagggttggggtacggttccgggacgggtaacggaaccgtaaggtccgtacggtaccgttcgtaccgggtacaccggtaccgaacgtccgtcccgtccccgtacggtctaccgtccgttaccgttaccccc

SEQ ID NO: 318230 - DNA, 596 bp, Homo sapiens
  misc_feature: GZ8MTXP02HP85K.44.35.D02.1.454.CMB.2.raw
  modified_base (342)..(342): a, c, t, g, unknown or other
  misc_feature (342)..(342): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtgttacatcagtagttattattggagttggctgcgcagtccgcgggaaggctggagtggattgggcgcatctataacagtggcagcaccaaactaccaaccccgcctacgaagngtcgagtcaccatcgtcactagcaggtaccaaagaccctagttccacctagaaattgacttctgtcgacccggtcgcggacacggccgtatacgttattgtgcgtagagtattccagtcgatacgagtagacggacgggggacgaacgtcgggacctccggaccccggtcggggacccgaacggggtaaccccgtcgggtaacccgtacccggttccgtacccgtccgtaaccggcccttacccgaaaccccgg

SEQ ID NO: 318231 - DNA, 693 bp, Homo sapiens
  misc_feature: GZ8MTXP02GVAT6.44.35.D02.1.454.CMB.2.raw
tcagacagtatatacacgaccggtgctcgatttagcacacgatagttgggtttgggggcctgggcctcaggaagcagcatcggaggtgcctcagccatggcatggatccctctcttcctcggcgtccttgcttactgcacagggtccgggcctcctctgacctgactcagccatcctcactgtccgtcgtccccaggacacacagtcactattacctgctcgtagggaaacttgagtgataattgcttctgtatcagcagaggccaggcccacgccccctagtcgctggtcacttctttacgaggtaataaagtacggccggtaccctacgagggtactcccgtaggacgtccgtcttcccgtcgtcggtacctaccgtaaccgttccggtaacggggacccgtaccgggacccctaaccgtaccgttaccggtaacccaacgttacccgaaccggcccggtaaccccggaccccgaaccggtcccgttaccgtacggggtacgttacgggaccggtaccttacggtaacctttaagttaccgtcgtacgtaacgggtacggttaaggggtaaacgtcggtaagttacggttggggtacggtcgggacgggacggaaccgtagcgtacgtaccgttcgcggtacgacgccgtacggccgtccgccccgtacgtcctactccgtccgttacccc

SEQ ID NO: 318232 - DNA, 584 bp, Homo sapiens
  misc_feature: GZ8MTXP02HV59E.44.35.D02.1.454.CMB.2.raw
  modified_base (300)..(300): a, c, t, g, unknown or other
  misc_feature (300)..(300): n is a, c, g, or t
  modified_base (346)..(346): a, c, t, g, unknown or other
  misc_feature (346)..(346): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtgttacatcagtagttattattggagttggctgcggcagtccggccggggaaggctggagtggattggggcnatctaataacagtggcagcaaccgactacaaccccgcctagaaagngtcgacgtcaaccatcgtacacgtagccagggtcccaaagaccctagttcctcctagaaatttgacttctgtcgacccgcgcggacacggccgtatattattgtgacgagagtacttaccgtatacgatacgaggtagagggacgggggcgaacgtggccgtacgacccggtacggggacccgtacgggaaccccgtgggtccgacccggtctccgtacaccggtcctacccgaaccg

SEQ ID NO: 318233 - DNA, 571 bp, Homo sapiens
  misc_feature: GZ8MTXP02JUUWR.44.35.D02.1.454.CMB.2.raw
  modified_base (299)..(299): a, c, t, g, unknown or other
  misc_feature (299)..(299): n is a, c, g, or t
  modified_base (551)..(551): a, c, t, g, unknown or other
  misc_feature (551)..(551): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccagggacgggtgaagccttcggagaccctgtccctcacctgcaatgtctctggtgttacatcagttagttattattggagttggctgcggcagtccgcgggaaggctggagtggattggggcncgatctataacagtggcagcaaccaactaccaaccccgcctacaagacgtcgacgtcactatcgtcactagacaggtaccaaagaccagttctaccctagaaacttgacttcgtgtcgaccgcgcgacacggccgtatacttatcgtgcgagagacttcgtatcgatacaggtaggaggacggggggcaacgtcggctccggacccgtacggggcccgacgggaaccccgtggtaaccgaccggtcttcccncgacgccctaccgaacccgg

SEQ ID NO: 318234 - DNA, 790 bp, Homo sapiens
  misc_feature: GZ8MTXP02HVQW6.44.35.D02.1.454.CMB.2.raw
  modified_base (300)..(300): a, c, t, g, unknown or other
  misc_feature (300)..(300): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtgttacatcagtagttattattggagttggctgcggcagtccggccgggaaggactggagtggattggggcnatctaataacaggtggcagccaaccaaactaccaacccccgcctacaaagagtcgacgtcaaccatcgtacaactagacacgggtaccaaagaaccctagttccctacccgtagtaaacttagtaccttcgtacgtcggaacccgtcccggaccgggaaccgtaaccggggaccccggtttaagttaactttaaagtttacggtttaacgggaccggtaaaggtaacggtaaacgttttacccctaaagttaccgggtaaatttaacccggaaagggttaaggggtaaaccgggggaaacccgggggggggtaccggtaaaaccgggttcgggggtaacccggttaccccggggaacccccggggttaccggggggaccccggaaaccgggggtaaaccccccgttgggggttaacccccgtaaccccgggttaccctttacccccgtaccggtaacccggtccccctttaaccccggaaaacccccggg

SEQ ID NO: 318235 - DNA, 655 bp, Homo sapiens
  misc_feature: GZ8MTXP02IZR6L.44.35.D02.1.454.CMB.2.raw
  modified_base (284)..(284): a, c, t, g, unknown or other
  misc_feature (284)..(284): n is a, c, g, or t
  modified_base (381)..(381): a, c, t, g, unknown or other
  misc_feature (381)..(381): n is a, c, g, or t
  modified_base (421)..(421): a, c, t, g, unknown or other
  misc_feature (421)..(421): n is a, c, g, or t
tcagacagtatatacacgaccggtgctcgatttagcacacgatagttgggtttgggggcctgggcctcaggaagcagcatcggaggtgcctcagccatggcatggatccctctcttcctcggcgtccttgcttactgcacagggtccggggcctcctctgacctgactcagccatccctcactgtccgtcgtccccaggacacacagtcactattacctgctcgtagggaaacttgagtgataattgcttctggtatcagcagcggccaggcccacgcccctancgctggtcattctttacgaggataagtaagccggccctacgacggactccccgtgacgccgtcttccctctcggcctacctaactcgtacgggaccnccggcctactccgtagaccatcgacgccgacccgaacccngccctacgtaggagtcggacggctacgtaactttattaccgtaggtacgaacgggtacggttacggggtaaaagtcgtaacggttaaggtttgggggtacggttcggggaccggggtagggaaccgtaaacgggccgttacggaccggttccgtaccgggtacgaaccggtacccgaacggtcccgtcccggtcccccgtacgggtccctaccgttccgttacccgtttccccc

SEQ ID NO: 318236 - DNA, 749 bp, Homo sapiens
  misc_feature: GZ8MTXP02JP3GF.44.35.D02.1.454.CMB.2.raw
  modified_base (299)..(299): a, c, t, g, unknown or other
  misc_feature (299)..(299): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtgttacatcagtagttattattggagttggctgcggcagtccggcgggaaggactggagtggattggggcnctatctataacgagtgcagcaaccaactaccaaccccgcctacaagagtcgacgtccaccatcgtacactagaccacggtaccaaagaaccctagtttacctcccgtagtaaattcgtaaccttctcggtcgtacccgcccggtaccgggaaccgtaccggtaccgttaagttaacgtttaacgttcggttacggaccggtaagtacggtaactttaccccgtaagttacccgtaaagttaaccgaagggttaacggggaaacgggggtaaccggggggggaaccgtaaaaccggttcggggacccgttaccccgggtaacccccgggttacggggggacccccggtaaacgggggtaaacccccggtttccggggaaacccggtcccccggttacccgttaccccgtaccgtaaacccggtcccccgttaaccccgaaaacccccgggg

SEQ ID NO: 318237 - DNA, 557 bp, Homo sapiens
  misc_feature: GZ8MTXP02JMXZQ.44.35.D02.1.454.CMB.2.raw
  modified_base (312)..(312): a, c, t, g, unknown or other
  misc_feature (312)..(312): n is a, c, g, or t
  modified_base (386)..(386): a, c, t, g, unknown or other
  misc_feature (386)..(386): n is a, c, g, or t
  modified_base (392)..(392): a, c, t, g, unknown or other
  misc_feature (392)..(392): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtggttacatcagttagttattattggagttggctgcggcagtccgcgggaaggactggagtggattggggcgcagtcataaacngtggcagcaaccaactaccaaccccgccctacaagacgtcgacgtcaccatgtcactagcaggtccaaagaccngttccnccctagaaattgaacttctgtcgacccgcgccggacaccggctatattattgtggcgagagacttcctaatcgaatacgagtagaggacgggggacaacgtggcgtccgacccgtcgggccgacggacccgtggtcgaccgtctccgtcacgcccgtacaacccg

SEQ ID NO: 318238 - DNA, 628 bp, Homo sapiens
  misc_feature: GZ8MTXP02IRNW3.44.35.D02.1.454.CMB.2.raw
  modified_base (324)..(324): a, c, t, g, unknown or other
  misc_feature (324)..(324): n is a, c, g, or t
  modified_base (360)..(360): a, c, t, g, unknown or other
  misc_feature (360)..(360): n is a, c, g, or t
  modified_base (396)..(396): a, c, t, g, unknown or other
  misc_feature (396)..(396): n is a, c, g, or t
  modified_base (398)..(398): a, c, t, g, unknown or other
  misc_feature (398)..(398): n is a, c, g, or t
tcagacagtatatacacgaccggtgctcgatttagcacacgatagttgggtttgggggcctgggcctcaggaagcagcatcggaggtgcctcagccatggcatggatccctctcttcctcggcgtccttgcttactgcacgagggtccggggcctcctctgacctgactcagccatccctcactgtccgtgtccccaggacacacagtcactattacctgctcgtaggggaaacttgagtgaattaaatttgcttcctggtatcagcagaggccaggccacgccccctatcgctggtcatctttcagataatagcgcctgaggntccctgagcgtcttcctctgctccactcgtggaccncggccactctcgacatcagcgcgacccagcctacgngntcgagctagacttattactgtacgaggacgtaggggaaacgtgtacgtaaggttggggtacggtttcgggacggggacgggggtaaccctaaacgggtcgttacgggtaccccgtttacggtaccgggttaccacccgggaaccccggtaaagggtccccgttccccggtacccccccggttacggggtaccctaacccggtttccccgtttacccggtttacccccccc

SEQ ID NO: 318239 - DNA, 708 bp, Homo sapiens
  misc_feature: GZ8MTXP02H03YA.44.35.D02.1.454.CMB.2.raw
  modified_base (263)..(263): a, c, t, g, unknown or other
  misc_feature (263)..(263): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagacctgtccctcacctgcaatgtctctggtggttacatcagtagttatattggagttggctgcgnagtcgcgggaaggactgggagtggagttgggcgcatctataacagtggcagcaccaactacaaccccgccctacaacgacgtcgacgtcaccatcgtcactagacaggtaccaaacgaaaccacgttctacccctagtaaacttgacctttcgtgtacgacccgtcccggccgggaaccaaccgggtacccgttaagttactttaaagtttcggtagtaccggtaggtaggtactttacccgtaacgttccggtaaacttaacgtaacggttaaggaacggggaacgggggggggtaccgtaaaacggtcggggtacccgtaccgggtaccccccggtacgggggacccggtaaccgggggtaaaccccgttcggggtaacccgtaaccccgggttacccgtccccgttacccgaccggtaccccgtaccccgaaaacccccggg

SEQ ID NO: 318240 - DNA, 535 bp, Homo sapiens
  misc_feature: GZ8MTXP02IZXZ7.44.35.D02.1.454.CMB.2.raw
  modified_base (297)..(297): a, c, t, g, unknown or other
  misc_feature (297)..(297): n is a, c, g, or t
  modified_base (308)..(308): a, c, t, g, unknown or other
  misc_feature (308)..(308): n is a, c, g, or t
  modified_base (335)..(335): a, c, t, g, unknown or other
  misc_feature (335)..(335): n is a, c, g, or t
  modified_base (378)..(378): a, c, t, g, unknown or other
  misc_feature (378)..(378): n is a, c, g, or t
  modified_base (384)..(384): a, c, t, g, unknown or other
  misc_feature (384)..(384): n is a, c, g, or t
  modified_base (482)..(482): a, c, t, g, unknown or other
  misc_feature (482)..(482): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtggttacatcagtagttattattggagttggctgcggcagtccgcgggaaggctggagtggattgggcncatctataacngtggcagcacaactcaaccccgcctanaagagtcgagtccaccatgtcactagcaggtccaaagaacccngttacnccctagaaaattgacttctgtcgaccgccgcgacacggccgtatattattgtgcgagagattccatcgatacagtagaggacgggggacaacgtggcncgacccgtggggccaacgggaccctggcaccggtctcctcacgcctccaaccg

SEQ ID NO: 318241 - DNA, 599 bp, Homo sapiens
  misc_feature: GZ8MTXP02GUFM9.44.35.D02.1.454.CMB.2.raw
  modified_base (418)..(418): a, c, t, g, unknown or other
  misc_feature (418)..(418): n is a, c, g, or t
  modified_base (454)..(454): a, c, t, g, unknown or other
  misc_feature (454)..(454): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccagggacgggtgaagccttcggagaccctgtccctcacctgcaatgtctcgtggtgttacatcagtagttattagttggagttggctggcggcagtccgcgggaaggctgggagtggattgggcgcatctataacgagtggcagcaccaacctaccaaccccgcctacaagacgtcgacgtccaccatctacactagacgagtaccaaagaccctagttcctacctagtaaattgacttcgngtcgaccgccgacggacgacggtcgtactattatgngcgagagtacttcctatcgaatacgaagtaggagggacgggggtacaacggtcggaccgtccggacccggtcggggacccgacggggtaacccgtcggtaaccgtaccgtccgtacccgtccgacggtccccacccgaaacccgg

SEQ ID NO: 318242 - DNA, 736 bp, Homo sapiens
  misc_feature: GZ8MTXP02HIW1N.44.35.D02.1.454.CMB.2.raw
  modified_base (245)..(245): a, c, t, g, unknown or other
  misc_feature (245)..(245): n is a, c, g, or t
  modified_base (334)..(334): a, c, t, g, unknown or other
  misc_feature (334)..(334): n is a, c, g, or t
tcagacagtatatacacgaccggtgctcgatttagcacacgatagttgggtttgggggggtcacaagaggcagcgctctcgggacgtctccaccatggactgggctctgctgctcctcactctcctgactcaggacacagggacctgggcccagtccgccctgactcagccagcctccgtgtctgggtctcctggacagtcgctcaccctctcctgcactggaactaatactgatgttagaaatntaaccttgtctctgtacaagtataccacgtaaacccccaactccttacttatagaagtacaataacgccggccctcgggactactttcnctatcgtcttctcagcctacaacgtctcggacaacgaccggtcctcgttcgaactttaaacttttccgtcggtcccttccgtcggtcccttacggaaccggtaaccggtacgggtacccgtaaactttaagtttacgtttcggacttcggtaccttacctaagtttacgtcggggtaccggggttacccttaagggtactttaacgggtttcgggggttccgtttacgggggaccggggtaacgggggtccccgggtaccgttaccgggtaccccggttaccggttacgggtacccgaccggaaccccggtaaacggtcccgtaccccggtccccccgttacggtccctaaccgttcccgttcccgttcccccgtaccccttcccgttaccttacttaaccg

SEQ ID NO: 318243 - DNA, 602 bp, Homo sapiens
  misc_feature: GZ8MTXP02H3ZKN.44.35.D02.1.454.CMB.2.raw
  modified_base (295)..(295): a, c, t, g, unknown or other
  misc_feature (295)..(295): n is a, c, g, or t
  modified_base (342)..(342): a, c, t, g, unknown or other
  misc_feature (342)..(342): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtgttacatcagtagttattattggagttgctgcggcagtccgcgggaaggctggagtggattgggcncatctataacagtggcagcaaccaactaccaaccccgcctacaacgngtacgacgtccacctatcgtcaacgtagacaggtaccaaagaccctagttccacctagtaaattcgacttctgtcgaccgtaccggccggacgacggaccgtatacgttacttggtcgacgtagacgtacttactagtacgatacgagtaggaggacgggggactaacgtcggacgtacggacccggtacggggacccgacgggtaacccgtcgggtaaccgacccggtactcccgtcgaccgtcccgtaccgaacccgg

SEQ ID NO: 318244 - DNA, 589 bp, Homo sapiens
  misc_feature: GZ8MTXP02HRMBE.44.35.D02.1.454.CMB.2.raw
  modified_base (236)..(236): a, c, t, g, unknown or other
  misc_feature (236)..(236): n is a, c, g, or t
  modified_base (295)..(295): a, c, t, g, unknown or other
  misc_feature (295)..(295): n is a, c, g, or t
  modified_base (309)..(309): a, c, t, g, unknown or other
  misc_feature (309)..(309): n is a, c, g, or t
  modified_base (339)..(339): a, c, t, g, unknown or other
  misc_feature (339)..(339): n is a, c, g, or t
  modified_base (459)..(459): a, c, t, g, unknown or other
  misc_feature (459)..(459): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccagggacgggtgaagccttcggagaccctgtccctcacctgcaatgtctctggtgttacntcagtattattatggagttggctgcgcagtcggccgggaaggctggagtggattgggcnatctatacagtggnagcaaccaactaccaaccccgcctacaagngtcgacgtccaaccatcgtacactagacacgggtacaaaacgacctagttacccacctagtaaattcgtacttactcgtcgacccgtccgacggaccacggccgttatacgttattgtgngagtagacttacctatacgatacgaggtacgagggaacgggggcaaacgtcggcgtaccggacccggtcggggaccgacgggtaacccgtggtccgacccggtcttccgccaccgtcctacccgaaccgg

SEQ ID NO: 318245 - DNA, 595 bp, Homo sapiens
  misc_feature: GZ8MTXP02HR7ZP.44.35.D02.1.454.CMB.2.raw
  modified_base (304)..(304): a, c, t, g, unknown or other
  misc_feature (304)..(304): n is a, c, g, or t
  modified_base (315)..(315): a, c, t, g, unknown or other
  misc_feature (315)..(315): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtgttacatcagttagttattagttggtagttggctggcggcaggtccgcggggaaggctggagtggagttgggcgnatctaataacngtggcagcaaccaactaccaaccccgcctacaagagtcgacgtcaccatcgtacactagccaggtaccaaagaccctagttaccctaccctagtaaacttgactttctgtcgaccgccgacggacaccggcgtatattagttgtgacgtagagtacttcctagtcgaatacgaggtaggacggggacgggggactaacggtcggcgtacccggacccggtcggggaccgacggggaaccccgtggtaaccgaccgtctccacgccgcctaccgaacccgg

SEQ ID NO: 318246 - DNA, 729 bp, Homo sapiens
  misc_feature: GZ8MTXP02I2GGX.44.35.D02.1.454.CMB.2.raw
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaacgccttcggagaccctgtccctcacctgcaatgtctcgtggtgttacatcagttattattattggtagttggctggcggcaggtccggaccggggaaggctgggaagtggagttggggcgctatctaagtaacaggtcggacaggaccaaacctaaaccctaacccgaacccccgtcccctaacgaaacggtacggtaccgaacgttacccaacccgtagttacggtacaaacccgttaagaccgtacgggttaacccaaaacggtaaccctaggtttaccctacccgttaaagtaaaacttcgtaacctttcgtaggtaccgaacccggtccggaccgaacggaccggtaccgttattagtttaacgttgtaggacgagtacgtacttaccgtatacgacttaacgaggttacgggacgggggacgggggaactaacggtcggtaccgtacccgggtacccggacgggggacccgtaacgggtacccgtggtaacccgtccggttacctccaccgtacgtacccgtaccgaaacccggg

SEQ ID NO: 318247 - DNA, 671 bp, Homo sapiens
  misc_feature: GZ8MTXP02J2Y9M.44.35.D02.1.454.CMB.2.raw
  modified_base (277)..(277): a, c, t, g, unknown or other
  misc_feature (277)..(277): n is a, c, g, or t
  modified_base (340)..(340): a, c, t, g, unknown or other
  misc_feature (340)..(340): n is a, c, g, or t
  modified_base (366)..(366): a, c, t, g, unknown or other
  misc_feature (366)..(366): n is a, c, g, or t
  modified_base (389)..(389): a, c, t, g, unknown or other
  misc_feature (389)..(389): n is a, c, g, or t
tcagacagtatatacacgaccggtgctcgatttagcacacgatagttgggtttgggggcctgggcctcaggaagcagcatcggaggtgcctcagccatggcatggatccctctcttcctcggcgtccttgcttactgcacagggtccgggcctcctctgacctgactcagccatcctcactgtccgtgtccccaggacacacagtcactatacctgctctagggaaacttgagtgataatttgcttctgtatcagcagacgccaggccagcccctancgctggtcatctttcaggtataagtaacgcggtcccagagggtctccgtgacgcgtacttccncgtggcctaccacgtcgtagggaccncggtaccactctacgaccctaancacgccggaccacccgaaggtccctcgtaggggactacggaggtccgtagtaaccttacgttaacgtggtacgtagtacgggtacgggtaaaacgtcgtaaccggtttaaggttcgggggttcgtttaccggggacggggtaaacggggtaaccaaacggggtcgttaccggaacccgggtttgtcccggggttacaaccggttcccgaaaccgggtcccgttcccggtaacccccgtccggggttaccctaccgttacccggtttccgtttaacccccccg

SEQ ID NO: 318248 - DNA, 678 bp, Homo sapiens
  misc_feature: GZ8MTXP02H07XX.44.35.D02.1.454.CMB.2.raw
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttggagaccctatccctcacctgcaatgtctctggtgttacatcagtagttatattggagttggctgcggcaggtccgccggggaaggctgggagtgggagttggggcacgatctaataacgaggtggacagcaaccaactaccaacccccgcctaacaagacgtcgacgtccacctatcgtcacgtagaccacgggtaccaaacgaacctagttccacctaagtaaattcgaacctttcgtacggtacgaacccggccggtaccgggaccgtaaccgggtaccgttattaacgtttagtttcggtcgacggtagaacggtacttaccgtagtacgaacttaacgaaggttaacgggaaggggtacgggggggaacgtaacggtcggggaccgtaccggtaacccccggtcgggggacccgaacggggtaaccccgtcggtcccgaaccggttccgtacccgtccaccgccgttacccgaacccgg

SEQ ID NO: 318249 - DNA, 824 bp, Homo sapiens
  misc_feature: GZ8MTXP02JEZDV.44.35.D02.1.454.CMB.2.raw
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccagggacgggtgaagccttcggagaccctgtccctcacctgcaatgtctctggtgttacatcagtattattatggagttgctgcggcaggtccgcgggaaggctggagtggagttgggcgcatctataacgaggtggacagccaaccaactaccaaccccgccctacaaaggacgtccgaacgtccaaccatacgtcaactaagactacgggtaccaaacgaacccagtttcctaccccgtagtaaaacttcgtaacctttcgtacggttacggaacccccggacccggcccggggaaacccgtacccggggtacccgttaaacgttaacgttttaacggtttacgggttacggtaaccgggtaaggtaaaacgggttaaccttttaaccccgttaaagttaacccggtaaacgtttaaacccggaaaacggggtttaaaggggaaacgggggttaaacccggggggggggaaccggtaaaaaccggggtttcggggaacccggttacccccggggtaaacccccgggttacgggggaccccgggtaaaccgggggtaaacccccggttacggggtaacccgtaaaccccggttcccggttaccccgttaccgacccggtacccccgttaccccgaaaacccccgggg

SEQ ID NO: 318250 - DNA, 612 bp, Homo sapiens
  misc_feature: GZ8MTXP02JM6KQ.44.35.D02.1.454.CMB.2.raw
  modified_base (373)..(373): a, c, t, g, unknown or other
  misc_feature (373)..(373): n is a, c, g, or t
  modified_base (450)..(450): a, c, t, g, unknown or other
  misc_feature (450)..(450): n is a, c, g, or t
tcagacagtatatacacgaccggtgctcgatttagcacacgatagttgggtttgggggcctgggcctcaggaagcagcatcggaggtgcctcagccatggcatggatccctctcttcctcggcgtccttgcttactgcacagggtccggggcctcctctgacctgactcagccatcctcactgtccgtgtccccaggacacacagtcactattacctgctctgggaaacttgagtgataaattgcttctggtatcagcagagccaggccaggccccctagtcgctaggtcatctttcaggataataacgccggacctcgagggactccccgtgacgccgtcttcccgtctggcctaccaactcgtacgggacnccgggctacctctacgaccatcgagccgacccgacccagccctgtcgagtgacgggtctacggaccttagttaccgngttaccgaaggtacggtaggggtaaaagttcgagttaaggttgggttacgttcggggacggaacgggaaccaaggtcgtacggtaccgtttcgacggttacgaacgcccgaagggtcctccggtcccccgtcggtaactaccggttcctacccgtttccccc

SEQ ID NO: 318251 - DNA, 638 bp, Homo sapiens
  misc_feature: GZ8MTXP02HGH8F.44.35.D02.1.454.CMB.2.raw
  modified_base (235)..(235): a, c, t, g, unknown or other
  misc_feature (235)..(235): n is a, c, g, or t
  modified_base (298)..(298): a, c, t, g, unknown or other
  misc_feature (298)..(298): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtgttacntcagtagttattattggagttggctgcggcaggtccgccgggaaggctggagtggagtgggcncatctataacagtggacagacaaccaacctaccaacccccgccctacgaacgacgtcgacgtccaccatcgtcaactagacacggtaccaaacgaaccctagttaccctccctagaaactttcgtaaactttcgtgtacggtacccgccgtaccgaccgacggaccttattacgttagtttgtagcgtaagacgtactttaccctagtacgtaatacgtagtaggacggggacgggggtacaacggtcgggactcccggacccggtcgggacccggaacgggtacccgtggaacccgtaccggtccttcccgaccgtaccgtccctaccccgaacccggg

SEQ ID NO: 318252 - DNA, 569 bp, Homo sapiens
  misc_feature: GZ8MTXP02GESS2.44.35.D02.1.454.CMB.2.raw
  modified_base (211)..(211): a, c, t, g, unknown or other
  misc_feature (211)..(211): n is a, c, g, or t
  modified_base (382)..(382): a, c, t, g, unknown or other
  misc_feature (382)..(382): n is a, c, g, or t
  modified_base (388)..(388): a, c, t, g, unknown or other
  misc_feature (388)..(388): n is a, c, g, or t
  modified_base (448)..(448): a, c, t, g, unknown or other
  misc_feature (448)..(448): n is a, c, g, or t
  modified_base (476)..(476): a, c, t, g, unknown or other
  misc_feature (476)..(476): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttaggagaccctgtccctnacctgcaatgtctctggtgttacatcagtagttattattggagttgctgcggcagtccggcgggaaggactggagtggattgggcgcatcataacaggtggcagcaaccaataccaaccccgcctacaagacgtcgaagtcaccatcgtcactagcaggtccaaagaaccngttccnccgtagtaaaattgtacttactgtcgaccgccgcggacacggccgtatacttaattgtcncggagagattccatcattaacaggttanaggtacggggggacaacgtggacgtacggaccccgtggggaccgaacggggaacctcgggtcgacccgtcgtcctcgacgcctaccaacccgg

SEQ ID NO: 318253 - DNA, 757 bp, Homo sapiens
  misc_feature: GZ8MTXP02J0A91.44.35.D02.1.454.CMB.2.raw
  modified_base (198)..(198): a, c, t, g, unknown or other
  misc_feature (198)..(198): n is a, c, g, or t
  modified_base (388)..(388): a, c, t, g, unknown or other
  misc_feature (388)..(388): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttgganaccctgtctctcatctgcactgtctctggtatttccatcagttctgattctattcgttgggtctggatcccggcacgcccccgagggaggggatggagtggattgggtgactatccaatttatacggtgggcgtacgttactactctacccgtccctcaacgtacgtcgtactacctacctagtttcggnggggacaccgttaccgattacgaaacccgtctttaccctccccgttaacgtaaaacccttcggaaccccttcccgggtaccggtacccccggggacccggaccggggtaacccgtaaccccgggggttaccccgttttttaacgtttaccggttcggttacggccgggtaacggggtaccgggaacggtaccgttacggggtttccttttaaccgtaagttccccgttaaggttccgggggtacccggttaacggtcccgtaccccggttaggtcccgtaaccgtttcggtaccctaccctcgtaaccgtccgttacccgaaccgaaccggggtaccctaacggttcccgttcccctttccccccgggg

SEQ ID NO: 318254 - DNA, 691 bp, Homo sapiens
  misc_feature: GZ8MTXP02F4XVJ.44.35.D02.1.454.CMB.2.raw
  modified_base (295)..(295): a, c, t, g, unknown or other
  misc_feature (295)..(295): n is a, c, g, or t
  modified_base (306)..(306): a, c, t, g, unknown or other
  misc_feature (306)..(306): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccagggacgggtgaagccttcggagaccctgtccctcacctgcaatgtctctggtgttacatcagtagttattattggagttggctggcggcagtccgcggaggctggagtggatgggcnatctataacgngtgcagcaccactaccaccccgcctacaagtagtacgacgtaccacctatcgtaccaacgtacgaccaacggtaccaaaacgtacccgttagttccctacccgtaagtaaacttacgttaccttcgtacgtaccgtacccgaccggaccggaaccgtaccggtaccgttaattagttacgttggtacggacggtaagtacgtaacttactaacgtacgaacgtaacgtaaggtaacggggaacggggtacggggggaccgtaacggtcggtaccggtacccggtaccccgggtacggggtacccggtaaccggggtaacccgtaccgggtaacccgtacccggttaccgtacccgtaccgtacccgtacccgtacccgaacccgg

SEQ ID NO: 318255 - DNA, 671 bp, Homo sapiens
  misc_feature: GZ8MTXP02GWOJT.44.35.D02.1.454.CMB.2.raw
  modified_base (268)..(268): a, c, t, g, unknown or other
  misc_feature (268)..(268): n is a, c, g, or t
  modified_base (299)..(299): a, c, t, g, unknown or other
  misc_feature (299)..(299): n is a, c, g, or t
  modified_base (309)..(309): a, c, t, g, unknown or other
  misc_feature (309)..(309): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatcgtctcgtggtgttacatcagttagttattattggagttggctgcggnaggtccgcgggaaggctggagtggatgggcncatctatacngtggcagccaaccaactaccaaccccgcctacaagcgtacgacgtccacctatgacaactaagacacgggtaccaaaggaaccctagttccctcctaagtaaacttcgtaactttcgtacggtcgacccggccggaccggaacgtacccgggtacccgtattaacgtttagttggttacgaccggtaagtaacggttactttacccgtaagtacgtaataacgtaaggttaggaacgggggaccggggggactaaacggtcgggaccgtacccggaccccggtcggggacccgtaccggggtaacccgtcgggtaacccgtacccggttcctcccgtacgaccgtccccgtaccgaacccgg

SEQ ID NO: 318256 - DNA, 786 bp, Homo sapiens
  misc_feature: GZ8MTXP02H5VGS.44.35.D02.1.454.CMB.2.raw
  modified_base (297)..(297): a, c, t, g, unknown or other
  misc_feature (297)..(297): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctccagatgggtcgtgtccgaggtgcagctgcaggagtcgggcccagggacgggtgaagccttcggacaccctgtccctcacctgcaatgtctctggtgttacatcagtagttattattggagttggctgcggcagtccgcgggaaggctgggagtggattgggcnctatcctaataacgaggtggacagacaacccaaactacccaacccccgcctacaaaggcgtacgaccgtccaaccatcgtacacgtacgacacgggtaacccaaacgtaacccctaggttaccctaccccgttaagtaaaacgtttcggtaacctttccgttacggttacccggaaccccggtcccgggtaaccgggaacccgtaacccgggtacccggttaatttaacgtttaacgtttcggttacggtaccggtaaggtaacggttaactttacccgttaaagttaaccggtaaacgttaaaccggtaagggttaaacggggtaacgggggtaaccggggggggaaccgtaaccgggtacggggtcccgttacccgggacccccgggttacgggggacccgaacccgggggtaacccgtaccggggtaacccgtaacccggtaccgttcccgtaccgaccggtaccccgttaccccgaaaccccggg

SEQ ID NO: 318257 - DNA, 571 bp, Homo sapiens
  misc_feature: GZ8MTXP02F7VD9.44.35.D02.1.454.CMB.2.raw
  modified_base (308)..(308): a, c, t, g, unknown or other
  misc_feature (308)..(308): n is a, c, g, or t
  modified_base (413)..(413): a, c, t, g, unknown or other
  misc_feature (413)..(413): n is a, c, g, or t
  modified_base (427)..(427): a, c, t, g, unknown or other
  misc_feature (427)..(427): n is a, c, g, or t
  modified_base (448)..(448): a, c, t, g, unknown or other
  misc_feature (448)..(448): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtggttacatcagtagttattattggagttggctgcggcagtccgcgggaggactggagtggattgggcgcatctataacngtggcagcaccaactacaaccccgcctcaagagtcgagtcaccatgtcactagacaggtccaagaacccagttctaccctgaaattgacttctgtgacccgccgnggaccacggcctanatttatgtgcgagagattccntcggatacgagtagaggtacggggggacgaacgtggactccggaacccctcgggggcccgtagggaaacccccgttggtcccgacccggtactccccgttacgacgacccgtccctaaccccg

SEQ ID NO: 318258 - DNA, 554 bp, Homo sapiens
  misc_feature: GZ8MTXP02GDD6P.44.35.D02.1.454.CMB.2.raw
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtggttacatcagtagttattattggagttggctgcggcagtccgcgggaaggactggagtggattgggcgcatctataacagtggcagcaccaactacaaccccgcctcaagagtcgacgtcaccatgtcactagcaggtccaaagaccagttactccctagaaattgaacttctagtgaccgcgcggacacggtccgtatattattgtagcgagagattcctatcgatacagtaggagacgggggacgaacgtgggactcggacccgtggggacccgacgggaacccgtcggtccgaccgtcgtcctcgacgcccaccgaacccg

SEQ ID NO: 318259 - DNA, 564 bp, Homo sapiens
  misc_feature: GZ8MTXP02H8E6S.44.35.D02.1.454.CMB.2.raw
  modified_base (197)..(197): a, c, t, g, unknown or other
  misc_feature (197)..(197): n is a, c, g, or t
  modified_base (396)..(396): a, c, t, g, unknown or other
  misc_feature (396)..(396): n is a, c, g, or t
  modified_base (467)..(467): a, c, t, g, unknown or other
  misc_feature (467)..(467): n is a, c, g, or t
  modified_base (489)..(489): a, c, t, g, unknown or other
  misc_feature (489)..(489): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctccagatgggtcgtgtccgaggtgcagctgcaggagtcgggcccaggacgggtgaagccttgganaccctgtccctcacctgcaatgtctctggtgttacatcagtattattattggagttggctgcggcaggtccgccggggaaggactgggagtggattggggcgcatctataacagtggcagcaaccaactaccaaccccgcctcaaagcgtcgacgtcaaccatgtcacttagacaggtccaaagaccagttccacctanaaacttagacttctgtcgaccgccgcgacgacgccgtactatacttgtgcgagagtatctatacgatacgngtagaggacgggggacgaacgnggcgtccgacccggcgggaccgacgggtacccgtcggtccgaccgtcctccgtccgaccgacccttccgaacccg

SEQ ID NO: 318260 - DNA, 731 bp, Homo sapiens
  misc_feature: GZ8MTXP02JQZL2.44.35.D02.1.454.CMB.2.raw
tcagacagtatatacacgaccggtgctcgatttagcacacgatagttgggtttgggggcctgggcctcaggaagcagcatcggaggtgcctcagccatggcatggatccctctcttcctcggcgtccttgcttactgcacgagggtccggggcctcctctgacctgactcagccatcctcactgtccgtgtccccaggacacacagtcactattacctgctcgtaggggaaaacttgagtgataaatttgcttcctgtatcagcagaggccaggcccacgcccccctatcggctcggtcacttctttacaggtataagtaacggccggcccgtacgacgggtacttcccgtaggtacgccggtccttcccgtccgtggtaccctacccgtaaactccggttacggggaacctaccggggacctaccttccgacgaaccctacgtacccaacgggcccgacccggaacccccaacggtccccttacgtacggggtaacctgggaaccgttccgtacgtaccttaacgttactacgttacgaacggtaccggtaagggggaaaacgttggaacggttaaggtttcggggtaggttccgggggaccggggtacggggaacgtaaaacggtcggttaccgggtaacccgtttccgggttacggtaccgaccgacccgaacgggtccgtcccggtaccccgtcgggtcctacccggtccttccggtttaacccccc

SEQ ID NO: 318261 - DNA, 628 bp, Homo sapiens
  misc_feature: GZ8MTXP02JCX7I.44.35.D02.1.454.CMB.2.raw
  modified_base (297)..(297): a, c, t, g, unknown or other
  misc_feature (297)..(297): n is a, c, g, or t
  modified_base (306)..(306): a, c, t, g, unknown or other
  misc_feature (306)..(306): n is a, c, g, or t
  modified_base (336)..(336): a, c, t, g, unknown or other
  misc_feature (336)..(336): n is a, c, g, or t
  modified_base (612)..(612): a, c, t, g, unknown or other
  misc_feature (612)..(612): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccagggacgggtgaagccttcgggagaccctgtccctcacctgcaatgtctctggtgttacatctagtagttattattggagttggctgcggcagtccgcgggaggctggagtggatgggcnatctatacngtggcagcaccaactaccaaccccgcctanaagacgtcgacgtcaccatcgtacactagacacgggtaccaaaggtaccctagttcctcccgtaagtaaacttgtaacctttcgtaggtccgacccggccgacggaccgacggtccgtattacttagttgtacggcggtaagagtacttactacgtacgtacttaacgaggtaacggaacggggacggggggacaaacggttcggaccttaccgggaccccggttacgggggaccgtaacggggaacccgtcggtaaccgaccggtcctaccgtanaccggctaacaccccg

SEQ ID NO: 318262 - DNA, 565 bp, Homo sapiens
  misc_feature: GZ8MTXP02IC5OF.44.35.D02.1.454.CMB.2.raw
  modified_base (244)..(244): a, c, t, g, unknown or other
  misc_feature (244)..(244): n is a, c, g, or t
  modified_base (255)..(255): a, c, t, g, unknown or other
  misc_feature (255)..(255): n is a, c, g, or t
  modified_base (302)..(302): a, c, t, g, unknown or other
  misc_feature (302)..(302): n is a, c, g, or t
  modified_base (323)..(323): a, c, t, g, unknown or other
  misc_feature (323)..(323): n is a, c, g, or t
  modified_base (376)..(376): a, c, t, g, unknown or other
  misc_feature (376)..(376): n is a, c, g, or t
  modified_base (429)..(429): a, c, t, g, unknown or other
  misc_feature (429)..(429): n is a, c, g, or t
  modified_base (532)..(532): a, c, t, g, unknown or other
  misc_feature (532)..(532): n is a, c, g, or t
tcagacagtatatacacgaccggtgctcgatttagcacacgatagttgggtttggggggggtcacaagaggcagcgctctcgggacgtctccaccatggcctgggctctgctgctcctcactctcctgactcaggacacagggacctgggcccagtccgcctgactcagccagcctccgtgtctgggtctcctggacagtcgctcaccctctcctgcactggaactaatactgatgtagaaatntaacctgtctntggtacaatactacccacggtaaacccccaactccttcttatgaatnaatagcgcctggcatttctcntcgtctctcaggtctctaagtctggcaacacggccttcgtgtaattaatttcncggtccctctcgtcccgtagaccgacggacggcctaactatttatcgctgctnatatgcgggtacttagattagttggtcgttgggcggacgggtaccggctcggaccgttctacgggtccacggacctaacgggctaccggtccccctggtaccncgttcctccgttcccacccttcctacttactac

SEQ ID NO: 318263 - DNA, 682 bp, Homo sapiens
  misc_feature: GZ8MTXP02HUR3O.44.35.D02.1.454.CMB.2.raw
  modified_base (355)..(355): a, c, t, g, unknown or other
  misc_feature (355)..(355): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggccaggacgggtgaagccttcggagaccctgtcctcacctgcaatgtctcgtggtgttacatcagtagttattatggagttggctggcggcaggtccggaccggggaaggactgggagtggattggggcgcatctaataacgaggtggcagccaaccaactaccaaccccgcctagaaacgngtcagtccaccatgtacactagcaggtccaaagaaccctagttccctacctagtaaattcgtacttcgtacgtcggaacccgccgaccgggacgaccgggtaccgttaacgttaacttaagtttggtggtacggtaaggtagttaacgttccttaacgttacgaagttaaacgaggtaacggggaacggggaacggggggggtacgtaacggtacgggtccggtacccgggtaccccggttacgggggacccggttaaccggggaacccgtcgggttaacccgaccggttaccctacccgtccgaccgtacccgtacccgaacccgg

SEQ ID NO: 318264 - DNA, 552 bp, Homo sapiens
  misc_feature: GZ8MTXP02FSJP7.44.35.D02.1.454.CMB.2.raw
  modified_base (266)..(266): a, c, t, g, unknown or other
  misc_feature (266)..(266): n is a, c, g, or t
  modified_base (298)..(298): a, c, t, g, unknown or other
  misc_feature (298)..(298): n is a, c, g, or t
  modified_base (335)..(335): a, c, t, g, unknown or other
  misc_feature (335)..(335): n is a, c, g, or t
  modified_base (339)..(339): a, c, t, g, unknown or other
  misc_feature (339)..(339): n is a, c, g, or t
  modified_base (379)..(379): a, c, t, g, unknown or other
  misc_feature (379)..(379): n is a, c, g, or t
  modified_base (397)..(397): a, c, t, g, unknown or other
  misc_feature (397)..(397): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtgttacatcagttagttattattggagttggctgcggnagtccgccgggaaggctgggatggattgggcncatctatacagtggcagcaccaactacaccccgcctnaagngtcagtccaccatgtcatagcaggtccaaagaccagttcnccctagaaattgacttcngtcgaccgccgcgtacacggccgtatactttatgtagacgagagtattctactacgattacgagtagagacgggggcaacgtggctcggacccgtggggcccaacgggggaccttaggggtccaccgtcgtaccctcgacgcccgtccaaaccgg

SEQ ID NO: 318265 - DNA, 668 bp, Homo sapiens
  misc_feature: GZ8MTXP02FFMJT.44.35.D02.1.454.CMB.2.raw
  modified_base (294)..(294): a, c, t, g, unknown or other
  misc_feature (294)..(294): n is a, c, g, or t
  modified_base (300)..(300): a, c, t, g, unknown or other
  misc_feature (300)..(300): n is a, c, g, or t
  modified_base (335)..(335): a, c, t, g, unknown or other
  misc_feature (335)..(335): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtgttacatcagtagttattatggagttgctgcggcagtccgcgggaaggctggagtggattgggcnatctanaacagtgcagcaaccaactaccaaccccgtcctanaagcgtacgacgtccaccgatcgtacaactaagaccaacgggtacccaaaaggtaaccctaagtttcccaccccttagtaaaactttacgacctttcgtacgtacgaacccgcccggaccggaacgaaccggggtcccgttaaacttaatttaaacgttggacggtacggtaagaacgtacgttccgtaaactacgaattaaccgaagtaagggaacggggaacggggggacgaaacggtcgggcctacccggacccgtcggggacccgaaccggggaacccgtcggtaaccgtaaccgtccgtaccgacgaaccgtcccacccgaaacccgg

SEQ ID NO: 318266 - DNA, 568 bp, Homo sapiens
  misc_feature: GZ8MTXP02HK4Z7.44.35.D02.1.454.CMB.2.raw
  modified_base (443)..(443): a, c, t, g, unknown or other
  misc_feature (443)..(443): n is a, c, g, or t
  modified_base (461)..(461): a, c, t, g, unknown or other
  misc_feature (461)..(461): n is a, c, g, or t
  modified_base (551)..(551): a, c, t, g, unknown or other
  misc_feature (551)..(551): n is a, c, g, or t
tcagacagtatatacacgaccggtgctcgatttagcacacgatagttgggtttgggggcctgggcctcaggaagcagcatcggaggtgcctcagccatggcatggatccctctcttcctcggcgtccttgcttactgcacagggtccggggcctcctctgacctgactcagccatcctcactgtccgtgtccccaggacacacagtcactattacctgctctagggaaaacttgagtgataaatttgcttctggtatcagcagaggccaggccacgcccctatcgctggtcatctttcaggataataagcggccctgagggatcccgtagacgcgtcttcctctggcctaccaaacttcgaggggaaccacgggccaacttcgagaccatcacgccgacccgaccctacgcccttcgaggatggaggtcctgaactattaccngtacagacgtagggaaangtactaagtgggtacgtcggacggaggaccaagtcgtcggaaccgttcgttacggacacggacccaagggcctacgcccccgtcggtacnccgtccttacgtccccc

SEQ ID NO: 318267 - DNA, 558 bp, Homo sapiens
  misc_feature: GZ8MTXP02IAEWF.44.35.D02.1.454.CMB.2.raw
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtggttacatcagtagttattattggagttggctgcggcagtccgccgggaaggactggagtggagttgggcgcatctataacagtggcagcacaactacaaccccgcctcaagagtcgagtcaccatcgcactagacacgggtaccaaagaacccagttcctaccctgaaaacttgaccttctgtgacccgccgcggacgacggccgtatagttaattgtgcgagagtattcctatcgatacgagtagaggacgggggcaacgtggctcggacccgtggggccgacggggaccctggtccaccggtctcccgtcgacgcctccgaacccg

SEQ ID NO: 318268 - DNA, 765 bp, Homo sapiens
  misc_feature: GZ8MTXP02HGECV.44.35.D02.1.454.CMB.2.raw
  modified_base (303)..(303): a, c, t, g, unknown or other
  misc_feature (303)..(303): n is a, c, g, or t
  modified_base (321)..(321): a, c, t, g, unknown or other
  misc_feature (321)..(321): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtgtacatcagtattattattggtagttggctggcggcacggtccggacggggaaggactgggagtggagtgggcncatctataacgagtgganagcaaccaactacccaacccccgcctacgaaacgacgtaccgacgtccaacctagtgtacaactacgactacgggtaccaaaacgacctacgttacctacccttaagtaaaactttcgtaaccgtttactacggttaccggaacccggtcccggaccgggaaccgtaacccggggtacccgttaaagtttaaacgtttaaacgtttcggttacggaccggtaaacggaggttaaacctttacccgtaagttaccgaagttaaaccgagggttaaacgggtaaacgggggtaaacggggggaaacctaacggttacgggtacccgttaccccgggaacccccggttagggggacccccgtaaacgggggtaacccccgttacggggtaaccctacccggttccgtaccccgtacgaacccgtacccccgtaaccgaaacccccgg

SEQ ID NO: 318269 - DNA, 582 bp, Homo sapiens
  misc_feature: GZ8MTXP02GFLPA.44.35.D02.1.454.CMB.2.raw
  modified_base (299)..(299): a, c, t, g, unknown or other
  misc_feature (299)..(299): n is a, c, g, or t
  modified_base (311)..(311): a, c, t, g, unknown or other
  misc_feature (311)..(311): n is a, c, g, or t
  modified_base (340)..(340): a, c, t, g, unknown or other
  misc_feature (340)..(340): n is a, c, g, or t
  modified_base (385)..(385): a, c, t, g, unknown or other
  misc_feature (385)..(385): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccagggacgggtgaagccttcggagaccctgtccctcacctgcaatgtctctggtgttacatcagttagttattattggagttggctgcggcaggtccgcgggaaggctggagtggattgggcncatctataacgngtggcagcaccaactccaaccccgcctanaagcgtcgactccacatgtacactagcaggtacccaaagaacccngttccaccctagtaaattgtacttctagtcgacccgccgaccggtacgacggtcgtatattattgtgacgagagtacttctatcgatacgagtaggagggacgggggacgaacgtcggaccgtccggacccgtcggggacccgaacggggacccgtcggtccgtaccggtcgtccctcgaccgccctaccgaacccg

SEQ ID NO: 318270 - DNA, 684 bp, Homo sapiens
  misc_feature: GZ8MTXP02I81PY.44.35.D02.1.454.CMB.2.raw
  modified_base (358)..(358): a, c, t, g, unknown or other
  misc_feature (358)..(358): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtcctcacctgcaatgtctctggtgttacatcagtagttattattggagttgctgcggcagtcgcgggaggctggagtggattgggcgcatctataacagtggcagcaccaactacaaccccgcctacaagacgtcgacgtcaccatgcactancacgtacaaagaaccagttcctacctagtaaatttcgtaactttcgtacggttacgacccgccggaccgggaaccaccgggtacccgttaattacgtttaacgttggttacgaccggtaagacgttactttaccgtataccgtaattaccgaaggttaaggaacggggacggggggacgtaaacggtcgggtacccgtaccggggtacccccgggttacgggggacccgtaaaccgggggtaccccgttaccggggtaacccgtaccccggggttacccttaccccggttccgaaccggtcccccgttacccgaaaacccccgggg

SEQ ID NO: 318271 - DNA, 612 bp, Homo sapiens
  misc_feature: GZ8MTXP02FSRID.44.35.D02.1.454.CMB.2.raw
  modified_base (262)..(262): a, c, t, g, unknown or other
  misc_feature (262)..(262): n is a, c, g, or t
  modified_base (292)..(292): a, c, t, g, unknown or other
  misc_feature (292)..(292): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtgttacatcagtagttattatggagttgctgcgnagtccgcgggaaggctggagtggatgggcnatctataacagtggcagcaaccaaactaccaaccccgccctacaaagacgtcgagtcaccatgtcactagcaggtaccaaagaccagttccaccctagaaaacttgtaaccttctacggtcgaacccgcccgacggtaacgaaccggtccgttaatagtttaagttggtagacgagtagtacttcctaatcgtaatacgtaagtaggaaggggacgggggtacaaacggtcggacgtaccggaacccggtcgggggaccgaacggggaaccctcggtaaccgtacccgtacgtccctacgacgcccgtaccgaaacccgg

SEQ ID NO: 318272 - DNA, 708 bp, Homo sapiens
  misc_feature: GZ8MTXP02H50G8.44.35.D02.1.454.CMB.2.raw
  modified_base (262)..(262): a, c, t, g, unknown or other
  misc_feature (262)..(262): n is a, c, g, or t
tcagacagtatatacacgaccggtgctcgatttagcacacgatagttgggtttgggggcctgggcctcaggaagcgagcatcggaggtgcctcagccatggcatggatccctctcttcctcggcgtccttgcttactgcacagggtccgggcctcctctgacctgactcagccatcctcactgtccgtgtccccaggacacacagtcactattacctgctctaggggaaaacttgagtgtataatttgcttctggtatcagnagagccaggccagccccctagcgctggtcatctttcagataatagccggcctacgaggactcccgtgacgcgtcttccgtcgtcggctaccgaactcgtacggaccaccggccacgtctacgaccatcgacgccgaccgacccacgtccctgtacggtactacggtacggtaccttacggaactttaacgtttaccgttcggtaacgtaacgggtacggggtaacggggtaaaaggttcccggaacgtttaaaggtttcgggggttaacggtttaccgggggtaaccgggggaacgggggtaaaacccccgtaaagggtccgttacgggtacccggtttaacggtcccggttaacgaccggtaccccgtaaacgggtcccgttcccccggacccccggttccgggttaaccccgaccgtttcccgttacccggtttaacccccccg

SEQ ID NO: 318273 - DNA, 723 bp, Homo sapiens
  misc_feature: GZ8MTXP02J2MF3.44.35.D02.1.454.CMB.2.raw
  modified_base (295)..(295): a, c, t, g, unknown or other
  misc_feature (295)..(295): n is a, c, g, or t
  modified_base (307)..(307): a, c, t, g, unknown or other
  misc_feature (307)..(307): n is a, c, g, or t
  modified_base (354)..(354): a, c, t, g, unknown or other
  misc_feature (354)..(354): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacggtgaagccttcggagaccctgtccctcacctgcaatgctctggtgttacatcagtagttattagtggagttgctggcgcagtccgcgggaaggactggagtggagttgggcncatctataacgngtgcagctaccaaactaccaccccgcctacgaagagtcacgtccacntaaaacgtcacgtagaccgagtacccaaagacctagttcctaccctaggtaaaactttcgtaacctttcgtacggttacggaccccgtccgggaccgggtaacccgtacgggtacccgttaagttaaccgtttagtttacggtacggaccggtaaagtacgttacggttttaccccgtaattacccggtaaataaccgtagggttaacgggacgggggtaaaccggggggactaaaccggttcgggaccggttacccgggacccccggttagggggaccccgaaccgggggtaaacccggttaccgggtcccgtaacccgggtttccccgtaccccgtaccggacccgtaccccgtaacccgaacccgg

SEQ ID NO: 318274 - DNA, 745 bp, Homo sapiens
  misc_feature: GZ8MTXP02F2DFU.44.35.D02.1.454.CMB.2.raw
  modified_base (301)..(301): a, c, t, g, unknown or other
  misc_feature (301)..(301): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtggttacatcagttagttattattggagttggctgcggcaggtccgccgggaaggctgggagtggattgggcnatcatacagtggcagcaccaactaccaaccccgccctacaagacgtcgacgtccaccatcgtacactagaccgagggtaccaaagaaccctagttacctaccctagtaaaacttcgtacctttcgtacgttacgaacccggcccggaccgggaaaccgaaccgggtacccggttaaattaacgtttaaagtttcggttacggaccggtaaggtaacggttaactttacccgttaaacgttaccggtaaacttaaccgaaacgggttaagggaaacgggggtaacgggggggggaaccgtaaaacggttcggggaccgttacccgggacccccgggttacgggggaccccggtaaccgggggaacccccgttacggggtaacccgtaaccccggttcccgttaccccgtaccgtaaccggtaccccgtaccccgaaaccccgggg

SEQ ID NO: 318275 - DNA, 776 bp, Homo sapiens
  misc_feature: GZ8MTXP02JUZBQ.44.35.D02.1.454.CMB.2.raw
  modified_base (328)..(328): a, c, t, g, unknown or other
  misc_feature (328)..(328): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccagggacgggtgaagccttcggagaccctgtccctcacctgacatgtctcgtggtgttacatctagttagttattagttggagttggctggtcggcacggtccggacggggaaggcgtgggagtggagttggggcacgtatctaagtaacgnggtggacagacaacccaactacccgaaccccgtcctagaacggacgtcgacgtccacctatcgtacactagacgtacgtaccaaacggtacctagttccacccgtagtaaacgttcgtaacttcgtacggtaccgtacccggacccggtaccggtaaccggtaccgggttaccgttaacgtttaacgtttaggttagttacgggacgtaacggtaagttacgtttaaccctaagttaccgtaacgtaaccggtaaggtaacgggggaacgggggtaaccgggggggtactaaccggggtttaccgggaccgggtaaccccggtacccggggtaccgggggtacccggtaaacccggggtaaaccccggttcgggtaaccccgttaccccgggttaccgttacccccggttacgacccccggtacccgtacccggtaaaacccccgggg

SEQ ID NO: 318276 - DNA, 541 bp, Homo sapiens
  misc_feature: GZ8MTXP02ISSUY.44.35.D02.1.454.CMB.2.raw
  modified_base (188)..(188): a, c, t, g, unknown or other
  misc_feature (188)..(188): n is a, c, g, or t
  modified_base (308)..(308): a, c, t, g, unknown or other
  misc_feature (308)..(308): n is a, c, g, or t
  modified_base (317)..(317): a, c, t, g, unknown or other
  misc_feature (317)..(317): n is a, c, g, or t
  modified_base (410)..(410): a, c, t, g, unknown or other
  misc_feature (410)..(410): n is a, c, g, or t
  modified_base (413)..(413): a, c, t, g, unknown or other
  misc_feature (413)..(413): n is a, c, g, or t
  modified_base (417)..(417): a, c, t, g, unknown or other
  misc_feature (417)..(417): n is a, c, g, or t
  modified_base (428)..(428): a, c, t, g, unknown or other
  misc_feature (428)..(428): n is a, c, g, or t
tcagacagtatatacacgaccggtgctcgatttagcacacgatagttgggtttggggggtcacaagaggcagcgctctcgggacgtctccaccatggcctgggctctgctgctcctcactctcctcacccaggacacagggtcctgggcccagtctgccctgactcagcctgcctccgtgtctggtcncctggacagtcggtcaccatctcctgcactggagccagcggtaatattcttagtcttaactttgtctcctggtatcaacatcatccaagtaaacgcccccaaatcatcatcatgagctanaagagcctnagggttctaatcgacttccactcgctcaagtccgacacacggcctccctgacaatctctggctcagctgagacgaggctgattatattcgttnctnagtnttcgttcgacnctactctaatttagtcgttacgttacggtacgtacggaaccgtaacgtaccgtaccgtaccgtacggtacaccgaaccgaacgaaccctaaccctactacgtactaccttccg

SEQ ID NO: 318277 - DNA, 745 bp, Homo sapiens
  misc_feature: GZ8MTXP02HSRKI.44.35.D02.1.454.CMB.2.raw
  modified_base (304)..(304): a, c, t, g, unknown or other
  misc_feature (304)..(304): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccagggacgggtgaagccttcggagaccctgtccctcacctgcaatgtctctggtgttacatcagtagttattagtggtagttggctgcggcagtccggccggggaaggactgggagtggattggggcncagtctaatacagtgcagcaaccaactaccaacccccgcctacaaagacgtacggacgtaccacctatcgtacaaccgtagaccacgggtacaaacgtacccgtaagttccctacccgtagtaaactttacgtacctttcgttacgtcggaccccggacccggaccgggaaccggtaacccgggtacccggttatttaacgtttaagtttcggtacggtacggtaaggtacggttacttaccccgttagtaaccgtaacgttaaccgtaagggttaaaggggacgggggaaacgggggggggttaacaaaccgggttcgggtaccgtcccggtaaaccccggggttcggggaccccggacggggtaaccccgtacgggtaaccccgtacccggtaccggttccctaccgtacccggtacccgttacccgtaaaccccgggg

SEQ ID NO: 318278 - DNA, 733 bp, Homo sapiens
  misc_feature: GZ8MTXP02GNFJW.44.35.D02.1.454.CMB.2.raw
  modified_base (300)..(300): a, c, t, g, unknown or other
  misc_feature (300)..(300): n is a, c, g, or t
  modified_base (313)..(313): a, c, t, g, unknown or other
  misc_feature (313)..(313): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccagggacggtgaagccttcggagaccctgtccctcacctgcaatgtctctggtgttacatcagttagttattagtggtagttggctgcggcaggtccggcgggaaggctgggagtggatgggcncgatctaataacnggtggacagaccaaccaaaccgtaccaacccccggcctacaagacgtacgacgtaccacatcgtacacttaagctaggtaccaaagtaacccagttaccctacctaagtaaacgttcgtaacctttctacggtaccgaacccgtcccgaccgggaccctaccggggtacccgttaagttagtttaacgtttcggtaggtaccggtaagtaacgttaacgtttacccgtaaacttacgtaaacgttaaccgtaaaggttacggggaacgggggaccggggggtaaccgtaaaacgggttcccggacccggtacccggtaacccccgggttacgggggaccccgtaaacggggtaaccccggtcggtaacccgtaaccccgtcgtaccccgtaccaccggacccttaacccggaaaccccgg

SEQ ID NO: 318279 - DNA, 678 bp, Homo sapiens
  misc_feature: GZ8MTXP02IMSGA.44.35.D02.1.454.CMB.2.raw
  modified_base (240)..(240): a, c, t, g, unknown or other
  misc_feature (240)..(240): n is a, c, g, or t
  modified_base (263)..(263): a, c, t, g, unknown or other
  misc_feature (263)..(263): n is a, c, g, or t
tcagacagtatatacacgaccggtgctcgatttagcacacgatagttgggtttgggggcctgggcctcaggaagcagcatcggaggtgcctcagccatggcatggatccctctcttcctcggcgtccttgcttactgcacgagggtccgggcctcctctgacctgactcagccatcctcactgtcccgtgtccccaggacacacagtcactacttacctgctcgtagggaaacttgagtnataattgcttctgtatcagcagnggccaggccacgccccctatcgctggtcattctttacaggtataaagacgccggcccctgagggtctccccgtgacgcgtcttcctcgtcggcctaccaactcgtcgggaaccgccggccctactcctagaaaccctgtacccacgcccgacccgaccccgtaacggtccccttacggtaggacgtcggacgggtacctacggtaacttaacgtttacgtacggttacgacgggtaacggggttaggggtaaaacggtcgtaacgttaaggtttgggggttacggttccggggaacgggggtaacgggacccgtaacggtcggttccggtaaccgtttcgtccggtccgtaacgcccgtacggtccgtccccggtcccccgtcggttacccctcgtcccgttcccgtttcccccg

SEQ ID NO: 318280 - DNA, 752 bp, Homo sapiens
  misc_feature: GZ8MTXP02JTSI2.44.35.D02.1.454.CMB.2.raw
  modified_base (196)..(196): a, c, t, g, unknown or other
  misc_feature (196)..(196): n is a, c, g, or t
  modified_base (209)..(209): a, c, t, g, unknown or other
  misc_feature (209)..(209): n is a, c, g, or t
  modified_base (239)..(239): a, c, t, g, unknown or other
  misc_feature (239)..(239): n is a, c, g, or t
  modified_base (245)..(245): a, c, t, g, unknown or other
  misc_feature (245)..(245): n is a, c, g, or t
  modified_base (249)..(249): a, c, t, g, unknown or other
  misc_feature (249)..(249): n is a, c, g, or t
tcagacagtatatacacgaccggtgctcgatttagcacacgatagttgggtttgggggggtcacaagaggcagcgctctcgggacgtctccaccatggcctgggctctgctgctcctcactctcctgactcaggacacagggacctgggcccagtccgccctgactcagccagcctcgtgtctggtctcctggacngtcgctcaccctntcctgcactgaactatctgatgtagaaatntacctntctntgtacagtactaccacgtaaccccaactccttacttatgaagtacaataacggccggtaccccgtcgggtactaacttttcgtactaacttccgtactttctcgtacggccttaccgtaagttcgtacgggtaccaaaccgtccggtcccttcgtttaggtaactttaaacgttttccgtcggtaccccttcgtcgtcccgttagaacccggtacggtaacccgggtcccggtaaactttaagtttaacgttcggtaccttcggcttaccgtattaacggtcggtaacccggggttccttaaagtagttttacggttacggggttcggttccggggacggggtaaccgggggtaccgtccggttacgtacccgttacggttacggaccgacggtaccccgtaacggggtcccgtacccggtcccccgttacgggtaccctaacccggttccttaaccccggttcccccgttaaccccgttccgtaaccgtttactttaacccg

SEQ ID NO: 318281 - DNA, 611 bp, Homo sapiens
  misc_feature: GZ8MTXP02H09BB.44.35.D02.1.454.CMB.2.raw
  modified_base (295)..(295): a, c, t, g, unknown or other
  misc_feature (295)..(295): n is a, c, g, or t
  modified_base (390)..(390): a, c, t, g, unknown or other
  misc_feature (390)..(390): n is a, c, g, or t
  modified_base (474)..(474): a, c, t, g, unknown or other
  misc_feature (474)..(474): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtgttacatcagtagttatattggagttggctgcggcagtccgcgggaaggctggagtggattgggcncatctatacagtggcagcaccaactcaaacccccgcctacaagagtcgacgtcacccatcggtcaaccgtagccgaaggtacccaaagtaacccncgtttcaccccttagaaacttgaaccttcgtgtacgaccgtaccgccggacgaccggccgttactagttattgtgcgtagagtntacctatcgagttacagtaggaggtacgggggacgtaacgtgggaccgtacggaccccgtaggggcccgacggggaacccccgtggtcccgacccggttaccgtcccttccgaacccgtccgtaccccgaaccccgg

SEQ ID NO: 318282 - DNA, 655 bp, Homo sapiens
  misc_feature: GZ8MTXP02H8WK9.44.35.D02.1.454.CMB.2.raw
  modified_base (295)..(295): a, c, t, g, unknown or other
  misc_feature (295)..(295): n is a, c, g, or t
  modified_base (336)..(336): a, c, t, g, unknown or other
  misc_feature (336)..(336): n is a, c, g, or t
  modified_base (341)..(341): a, c, t, g, unknown or other
  misc_feature (341)..(341): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagcctgtccctcacctgcaatgtctctggtgttacatcagtagttatattggagttggctgcggcagtccgcgggaaggctgggagtggattggggcncatcctaatacagtggactgctacaactaccaacccgcctnaacgngtcacgtcaaccatcgtcaactagaccaggtccaaacgaaaccctagtttacccacccttaagaaaacgtttcgacctttacgtgttacgacccgtaccggacggactacgggaccgttatacttaagttcgttggacgtaagaggtacttacccgtatacgaacgttaacacggttaggacgggaacgggggggtacgaacggttacggccgttaacggaaacccccgttcgggggacccgtacgggggaacccgtacgggttcccgaacccggtcgttaccctaccgaccggacccttacccgaaaccccgg

SEQ ID NO: 318283 - DNA, 596 bp, Homo sapiens
  misc_feature: GZ8MTXP02GQOLS.44.35.D02.1.454.CMB.2.raw
  modified_base (271)..(271): a, c, t, g, unknown or other
  misc_feature (271)..(271): n is a, c, g, or t
  modified_base (301)..(301): a, c, t, g, unknown or other
  misc_feature (301)..(301): n is a, c, g, or t
  modified_base (393)..(393): a, c, t, g, unknown or other
  misc_feature (393)..(393): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccagggacgggtgaagccttcggagaccctgtccctcacctgcaatgtctcgtggtggttacatcagttagttattagttggagttggctagcggnagtccgcgggaggactggagtgagtgggcncatctaatacaggtgcagcaacaactccaaccccgcctacaagagtcgacgtcaccatgtacacttagccaggtaccaaagaccgtagttcncccttaagaaattcgtaccttctcgtacgaccgcccgaccggaacgaccggtaccgtaatacttactgtagcgagagtattacctagtcgatagagtaggacgggacgggggacacggtacggcgtaccggacccgacggggccgaacgggaccctacgggaaccgtacccgtccgtacctccgacgtcccgtaccgaacccg

SEQ ID NO: 318284 - DNA, 661 bp, Homo sapiens
  misc_feature: GZ8MTXP02FZJPB.44.35.D02.1.454.CMB.2.raw
  modified_base (291)..(291): a, c, t, g, unknown or other
  misc_feature (291)..(291): n is a, c, g, or t
  modified_base (310)..(310): a, c, t, g, unknown or other
  misc_feature (310)..(310): n is a, c, g, or t
tcagacagtatatacacgaccggtgctcgatttagcacacgatagttgggtttgggggcctgggcctcaggaagcagcatcggaggtgcctcagccatggcatggatccctctcttcctcggcgtccttgcttactgcacagggtccggggcctcctactgacctgactcagccatcctcactgtccgtgtccccaggacacacaatcaacttattacctgcttcgtaggggaaaacttgagtagaattaaattgcttctggtatcgagcagagccaggccacgcccctangctgtcatcttcagataanaagccgacctgaggactccctagacgtcgtcttccgtaccgtcggcctacctaacgtccgtacgggaccaccggccctacgttccacgaacccctagtcccaacgccgacccgaacccgaacgtccccgttagtaccggaacttagggaacggtcttacggtaactttaacgttacccgttggttaaccgacggtaacgggttaggggaaaagttcggtaacgttaaggtttggggttaacggttcgggaacgggacggggtaaccaggtaccgaggtacccgttacgccggtacgacgaccccgtaaggcccgtaccgcccccgtcggacctacctccgtccttaccccc

SEQ ID NO: 318285 - DNA, 621 bp, Homo sapiens
  misc_feature: GZ8MTXP02ITRSK.44.35.D02.1.454.CMB.2.raw
  modified_base (258)..(258): a, c, t, g, unknown or other
  misc_feature (258)..(258): n is a, c, g, or t
  modified_base (263)..(263): a, c, t, g, unknown or other
  misc_feature (263)..(263): n is a, c, g, or t
  modified_base (292)..(292): a, c, t, g, unknown or other
  misc_feature (292)..(292): n is a, c, g, or t
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtgttacatcagtattattattggagttggntgcgnagtcgcggaaggactggagtggattgggngcgatctataacagtggcagcaaccaactaccaaccccgcctacaagagtcgacgtcaaccatcgtcaactacgacaggtaccaaacggaacctacgttacaccccttgaaaactttgaacttctgtcgaccgtaccgacggacaaccggccgttatacgttaattggtagcggaagacgtaacgtttccctaagtacgatacgaaggtaggaagggtacggggggactaacgtcggaccgtccgaaacccggtcggggacccggtaccggggaaccctgggtaaccgaccggtacttcccgtacgacgttcccgaaccgtaaccccgg

SEQ ID NO: 318286 - DNA, 788 bp, Homo sapiens
  misc_feature: GZ8MTXP02HEDJC.44.35.D02.1.454.CMB.2.raw
tcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaacgccttcggagaccctgtccctcacctgcaatgtctctggtgttaacatcagtattactattggagttgctgcggcagtccgcgggaaggactggagtggattgggcgacatctaataaacgagtcgggcaaggaccaaaccgaaaacttaaccgaaaccccccgcccgtacaaaggacgtaccgaagtacccaactagttcgtactaaacgttaacgacaaacgggttacccaaaaacggtaacccgtaacgttttccctaccccgtaagtaaaatttacggtaacctttaccgtcggttacggaaccccggcccggtaccgggtaaccgaacccgggtacccggttaaattaaacttagtttaggttagtacggaacgtaaggtacgttacccttaacgtacgtaaacgtaacgtaacggtaaacgggaaggggtaaaccggggggggaacgtaaaaccggtttacgggaccgtttacccggaacccccggttaacggggacccggtaaccgggggtaaaccccgttacgggtaacccgtaacccgggttacctaccccggttaccaaccggtaccccgtaccggtaaaacccccgg

SEQ ID NO: 318287 - DNA, 514 bp, Homo sapiens
  misc_feature: GZ8MTXP01BPH2M.10.20.B09.1.454.CMB.2.raw
  modified_base (292)..(292): a, c, t, g, unknown or other
  misc_feature (292)..(292): n is a, c, g, or t
  modified_base (352)..(352): a, c, t, g, unknown or other
  misc_feature (352)..(352): n is a, c, g, or t
  modified_base (500)..(500): a, c, t, g, unknown or other
  misc_feature (500)..(500): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccgtcagaatattgctaccaacttagcctggtatcaacaaagcctggccaggctcccagactcctcatctctggtncatcttcgagggccacgtggtgtcccagtcaggttcagtcggcagtggtctggaaacagngttcactctcaccatcagcgcctgcagtctgaagtattttgctagtttattactgtcaggctagtataatgtacttgggtttatcactttcggccctgggacctaaaggtcggttatttcgagtacgtaacttggttcggctgcaacntcttgtctttcaac

SEQ ID NO: 318288 - DNA, 506 bp, Homo sapiens
  misc_feature: GZ8MTXP01BU4JV.10.20.B09.1.454.CMB.2.raw
  modified_base (221)..(221): a, c, t, g, unknown or other
  misc_feature (221)..(221): n is a, c, g, or t
  modified_base (350)..(350): a, c, t, g, unknown or other
  misc_feature (350)..(350): n is a, c, g, or t
  modified_base (374)..(374): a, c, t, g, unknown or other
  misc_feature (374)..(374): n is a, c, g, or t
  modified_base (490)..(490): a, c, t, g, unknown or other
  misc_feature (490)..(490): n is a, c, g, or t
  modified_base (501)..(501): a, c, t, g, unknown or other
  misc_feature (501)..(501): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccgtnagaatatgctaccaattagcctggtatcaacaaagcctggccaggctcccagactcctcatctctggtgcatctcgagggccagtggtcgtcccagccaggttcagtcggcagtgggtctggaaacagngttcactctcacatcagcgctacngtctgaagtattttgctagtttattactgtacagcaagttataatgtacttgggtttatctactttcggccctagggacctaaggtgtatttcagacgtaacgtgttgcttgcacntctgttcttcnttccc

SEQ ID NO: 318289 - DNA, 556 bp, Homo sapiens
  misc_feature: GZ8MTXP01AVF8C.10.20.B09.1.454.CMB.2.raw
  modified_base (194)..(194): a, c, t, g, unknown or other
  misc_feature (194)..(194): n is a, c, g, or t
  modified_base (221)..(221): a, c, t, g, unknown or other
  misc_feature (221)..(221): n is a, c, g, or t
  modified_base (353)..(353): a, c, t, g, unknown or other
  misc_feature (353)..(353): n is a, c, g, or t
  modified_base (391)..(391): a, c, t, g, unknown or other
  misc_feature (391)..(391): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccagggganagagccaccctctcctgcagggccgtnagaatattgctaccaattagcctggtatcaacaaaagcctggccaggctcccagactcctcatctctggtgctatcttcggagggccactggtgtcccagccaggttcaggtcgcagtggtctggaaacagngttcactctcacatcagcgcctgcagtctagaagtttntttgcttagtttatacgtgtacaggtactaagttaataagttgtacgtttgggttttacttacgtcgtttccggccgtagggaactaaagtggttatttacgaacggtaacgtaacgttggttcggttctggacctaacgtacttcgttacgttccttcgtaacc

SEQ ID NO: 318290 - DNA, 545 bp, Homo sapiens
  misc_feature: GZ8MTXP01DP1J7.10.20.B09.1.454.CMB.2.raw
tcagcatagtagtgcacgaccggtgctcgatttagtgtagtgtgaagggggaactgctcagttaggacccagacggaaccatggaagccccagcgcagcttctcttcctcctgctactctggctcccagacaacactgcagaaatagttatgacgcagtctccagccaccctgtctgtgtctccaggggagagagcccaccctctcctgcagggccgtcagaatattgctaccaattagcctggtatacaacaaaagcctggccaggctcccagactcctcatctctggtgcatcttcgagggccatggtcgtcccagccaggttcagtggccaggtgggtctggaacagagttcactctcacatcagcgctgcagtctgaagtattttgctagtttattactgtacagctaagttataaatgtacttgggttttaattctaacgttttccggcccttaggggaacctaaaggtggtatttcgaagttacgtaacgtggttaggccttgcctaccgtaattctggttcctttcgaactttccccg

SEQ ID NO: 318291 - DNA, 585 bp, Homo sapiens
  misc_feature: GZ8MTXP01ED78J.10.20.B09.1.454.CMB.2.raw
  modified_base (194)..(194): a, c, t, g, unknown or other
  misc_feature (194)..(194): n is a, c, g, or t
  modified_base (223)..(223): a, c, t, g, unknown or other
  misc_feature (223)..(223): n is a, c, g, or t
  modified_base (228)..(228): a, c, t, g, unknown or other
  misc_feature (228)..(228): n is a, c, g, or t
  modified_base (230)..(230): a, c, t, g, unknown or other
  misc_feature (230)..(230): n is a, c, g, or t
  modified_base (243)..(243): a, c, t, g, unknown or other
  misc_feature (243)..(243): n is a, c, g, or t
  modified_base (253)..(253): a, c, t, g, unknown or other
  misc_feature (253)..(253): n is a, c, g, or t
  modified_base (259)..(259): a, c, t, g, unknown or other
  misc_feature (259)..(259): n is a, c, g, or t
  modified_base (263)..(263): a, c, t, g, unknown or other
  misc_feature (263)..(263): n is a, c, g, or t
  modified_base (268)..(269): a, c, t, g, unknown or other
  misc_feature (268)..(269): n is a, c, g, or t
  modified_base (273)..(273): a, c, t, g, unknown or other
  misc_feature (273)..(273): n is a, c, g, or t
  modified_base (277)..(277): a, c, t, g, unknown or other
  misc_feature (277)..(277): n is a, c, g, or t
  modified_base (390)..(390): a, c, t, g, unknown or other
  misc_feature (390)..(390): n is a, c, g, or t
  modified_base (564)..(564): a, c, t, g, unknown or other
  misc_feature (564)..(564): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccagggganagacgccaccctctcctgcagggccgtanagatntnctacatgctgtanacaacaagcngcagcnccanactcnntctntgtnctatcgtcgacggccacgtggtctccagccgtaggttcaggtcggcgtaggtggtctaggaaacagtcgttcactctacacctatcgacgccgctgctagtcgtagtaagttnttttacgacttaagtttacttacgttgtactaggtacttaagttaattaagttacgttacgttttgggttttacttaccgttaccggttttcccgggacccgttacgggtaaccgtaaaggttcggttactttacgaacgtaacgtaacgttggttcgttcgtcgactaacctnttcgttcgttccttcgtaacg

SEQ ID NO: 318292 - DNA, 490 bp, Homo sapiens
  misc_feature: GZ8MTXP01DKU61.10.20.B09.1.454.CMB.2.raw
  modified_base (292)..(292): a, c, t, g, unknown or other
  misc_feature (292)..(292): n is a, c, g, or t
  modified_base (346)..(346): a, c, t, g, unknown or other
  misc_feature (346)..(346): n is a, c, g, or t
  modified_base (348)..(348): a, c, t, g, unknown or other
  misc_feature (348)..(348): n is a, c, g, or t
  modified_base (476)..(476): a, c, t, g, unknown or other
  misc_feature (476)..(476): n is a, c, g, or t
tcagcatagtagtgcacgaccggtgctcgatttagtgtagtgtgaaggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccgtcagaatattgctaccaacttagcctggtatcaacaaaagcctggccaggctcccagactcctcatctctggtncatcttcgagggccactggtgtccagccaggttcagtgcagtggtctggaaacngngttcactctcaccatcagcgctgcagtctgaagtattttgctagttatactgtcaggcagtataatgactggtttatctcttcgcctgggacctaaagtgattcagtcgaacttgttgctgctaaccntcttgtcttctaac

SEQ ID NO: 318293 - DNA, 554 bp, Homo sapiens
  misc_feature: GZ8MTXP01AVS7L.10.20.B09.1.454.CMB.2.raw
  modified_base (216)..(216): a, c, t, g, unknown or other
  misc_feature (216)..(216): n is a, c, g, or t
  modified_base (307)..(307): a, c, t, g, unknown or other
  misc_feature (307)..(307): n is a, c, g, or t
tcagcatagtagtgcacgaccggtgctcgatttagtgtagtgtgaaggggaactgctcagttaggacccagacggaaccatggaagcccagcgcagcttctcttcctcctgctactctggctcccagacaacactgcagaaatagttatgacgcagtctccagccaccctgtctgtgtctccaggggagagagccaccctctcctgcagggccgtnagaatattgctaccaattagcctggtatcaacaaagcctggccaggctcccagactcctcatctctggtgcatcttcgagggccactggtntcccagccaggttcagtgccaggtggtctggaacaagagttcactctcaccatcagcggcctgcagtctgaagtattttgctagtttattactgtcagctagtattaatgtacgttgggttttaattccgtacgttttccgggtcccgttaggggtaaccctaaaggttggtaacttttccgaagttaaccgaaacttggttcgggttcttcggctacccaattcgtggttcctttcaacgtttccc

SEQ ID NO: 318294 - DNA, 507 bp, Homo sapiens
  misc_feature: GZ8MTXP01C2FJ9.10.20.B09.1.454.CMB.2.raw
  modified_base (349)..(349): a, c, t, g, unknown or other
  misc_feature (349)..(349): n is a, c, g, or t
  modified_base (351)..(351): a, c, t, g, unknown or other
  misc_feature (351)..(351): n is a, c, g, or t
  modified_base (491)..(491): a, c, t, g, unknown or other
  misc_feature (491)..(491): n is a, c, g, or t
tcagcatagtagtgcacgaccggtgctcgatttagtgtagtgtgaaggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccgtcagaatattgctaccaacttagcctggtatcaacaaagcctggccaggctcccagactcctcatctctggtgcatcttcgagggccactggtcgtcccagccaggttcagtcggcagtggtctggaaacngngttcactctcaccatcagcgctgcagtctagaagtattttgctagtttatactgtcaggtcagttataagtgtacgttgggttttatctacgtttcggcctgggacctaaaggtggatttcagtacgacttgttgctgcncatcttgtcttctaac

SEQ ID NO: 318295 - DNA, 557 bp, Homo sapiens
  misc_feature: GZ8MTXP01AO40A.10.20.B09.1.454.CMB.2.raw
  modified_base (354)..(354): a, c, t, g, unknown or other
  misc_feature (354)..(354): n is a, c, g, or t
  modified_base (395)..(395): a, c, t, g, unknown or other
  misc_feature (395)..(395): n is a, c, g, or t
  modified_base (538)..(538): a, c, t, g, unknown or other
  misc_feature (538)..(538): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgaggggagagacgccaccctctcctgcagggccgtcagaatattgctaccaacttagcctggtatcaacaaagcctggccaggctcccagactcctcatctctggtgctatcttcgagggccacgtggtcgtccagccaggttcagtcggcaggtggtctggaaacngtgttcactctcacatcagcggcctgctagtctagaaagtnttttgcttagtttatactgtacaggctaagttataagttgtacgttggttttactcgtacgtttccggaccttggggaacctaaaggttcggttattttccgaaggtacgtaacgttggttcggacttcggacctaaccgttnttcgttacgttccttcgtc

SEQ ID NO: 318296 - DNA, 555 bp, Homo sapiens
  misc_feature: GZ8MTXP01A6QL2.10.20.B09.1.454.CMB.2.raw
  modified_base (192)..(192): a, c, t, g, unknown or other
  misc_feature (192)..(192): n is a, c, g, or t
  modified_base (220)..(220): a, c, t, g, unknown or other
  misc_feature (220)..(220): n is a, c, g, or t
  modified_base (244)..(244): a, c, t, g, unknown or other
  misc_feature (244)..(244): n is a, c, g, or t
  modified_base (285)..(285): a, c, t, g, unknown or other
  misc_feature (285)..(285): n is a, c, g, or t
tcagcatagtagtgcacgaccggtgctcgatttagtgtagtgtgaaggggggaactgctcagttaggacccagacggaaccatggaagccccagcgcagcttctcttcctcctgctactctggctcccagacaacactgcagaaatagttatgacgcagtctccagccaccctgtctgtgtctccagggganagagcccaccctctcctgcagggccgtnagatatgctacaattgcctggtancaacaaagctggccaggctcccagactcctcatctctggtncatcttcgagggcctacgtggtcgtccccagccaggttcaggtggccgaggtgggtctggaacaggacgttcactctcaccatcagccggcctgcagtctagaagttacttttgactagtttatactgtcagctagtataatgtaacttggtttattcgtacgtttcggcctagggaacctaaaggttggtaatttcaaggttaccgtaaacgtggttacggcttacggcctaacccgttcttcgttcgttaccttaaccgttcttcccg

SEQ ID NO: 318297 - DNA, 527 bp, Homo sapiens
  misc_feature: GZ8MTXP01AIU9N.10.20.B09.1.454.CMB.2.raw
  modified_base (218)..(218): a, c, t, g, unknown or other
  misc_feature (218)..(218): n is a, c, g, or t
  modified_base (310)..(310): a, c, t, g, unknown or other
  misc_feature (310)..(310): n is a, c, g, or t
  modified_base (509)..(509): a, c, t, g, unknown or other
  misc_feature (509)..(509): n is a, c, g, or t
tcagcatagtagtgcacgaccggtgctcgatttagtgtagtgtgaagggggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccgtnagaatattgctaccaacttagcctggtatcaaacaaagcctggccaggctcccagactcctcatctctggtgcatcttcgagggccatggtntcccagccaggttcagtggccaggtgggtctaggaacaagagttcactctcaccatcagtcggcctgcagtctagagtatttgctagtttattactgtcagctagtatatgtacttggttttactcgtacgtttcggccctaggggtaacctaaaggtgtatttcgacggacgtaaacgtggttggcttgcctaacctnttctcgttcttcgcgtcc

SEQ ID NO: 318298 - DNA, 542 bp, Homo sapiens
  misc_feature: GZ8MTXP01D2NF2.10.20.B09.1.454.CMB.2.raw
  modified_base (191)..(191): a, c, t, g, unknown or other
  misc_feature (191)..(191): n is a, c, g, or t
  modified_base (288)..(288): a, c, t, g, unknown or other
  misc_feature (288)..(288): n is a, c, g, or t
tcagcatagtagtgcacgaccggtgctcgatttagtgtagtgtgaagggggaactgctcagttaggacccagacggaaccatggaagccccagcgcagcttctcttcctcctgctactctggctcccagacaacactgcagaaatagttatgacgcagtctccagccaccctgtctgtgtctccagggganagagccaccctctcctgcagggccgtcagaatatgctaccaattagcctggtatacaacaaagcctggccaggctcccagactcctcatctctggtncatcttcgaggccacgtggtctcccagccaggttcaggtggccaggtgggtctggaacaagagttcactctcacatcagcgctgctagtctagaagtattttgactagtttatactgtacagtctaagttattaagtgtaacgtttgggttttaacttctacgttttccggcccttagggaacctaaaggtcgtatttcgaagttacgaacttgttcggcttaggcactaattctattccttcgaagtttcccc

SEQ ID NO: 318299 - DNA, 597 bp, Homo sapiens
  misc_feature: GZ8MTXP01AXQZO.10.20.B09.1.454.CMB.2.raw
  modified_base (195)..(195): a, c, t, g, unknown or other
  misc_feature (195)..(195): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcaagaaatagttatgacgcagtctccagccacctgtctgtgtctccgagggganagacgcccaccctctcctgcaggggccgtcagaatattgctaaccaacttagcctggtatacaacaaagctggccaggctacccagactcctcatctcgtggtgctatcgtcgacgggccacgtgggtcgtcccagccgtaggttcaggtcggcaggtgggtctaggaaacaggtcgttcacttctacgaccatcgacgccggtcctgctagtctaggtaaacttgttttgacttagtttattactgtacaggtactaagttaataagttgtacgtttgggttttaacttccgttaccgtttccggacccgttagggaaacctaaaggttgttaacgtttacgaaggtaacggtaacttggttcggctcgactaaccctattcgttcttccgttcgtaaccg

SEQ ID NO: 318300 - DNA, 605 bp, Homo sapiens
  misc_feature: GZ8MTXP01D4M92.10.20.B09.1.454.CMB.2.raw
  modified_base (155)..(155): a, c, t, g, unknown or other
  misc_feature (155)..(155): n is a, c, g, or t
  modified_base (195)..(195): a, c, t, g, unknown or other
  misc_feature (195)..(195): n is a, c, g, or t
  modified_base (226)..(226): a, c, t, g, unknown or other
  misc_feature (226)..(226): n is a, c, g, or t
  modified_base (234)..(234): a, c, t, g, unknown or other
  misc_feature (234)..(234): n is a, c, g, or t
  modified_base (256)..(256): a, c, t, g, unknown or other
  misc_feature (256)..(256): n is a, c, g, or t
  modified_base (266)..(266): a, c, t, g, unknown or other
  misc_feature (266)..(266): n is a, c, g, or t
  modified_base (272)..(272): a, c, t, g, unknown or other
  misc_feature (272)..(272): n is a, c, g, or t
  modified_base (275)..(275): a, c, t, g, unknown or other
  misc_feature (275)..(275): n is a, c, g, or t
  modified_base (279)..(280): a, c, t, g, unknown or other
  misc_feature (279)..(280): n is a, c, g, or t
  modified_base (288)..(288): a, c, t, g, unknown or other
  misc_feature (288)..(288): n is a, c, g, or t
  modified_base (588)..(588): a, c, t, g, unknown or other
  misc_feature (588)..(588): n is a, c, g, or t
tcagcatagtagtgcacgaccggtgctcgatttagtgtagtgtgaggggggaggaactgctcagttaggacccagacggaaccatggaagccccagcgcagcttctcttcctcctgctactctggctcccagacaacactgcaagaaatagttangacgcagtctccagccacctgtctgtgtctccgagggganagacgccaccctctcctgcgaggggccgtanaagtaatntcgactaactaattgctagtanacaacaagcngcagcncanctcnntctgtgtnctactcgtcggacggcctacgtcggtcgtccgagccgtaggttcgaggtcggacgtagggtcggtactaggaaaactacgtcgttccacttccaccacctacgtcgacggccgctgacgtagtcgtaagtaaagtttgtttacgactttaagtttacttacgtacgtacgaggtattaagttaattaagttacggttacgttttaggttttacttaccgttacgttccggaccggttaacgggtaaacgtaaggttcgttacttacgaacgtaacgtagttggttcgactgacctaactnttcgttcttcctttcgc

SEQ ID NO: 318301 - DNA, 526 bp, Homo sapiens
  misc_feature: GZ8MTXP01E3FO3.10.20.B09.1.454.CMB.2.raw
  modified_base (192)..(192): a, c, t, g, unknown or other
  misc_feature (192)..(192): n is a, c, g, or t
tcagcatagtagtgcacgaccggtgctcgatttagtgtagtgtgaaggggggaactgctcagttaggacccagacggaaccatggaagccccagcgcagcttctcttcctcctgctactctggctcccagacaacactgcagaaatagttatgacgcagtctccagccaccctgtctgtgtctccagggganagagccaccctctcctgcagggccgtcagaatattgctacaattagcctggtatcaacaaaagcctggccaggctcccagactcctcatctctggtgcatcttcgagggccacgtggtcgtcccagccaggttcagtggcagtggtctggaacaagagttcactctcacatcgagcggcctgcagtctagaagtatttgctagtttatactgtacagctaagtatatgtacttggtttatcgtactttcggcccttgggacctaaaggtggtatttcgaagacgtaaacgtggttaggcttgcctacctaattctgttccttcgaagtttcccc

SEQ ID NO: 318302 - DNA, 568 bp, Homo sapiens
  misc_feature: GZ8MTXP01D9HML.10.20.B09.1.454.CMB.2.raw
  modified_base (194)..(194): a, c, t, g, unknown or other
  misc_feature (194)..(194): n is a, c, g, or t
  modified_base (224)..(224): a, c, t, g, unknown or other
  misc_feature (224)..(224): n is a, c, g, or t
  modified_base (309)..(309): a, c, t, g, unknown or other
  misc_feature (309)..(309): n is a, c, g, or t
  modified_base (556)..(556): a, c, t, g, unknown or other
  misc_feature (556)..(556): n is a, c, g, or t
  modified_base (566)..(566): a, c, t, g, unknown or other
  misc_feature (566)..(566): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccacctgtctgtgtctccgagggganagacgccaccctctcctgcgaggggccgtnaagtaattattgactaacctaacttagcctaggtaactacaaacaaagcctggccaggctacccagacctcctcatctcgtggtnctattcgttcggacgggcctacgttgggtcgtccccgagtcccgtaggttcaggtcggcgtaggtgggtctaggaaacctaggtcgttccaactcctaccaaccatcgacgccgctgactagtctagtaagttatttgacttaagtttactatgtacaggtactaagttataagtgtaacgttggtttactcgtacgttcgaccgtaggaactaaagtcgattcagtacagttgttgctgctaactntcttctcttntc

SEQ ID NO: 318303 - DNA, 552 bp, Homo sapiens
  misc_feature: GZ8MTXP01C9076.10.20.B09.1.454.CMB.2.raw
  modified_base (193)..(193): a, c, t, g, unknown or other
  misc_feature (193)..(193): n is a, c, g, or t
  modified_base (219)..(219): a, c, t, g, unknown or other
  misc_feature (219)..(219): n is a, c, g, or t
  modified_base (351)..(351): a, c, t, g, unknown or other
  misc_feature (351)..(351): n is a, c, g, or t
  modified_base (387)..(387): a, c, t, g, unknown or other
  misc_feature (387)..(387): n is a, c, g, or t
tcagcatagtagtgcacgaccggtgctcgatttagtgtagtgtgaaggggaggaactgctcagttaggacccagacggaaccatggaagccccagcgcagcttctcttcctcctgctactctggctcccagacaacactgcagaaatagttatgacgcagtctccagccaccctgtctgtgtctccagggganagagccacctctcctgcagggccgtnagaatattgctaccaattagcctggtatcaacaaaagcctggccaggctcccagactcctcatctctggtgcatcttcgagggccacgtggtgtcccagccaggttcagtcggcagtgggtctggaaacagngttcactctcaccatcagcgcctgcagtctgaagtnttttgctagtttatactgtcaggtctagttataaagtgtaacgttgggttttaattcgtacgttttccggacccttaggggaaccctaaaaggttcgggttaacttttcgaaggtaacgtaacttggttcggccttgctaaccctatccgttcgtctttcgtaac

SEQ ID NO: 318304 - DNA, 555 bp, Homo sapiens
  misc_feature: GZ8MTXP01DNYW7.10.20.B09.1.454.CMB.2.raw
  modified_base (194)..(194): a, c, t, g, unknown or other
  misc_feature (194)..(194): n is a, c, g, or t
  modified_base (222)..(222): a, c, t, g, unknown or other
  misc_feature (222)..(222): n is a, c, g, or t
  modified_base (391)..(391): a, c, t, g, unknown or other
  misc_feature (391)..(391): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccagggganagacgccaccctctcctgcagggccgtnagaatattgctacaattgcctggtatcaacaaagcctggccaggctcccagactcctcatctctggtgcatcttcggacgggcctacgtggtcgtcccagccaggttcagtcggcagtgggtctaggaaacagtgttcactctacacatcagcgctgcagtctagaatnttttgctaagtttatactgtacagggactaggtaataagtgtacgttgggttttactcgtacgttccggtcccgtaggggaaccctaaaaggttcggttatttacgaagtaaccgtaattggttgggcccttgcctaacctgtcttacgttcctttccgtaacc

SEQ ID NO: 318305 - DNA, 565 bp, Homo sapiens
  misc_feature: GZ8MTXP01BGZ7M.10.20.B09.1.454.CMB.2.raw
  modified_base (195)..(195): a, c, t, g, unknown or other
  misc_feature (195)..(195): n is a, c, g, or t
  modified_base (223)..(223): a, c, t, g, unknown or other
  misc_feature (223)..(223): n is a, c, g, or t
  modified_base (294)..(294): a, c, t, g, unknown or other
  misc_feature (294)..(294): n is a, c, g, or t
  modified_base (550)..(550): a, c, t, g, unknown or other
  misc_feature (550)..(550): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgagggganagacgccaccctctcctgcagggccgtnagaatattgctaccaacttgcctggtatcaaacaaagcctggccaggctcccagactcctcatctctggtnctatcttcggagggccctactgggtcgtccccagcctagggttcaggtcggctaggtgggtctagggaaacagcgtttcactctcaccatcgacgcggcctggcagtctagaacgtattttgacttagtttactactgtacagggtctaagttataagtgtaacgtttggttttattccgtacgtttccggcccttagggacctaaaggtcgttatttcaagtacgtaacgttgttcggcttcggacctaaccttntcgttcttcttcgtc

SEQ ID NO: 318306 - DNA, 511 bp, Homo sapiens
  misc_feature: GZ8MTXP01EOPI6.10.20.B09.1.454.CMB.2.raw
  modified_base (195)..(195): a, c, t, g, unknown or other
  misc_feature (195)..(195): n is a, c, g, or t
  modified_base (222)..(222): a, c, t, g, unknown or other
  misc_feature (222)..(222): n is a, c, g, or t
  modified_base (314)..(314): a, c, t, g, unknown or other
  misc_feature (314)..(314): n is a, c, g, or t
  modified_base (350)..(350): a, c, t, g, unknown or other
  misc_feature (350)..(350): n is a, c, g, or t
  modified_base (380)..(380): a, c, t, g, unknown or other
  misc_feature (380)..(380): n is a, c, g, or t
  modified_base (387)..(387): a, c, t, g, unknown or other
  misc_feature (387)..(387): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgagggganagagccaccctctcctgcagggccgtnagaatattgctacaacttagcctggtatcaacaaagcctggccaggctcccagactcctcatctctggtgcatcttcgagggccacgtggtntcccagccaggttcagtcggcagtggtctggaaacngtgttcactctcacatcagcgctgcagtcngtaagtnttttgcttagtttatactgtcaggctaagttatatgtacttgggtttatctacttcggcctgggaacctaaagtggttatttcgagacgtacttgttggctgctctagtcttagttccttcgtc

SEQ ID NO: 318307 - DNA, 508 bp, Homo sapiens
  misc_feature: GZ8MTXP01A3IMK.10.20.B09.1.454.CMB.2.raw
  modified_base (193)..(193): a, c, t, g, unknown or other
  misc_feature (193)..(193): n is a, c, g, or t
  modified_base (291)..(291): a, c, t, g, unknown or other
  misc_feature (291)..(291): n is a, c, g, or t
  modified_base (353)..(353): a, c, t, g, unknown or other
  misc_feature (353)..(353): n is a, c, g, or t
  modified_base (383)..(383): a, c, t, g, unknown or other
  misc_feature (383)..(383): n is a, c, g, or t
tcagcatagtagtgcacgaccggtgctcgatttagtgtagtgtgaaggggaggaactgctcagttaggacccagacggaaccatggaagccccagcgcagcttctcttcctcctgctactctggctcccagacaacactgcagaaatagttatgacgcagtctccagccaccctgtctgtgtctccagggganagagccaccctctcctgcagggccgtcagaatattgctaccaacttagcctggtatcaacaaagcctggccaggctcccagactcctcatctctggtncatcttcgagggccactgggtcgtcccagccaggttcagtcggcagtgggtctggaaacagngttcactctcaccatcagcgcctgcagtcngaagattttgctagtttatactgtcaggcagtataatgacttgggtttattcgactttcggcctgggaccaaagtggttatttcagtacgtaacttgttggctgcaaccatcttgtcttcgtaac

SEQ ID NO: 318308 - DNA, 589 bp, Homo sapiens
  misc_feature: GZ8MTXP01AQA80.10.20.B09.1.454.CMB.2.raw
  modified_base (198)..(198): a, c, t, g, unknown or other
  misc_feature (198)..(198): n is a, c, g, or t
  modified_base (372)..(372): a, c, t, g, unknown or other
  misc_feature (372)..(372): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcaagaaatagttatgacgcagtcctccagcccaccctgtctgtgtctccgagggganagacgcccaccctctcctgcgagggccgtcagaatattgactaaccaattagcctaggtaatacaaacaaaacgcctcggccaggcctacccagacctcctcatctctggtcgctatctcggaggccagtggtcgccagccgtaggtcaggtcggcaggtggtctaggaaaacngtaagttcactcctcaccatcgagccggtctgctagtctaggaacgttattttcgactttagtttattacgtgttaccagggtactaagttaataagttcgtaacgttggttttactcgtacggtttccgaccgttaggaacctaaaggttcggttactttacgagtaaccgtaagttggcgttacgtcgctaacctatcgttcttcgttctaaccg

SEQ ID NO: 318309 - DNA, 510 bp, Homo sapiens
  misc_feature: GZ8MTXP01DAZP3.10.20.B09.1.454.CMB.2.raw
  modified_base (193)..(193): a, c, t, g, unknown or other
  misc_feature (193)..(193): n is a, c, g, or t
  modified_base (220)..(220): a, c, t, g, unknown or other
  misc_feature (220)..(220): n is a, c, g, or t
  modified_base (291)..(291): a, c, t, g, unknown or other
  misc_feature (291)..(291): n is a, c, g, or t
  modified_base (388)..(388): a, c, t, g, unknown or other
  misc_feature (388)..(388): n is a, c, g, or t
tcagcatagtagtgcacgaccggtgctcgatttagtgtagtgtgaaggggaggaactgctcagttaggacccagacggaaccatggaagccccagcgcagcttctcttcctcctgctactctggctcccagacaacactgcagaaatagttatgacgcagtctccagccaccctgtctgtgtctccagggganagagccaccctctcctgcagggccgtnagaatattgctaccaacttagcctggtatcaacaaagcctggccaggctcccagactcctcatctctggtncatcttcgagggccacgtggtcgtcccagccaggttcagtcggcagtgggtctggaaacagtgttcactctcaccatcagcgctgcagtctgaagtnttttgctagtttatactgtcaggctagtataatgtacttggtttattctacgtttcggccctgggaacctaaagttcggatttcgagtacgtaacttgttgctgcaacatcttgtccttctc

SEQ ID NO: 318310 - DNA, 595 bp, Homo sapiens
  misc_feature: GZ8MTXP01EOG4Z.10.20.B09.1.454.CMB.2.raw
  modified_base (195)..(195): a, c, t, g, unknown or other
  misc_feature (195)..(195): n is a, c, g, or t
  modified_base (229)..(229): a, c, t, g, unknown or other
  misc_feature (229)..(229): n is a, c, g, or t
  modified_base (449)..(449): a, c, t, g, unknown or other
  misc_feature (449)..(449): n is a, c, g, or t
  modified_base (577)..(577): a, c, t, g, unknown or other
  misc_feature (577)..(577): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcaagaaatagttatgacgcagtctccagccacctgtctgtgtctccgagggganagacgcccaccctctcctgcgacggggcccggtnaagtaattattgaccttaaccaactttagccttagggtaatacaaacaaaacgcctcggccaggcctcccagacctcctcatctcgtggtcgctattcgttcggacgggtccctacgtcgggtcgtccccagccgtaggttcgaggtcggcgtagggtcgggtctaggaaaactagtgttcactctcactatcacggcgtcctgctagtctaggtaagtnttttgacttagtttattactgtcagggtctaagttataagttgtacgtttggttttactcgtacgttccggtccgtagggaacctaaaggttcgttattacgagtacgtaacttggttgctgctaacnttcttagttccttctccg

SEQ ID NO: 318311 - DNA, 544 bp, Homo sapiens
  misc_feature: GZ8MTXP01ESZDV.10.20.B09.1.454.CMB.2.raw
  modified_base (194)..(194): a, c, t, g, unknown or other
  misc_feature (194)..(194): n is a, c, g, or t
  modified_base (221)..(221): a, c, t, g, unknown or other
  misc_feature (221)..(221): n is a, c, g, or t
  modified_base (280)..(280): a, c, t, g, unknown or other
  misc_feature (280)..(280): n is a, c, g, or t
  modified_base (285)..(285): a, c, t, g, unknown or other
  misc_feature (285)..(285): n is a, c, g, or t
  modified_base (343)..(343): a, c, t, g, unknown or other
  misc_feature (343)..(343): n is a, c, g, or t
  modified_base (352)..(352): a, c, t, g, unknown or other
  misc_feature (352)..(352): n is a, c, g, or t
tcagcatagtagtgcacgaccggtgctcgatttagtgtagtgtgaaggggggaactgctcagttaggacccagacggaaccatggaagccccagcgcagcttctcttcctcctgctactctggctcccagacaacactgcagaaatagttatgacgcagtctccagccaccctgtctgtgtctccgaggggganagagcccacctctcctgcagggccgtnagaatatgctacaattgcctggtatacaacaaagctgccaggctccagactctcatctntggtncatcgttcgagggccactggtcgtcccagcctaggttcagtgccaggtggctgacagngttcactcncacatcagcgctgcagtcagaagttatttgctagtttatactgtacagtctaagttataagttgtacttgggttttaactcgttacgtttcggcccgttagggtaaccaaaggttggtatttcggaagttacgtaacttggttacggttcttaggtctaccgtaattctgttaccttcttaacgtttccccg

SEQ ID NO: 318312 - DNA, 601 bp, Homo sapiens
  misc_feature: GZ8MTXP01DCMC1.10.20.B09.1.454.CMB.2.raw
  modified_base (226)..(226): a, c, t, g, unknown or other
  misc_feature (226)..(226): n is a, c, g, or t
  modified_base (232)..(232): a, c, t, g, unknown or other
  misc_feature (232)..(232): n is a, c, g, or t
  modified_base (256)..(256): a, c, t, g, unknown or other
  misc_feature (256)..(256): n is a, c, g, or t
  modified_base (291)..(291): a, c, t, g, unknown or other
  misc_feature (291)..(291): n is a, c, g, or t
  modified_base (301)..(301): a, c, t, g, unknown or other
  misc_feature (301)..(301): n is a, c, g, or t
  modified_base (326)..(326): a, c, t, g, unknown or other
  misc_feature (326)..(326): n is a, c, g, or t
  modified_base (379)..(379): a, c, t, g, unknown or other
  misc_feature (379)..(379): n is a, c, g, or t
  modified_base (409)..(409): a, c, t, g, unknown or other
  misc_feature (409)..(409): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggcctcccagacaacactgcagaaatagttatgacgcagtctccagccaccctgtctgtgtctccgaggggagagacgcccaccctctcctgcgagggccgtnagaatnttgctaaccaacttagcctggtanacaacaaagcctggccaggcctcccagacctcctnatctcgtggncatcttcggagggccacgttggtcnccccagccaggttcaggtcggcaggttgggtctaggaaacagtgttcacttcncaccatcgacgcgctgcagtctagaagttntttgacttagtttatacttgtacaggtactaagttaataacgttgtacgtttgggttttacttaccgtacgttttccggacccgttacgggaacctaaaggttgggttaacttttacggaacgttaacggtaacttgggttcggttacgttcggacctaaccgttacgtccgtttagttccgttcttaaccg

SEQ ID NO: 318313 - DNA, 693 bp, Homo sapiens
  misc_feature: GZ8MTXP01ERE55.10.20.B09.1.454.CMB.2.raw
  modified_base (156)..(156): a, c, t, g, unknown or other
  misc_feature (156)..(156): n is a, c, g, or t
  modified_base (197)..(197): a, c, t, g, unknown or other
  misc_feature (197)..(197): n is a, c, g, or t
  modified_base (230)..(230): a, c, t, g, unknown or other
  misc_feature (230)..(230): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggcctcccagacaacactgcaagaaatagttangacgcagtctccagccaccctgtctgtgtctccgagggganagacgcccaccctctcctgcgacggggccgtanaagtaattattcgaccttaaccaacttgcccttaggtaactacaaacaaaacgccgtaggccaacggcctcccagacctcctcactctcgtggtcgctattcgttcggacgggtcctacgtcggtcgtcccagtccgtaggttcaggtcggacgtaggtcgggtacgtaggaaaactagtcgttcaccgtcctaccgacctagtcgacggtccggtcctcggacgtacgttcgtaaggttaaacgtttcgtttttagacgtttaagttttaacttaacgttcgtactaagggggtacttaaaggtttaaattaaacgttggtttaacgtttagggtttttaacttaccggtttaccggtttcccgggacccgttagggaaaccttaaagggttcgttaactttacgaagtacggtaacgttggttcggactcgactaactattccgttcttccgtttcgtccg

SEQ ID NO: 318314 - DNA, 609 bp, Homo sapiens
  misc_feature: GZ8MTXP01B2NFR.10.20.B09.1.454.CMB.2.raw
  modified_base (194)..(194): a, c, t, g, unknown or other
  misc_feature (194)..(194): n is a, c, g, or t
  modified_base (225)..(225): a, c, t, g, unknown or other
  misc_feature (225)..(225): n is a, c, g, or t
  modified_base (230)..(230): a, c, t, g, unknown or other
  misc_feature (230)..(230): n is a, c, g, or t
  modified_base (232)..(232): a, c, t, g, unknown or other
  misc_feature (232)..(232): n is a, c, g, or t
  modified_base (248)..(248): a, c, t, g, unknown or other
  misc_feature (248)..(248): n is a, c, g, or t
  modified_base (259)..(259): a, c, t, g, unknown or other
  misc_feature (259)..(259): n is a, c, g, or t
  modified_base (271)..(271): a, c, t, g, unknown or other
  misc_feature (271)..(271): n is a, c, g, or t
  modified_base (278)..(278): a, c, t, g, unknown or other
  misc_feature (278)..(278): n is a, c, g, or t
  modified_base (288)..(288): a, c, t, g, unknown or other
  misc_feature (288)..(288): n is a, c, g, or t
  modified_base (588)..(588): a, c, t, g, unknown or other
  misc_feature (588)..(588): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccacctgtctgtgtctccgagggganagacgcccaccctctcctgcgagggccgtanagatntnactactatgctagtanacaacaacgcngcacgccaccanactctcntctcgtgtcnctactcgtacggacggtcctacgtcggtccgtaccgacgtccgtaggtcgaggtcggacgtagggtcggtacgaggaaactagtcgttaccactccacactgtcgacgcgtcgtgacgtagttacgtagtaagtttgtttagactttaagtttacttcgtagtacgaggtaacttaagttaagttaacgttagttacgtttaggttttacttccgttaccgttccggaccgttagggtaaacctaaaggttcgttacttacgaacggtaacgtacgttggttcgactcgacctaacgttnttcttacgttccttcgtaacc

SEQ ID NO: 318315 - DNA, 606 bp, Homo sapiens
  misc_feature: GZ8MTXP01CHPUR.10.20.B09.1.454.CMB.2.raw
  modified_base (195)..(195): a, c, t, g, unknown or other
  misc_feature (195)..(195): n is a, c, g, or t
  modified_base (226)..(226): a, c, t, g, unknown or other
  misc_feature (226)..(226): n is a, c, g, or t
  modified_base (320)..(320): a, c, t, g, unknown or other
  misc_feature (320)..(320): n is a, c, g, or t
  modified_base (394)..(394): a, c, t, g, unknown or other
  misc_feature (394)..(394): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcaagaaatagttatgacgcagtctccagccacctgtctgtgtctccgagggganagacgcccaccctctcctgcgagggccgtanagtaattattcgacctaaccaactttagccttaggtaactacaaacaaaagccctaggcccaggcctacccgagtacctcctcatctcgtggtnctagtcgttcggacggtcctacgtgggtctcccgagcctaggttcaggtcggcgtaggtgggtctaggaaaacngtaacgttcactcctacaccatcgacgcgctgcgtagtctagtaaattgttttgactttagtttaacttcttgtacaggtacgtaagttaattaagtgttacgtttgggtttactcgtacgtttccggacgttacgggaacctaaaggtcggttaatttcgaagtaccgtagttggttcgactcgcctaactgttccttagttccttcgtcc

SEQ ID NO: 318316 - DNA, 550 bp, Homo sapiens
  misc_feature: GZ8MTXP01APIGA.10.20.B09.1.454.CMB.2.raw
  modified_base (192)..(192): a, c, t, g, unknown or other
  misc_feature (192)..(192): n is a, c, g, or t
  modified_base (220)..(220): a, c, t, g, unknown or other
  misc_feature (220)..(220): n is a, c, g, or t
  modified_base (397)..(397): a, c, t, g, unknown or other
  misc_feature (397)..(397): n is a, c, g, or t
  modified_base (528)..(528): a, c, t, g, unknown or other
  misc_feature (528)..(528): n is a, c, g, or t
tcagcatagtagtgcacgaccggtgctcgatttagtgtagtgtgaagggggaactgctcagttaggacccagacggaaccatggaagccccagcgcagcttctcttcctcctgctactctggctcccagacaacactgcagaaatagttatgacgcagtctccagccaccctgtctgtgtctccgagggganagagcccaccctctcctgcagggccgtnagaatattgctaccaattagcctggtatcaaacaaagcctggccaggcctcccagactcctcatctctggtgcatcttcggacgggccactggtcgtcccagcctaggttcaggtggccaggtgggtctgggaacagtagttcactctcaccatcgagcgctgctagtctagaagtntttgacttagtttattactgtacagctaagttataatgtacgtttggtttactcgtacgtttcggcccttaggggaacctaaggttggtaatttcgacgttacgtaaacgtgttacggttcttcgcacctnttctgttccttcgttcgttccc

SEQ ID NO: 318317 - DNA, 558 bp, Homo sapiens
  misc_feature: GZ8MTXP01DL12G.10.20.B09.1.454.CMB.2.raw
  modified_base (196)..(196): a, c, t, g, unknown or other
  misc_feature (196)..(196): n is a, c, g, or t
  modified_base (225)..(225): a, c, t, g, unknown or other
  misc_feature (225)..(225): n is a, c, g, or t
  modified_base (416)..(416): a, c, t, g, unknown or other
  misc_feature (416)..(416): n is a, c, g, or t
  modified_base (541)..(541): a, c, t, g, unknown or other
  misc_feature (541)..(541): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagcccaccctgtctgtgtctcgaagggganagacgcccaccctctcctgcagggccgtnagaatattgctaaccaattgcctggtatcaacaaagcctggccaggctcccagctcctcatctctggtgcatcttcggagggccacgtgggtctcccgagccgtaggttcaggtcggcgaggttgggtctagggaaacagtcgttcactctaccacctatcgagccggtactggcagttctagtaaagttnttttgcttagtttattactgtacaggtctagtataagtgtacgttggtttactctacgtttcggacccgttagggaactaaaggttgaatttcgaagtacgtaattggttgcctgacctaacctntcttgtccttctaaccg

SEQ ID NO: 318318 - DNA, 781 bp, Homo sapiens
  misc_feature: GZ8MTXP01EASYF.10.20.B09.1.454.CMB.2.raw
  modified_base (199)..(199): a, c, t, g, unknown or other
  misc_feature (199)..(199): n is a, c, g, or t
  modified_base (229)..(229): a, c, t, g, unknown or other
  misc_feature (229)..(229): n is a, c, g, or t
  modified_base (314)..(314): a, c, t, g, unknown or other
  misc_feature (314)..(314): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggcctcccagacaacactgcaagaaattagttatgacgcagtctccagcccacctgtctgtgtctccgaggggganagacgcccaccctctcctgcgagggccgtnaagtaatattgactaaccaacttagcctaggtaactacaaacaaagcctggaccaggcctcccagacctcctcactctcgtggtnctattccgttacggacgggtccctacgtcgggttccgtccccgagtccccgtaagggtttccaagggttccgggaccgtaggggttcgggggtaccttaggggaaaaacccgtaggttaacggttaccaacccttccttaccccaaccctaagttcccgaacgggtcccggtacccgttggaccgttacggttaccgttaagggttaaacgtttagtttttttacggaccttttaaggttttaactttacgtacggttacctaaggggtacttaaaggtttaaacttaaggtttcggttaaaccggttttggggttttttaacttacccggtttaaccggttttacccggggtaccccgttaagggggtaaacccttaaaagggtttcggttaactttacggaaagtaaacgtaacgttgggttcggttacttcgactaaccgtattcttacgttccttctaacccg

SEQ ID NO: 318319 - DNA, 540 bp, Homo sapiens
  misc_feature: GZ8MTXP01EHM98.10.20.B09.1.454.CMB.2.raw
  modified_base (289)..(289): a, c, t, g, unknown or other
  misc_feature (289)..(289): n is a, c, g, or t
  modified_base (300)..(300): a, c, t, g, unknown or other
  misc_feature (300)..(300): n is a, c, g, or t
  modified_base (416)..(416): a, c, t, g, unknown or other
  misc_feature (416)..(416): n is a, c, g, or t
  modified_base (438)..(438): a, c, t, g, unknown or other
  misc_feature (438)..(438): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgaggggagagacgccaccctctcctgcagggccggtcagaatattgctaaccaacttagcctggtatacaaacaaaagcctggccaggctcccacgactccncatctctggtncatcttcgagggcctacgtggtcgtccccaggccaaggttccaggtccggcgtaggtcggggtctagggaaacagtcgttcactctcacctatcagcggctgcagtctagaagttntttgctagtttatactgtcagntagtaatagtgtattggtttatcgtacgttcgcctggactaaagtcgttattgagtacgtaacgttgttgctgacctaatagtccttagttccttctaaccg

SEQ ID NO: 318320 - DNA, 597 bp, Homo sapiens
  misc_feature: GZ8MTXP01B7I3X.10.20.B09.1.454.CMB.2.raw
  modified_base (575)..(575): a, c, t, g, unknown or other
  misc_feature (575)..(575): n is a, c, g, or t
tcagcatagtagtgcacgaccggtgctcgatttagtgtagtgtgaaggggggaactgctcagttaggacccagacggaaccatggaagccccagcgcagcttctcttcctcctgctactctggctcccagacaacactgcagaaatagttatgacgcagtctccagccaccctgtctgtgtctccgaggggagagacgcccaccctctcctgcgaggggccggtcaagtaatattgacctaaccaacttagcctggtactacaaacaaacgcctggccaggcctcccagacctcctcatcctcgtggtgcattcgtcggacgggcctagtcggtcgtcccgagcctagggttcaggtcggccgtagggttgggtctaggaaactaggtacgtttcacctctaccacactcgacgggtccggccttgcctaggtctaggaaagttattttgacttagtttaacttcgtgtacagtactagttataatgtacgttggttttactcgtacgtttcggcccgtagggtacctaaaggtgtaatttcgaacgacgtacgtgttcggcttcgcctaacgtnttcgtgttcctcgttcttcccg

SEQ ID NO: 318321 - DNA, 581 bp, Homo sapiens
  misc_feature: GZ8MTXP01ENEJQ.10.20.B09.1.454.CMB.2.raw
  modified_base (193)..(193): a, c, t, g, unknown or other
  misc_feature (193)..(193): n is a, c, g, or t
  modified_base (222)..(222): a, c, t, g, unknown or other
  misc_feature (222)..(222): n is a, c, g, or t
  modified_base (228)..(228): a, c, t, g, unknown or other
  misc_feature (228)..(228): n is a, c, g, or t
  modified_base (247)..(247): a, c, t, g, unknown or other
  misc_feature (247)..(247): n is a, c, g, or t
  modified_base (252)..(252): a, c, t, g, unknown or other
  misc_feature (252)..(252): n is a, c, g, or t
  modified_base (553)..(553): a, c, t, g, unknown or other
  misc_feature (553)..(553): n is a, c, g, or t
tcagcatagtagtgcacgaccggtgctcgatttagtgtagtgtgaaggggggaactgctcagttaggacccagacggaaccatggaagccccagcgcagcttctcttcctcgtgctactctggctcccagacaacactgcagaaatagttatgacgcagtctccagccaccctgtctgtgtctccgagggganagagcccaccctctcctgcgagggccgtnagaatntgctacaattgcctggtanacaanaaagctgccagctccagactctcatctcgtggtgctattcgttcggacgggcctacgttggtcctcccgagcccgtaggttcgaggtcggcctagggtgggtcgtaggaacctaagtacgtttcaacctctacacctatcgaggccgcctgcagtctagaagttattttgacttagtttactacgtgtacagtactaagtattaagtgtacgtttggtttactcgttacgtttccggaccttaggaacctaaggtgtaactttcgaagttacgtaacgtgttcggcttcggccctaacgtnttcgttgttaccttcgttcgtttccccg

SEQ ID NO: 318322 - DNA, 580 bp, Homo sapiens
  misc_feature: GZ8MTXP01BA2VV.10.20.B09.1.454.CMB.2.raw
  modified_base (192)..(192): a, c, t, g, unknown or other
  misc_feature (192)..(192): n is a, c, g, or t
  modified_base (220)..(220): a, c, t, g, unknown or other
  misc_feature (220)..(220): n is a, c, g, or t
  modified_base (241)..(241): a, c, t, g, unknown or other
  misc_feature (241)..(241): n is a, c, g, or t
  modified_base (250)..(250): a, c, t, g, unknown or other
  misc_feature (250)..(250): n is a, c, g, or t
  modified_base (256)..(256): a, c, t, g, unknown or other
  misc_feature (256)..(256): n is a, c, g, or t
  modified_base (260)..(260): a, c, t, g, unknown or other
  misc_feature (260)..(260): n is a, c, g, or t
  modified_base (264)..(264): a, c, t, g, unknown or other
  misc_feature (264)..(264): n is a, c, g, or t
  modified_base (270)..(270): a, c, t, g, unknown or other
  misc_feature (270)..(270): n is a, c, g, or t
  modified_base (274)..(274): a, c, t, g, unknown or other
  misc_feature (274)..(274): n is a, c, g, or t
tcagcatagtagtgcacgaccggtgctcgatttagtgtagtgtgaagggggaactgctcagttaggacccagacggaaccatggaagccccagcgcagcttctcttcctcctgctactctggctcccagacaacactgcagaaatagttatgacgcagtctccagccaccctgtctgtgtctccgagggganagagcccaccctctcctgcagggccgtnagatatgctacattgctgtancaacaagcngcagcnccanctcncatctntgtncatctcgacggccacgtggtcgtcccagcctaggttcaggtggcctaggtggtctaggaacaagtacgttcactctaccacctatcgaacgccggcctggccagttcgtagaaagttacttttgacttagtttattacgtgtactagacgtaagttaataacgtcgttaacgtttggggttttaacttcgtaccgtttccggtacccgtagggtaaccaaaggttcggtatttacgaggttacgtaaacgttggttacggttcttacggcctaacctgttccttacgttcttcccgaatttccccg

SEQ ID NO: 318323 - DNA, 575 bp, Homo sapiens
  misc_feature: GZ8MTXP01EDER1.10.20.B09.1.454.CMB.2.raw
  modified_base (192)..(192): a, c, t, g, unknown or other
  misc_feature (192)..(192): n is a, c, g, or t
  modified_base (220)..(220): a, c, t, g, unknown or other
  misc_feature (220)..(220): n is a, c, g, or t
tcagcatagtagtgcacgaccggtgctcgatttagtgtagtgtgaaggggggaactgctcagttaggacccagacggaaccatggaagccccagcgcagcttctcttcctcctgctactctggctcccagacaacactgcagaaatagttatgacgcagtctccagccaccctgtctgtgtctccagggganagagcccaccctctcctgcagggccgtnagaatattgctaccaattagcctggtatcaacaaagcctggccaggctcccagactcctcatctctggtgcatcttcgaggccacgtggtctcccagccaggttcaggtgccaggtggtctggaacagagttcactctcacatcagccgctgcagtctagaagtattttgactagtttatactgtacagctaagttattaagtgtacgtttgggttttattccgtaacgttttccgggccccttaggggaaaccctaaagggtggttacttttcgaaacggttaccgtaaacgttgggttagggttccttggccctaaaccgttcgttcgttcgttcctttaacgccgtttcccg

SEQ ID NO: 318324 - DNA, 699 bp, Homo sapiens
  misc_feature: GZ8MTXP01ENO4A.10.20.B09.1.454.CMB.2.raw
  modified_base (290)..(291): a, c, t, g, unknown or other
  misc_feature (290)..(291): n is a, c, g, or t
  modified_base (313)..(313): a, c, t, g, unknown or other
  misc_feature (313)..(313): n is a, c, g, or t
  modified_base (364)..(364): a, c, t, g, unknown or other
  misc_feature (364)..(364): n is a, c, g, or t
tcagcatagtagtgcacgaccggtgctcgatttagtgtagtgtgaagggggaggaactgctcagttaggacccagacggaaccatggaagcccagcgcagcttctcttcctcctgctactctggctcccagacaacactgcaagaaatagttatgacgcagtctccacgccaccctgtctgtgtctccgaggggagagacgccaccctctcctgcgacgggccggtcagaatattgactaacctaacttagcctgggtaatcgaacaaaagccctaggcccaggctcccnnctcccgtacactcctctggtcnctagtctcgagggtccctacgtcgggtcgtcccgaggtccgtacggttacngggttccggacgtagggtcggggtcgtgggggtaaaacctaggggtaacgttcgaaaccgtttccgtaccgtacccgtaactaccaaggtcccggaccgtcggacctaggtccttagggtaaacgtagttttacgacttaggttacttaacgttgttactagggtctaaggttaactaaagttcgtaaacgttgggttttaacttcggtttaacttttccgggtaccctttcggggaacccttaaaggggtcgttaaagtttcgaaaggttaccggtaaacgttcggttacggttcgtggtcctaaccgtacttccgttacgttccgttcgtaac

SEQ ID NO: 318325 - DNA, 564 bp, Homo sapiens
  misc_feature: GZ8MTXP01AL22M.10.20.B09.1.454.CMB.2.raw
  modified_base (193)..(193): a, c, t, g, unknown or other
  misc_feature (193)..(193): n is a, c, g, or t
  modified_base (294)..(294): a, c, t, g, unknown or other
  misc_feature (294)..(294): n is a, c, g, or t
  modified_base (372)..(372): a, c, t, g, unknown or other
  misc_feature (372)..(372): n is a, c, g, or t
  modified_base (539)..(539): a, c, t, g, unknown or other
  misc_feature (539)..(539): n is a, c, g, or t
  modified_base (554)..(554): a, c, t, g, unknown or other
  misc_feature (554)..(554): n is a, c, g, or t
tcagcatagtagtgcacgaccggtgctcgatttagtgtagtgtgaaggggggaactgctcagttaggacccagacggaaccatggaagccccagcgcagcttctcttcctcctgctactctggctcccagacaacactgcagaaatagttatgacgcagtctccagccaccctgtctgtgtctccgagggganagagccaccctctcctgcagggccgtcagaatattgctaccaacttagcctggtatcaaacaaagcctggccaggcctcccagacctcctcatctctggtncatcgtcggagggccacgtggtctcccagccaggttcagtggccaggtgggtctaggaacagtagttcactctacacntcagcgcctgctagtctagaagttattttgacttagtttactacgtgtactaggactaagttaataagttggttacgtttgggttttactccgtacgtttccggccgttagggaacctaaaggtgtaactttcgaagttacgtaagtggacggttcttgcctacgtnttctaggttccttcncgtttccccg

SEQ ID NO: 318326 - DNA, 554 bp, Homo sapiens
  misc_feature: GZ8MTXP01DSTWT.10.20.B09.1.454.CMB.2.raw
  modified_base (195)..(195): a, c, t, g, unknown or other
  misc_feature (195)..(195): n is a, c, g, or t
  modified_base (223)..(223): a, c, t, g, unknown or other
  misc_feature (223)..(223): n is a, c, g, or t
  modified_base (248)..(248): a, c, t, g, unknown or other
  misc_feature (248)..(248): n is a, c, g, or t
  modified_base (286)..(286): a, c, t, g, unknown or other
  misc_feature (286)..(286): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgagggganagagcccaccctctcctgcagggccgtnagaatattgctacaattgcctgtancaacaaagctgccagctccagactcctcatctctggtncatcttcggagggccacgtggtcgtcccagcctaggttcagtcggcaggtgggtctggaaaacagtgttcactctccaccatcagccgcctgcgagtctgtaaagtattttgactagtttattactgtcaggtctaagtataatgtacttggtttatcgtactttcggccttgggaacctaaagttcggaacttttcgaaagtaacgtaacgttcggttggttcccttaaggacctaaccgttatccgttagttcccttcgtaacccg

SEQ ID NO: 318327 - DNA, 623 bp, Homo sapiens
  misc_feature: GZ8MTXP01DGU3D.10.20.B09.1.454.CMB.2.raw
  modified_base (196)..(196): a, c, t, g, unknown or other
  misc_feature (196)..(196): n is a, c, g, or t
  modified_base (225)..(225): a, c, t, g, unknown or other
  misc_feature (225)..(225): n is a, c, g, or t
  modified_base (255)..(255): a, c, t, g, unknown or other
  misc_feature (255)..(255): n is a, c, g, or t
  modified_base (355)..(355): a, c, t, g, unknown or other
  misc_feature (355)..(355): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcaagaaatagttatgacgcagtctccagccaccctgtctgtgtctccgagggganagacgccaccctctcctgcgagggccgtnagaatattgctacaattgcctggtatcaanaaagcctggccaggctcccagactcctcatctctggtgcatctcggaggccactggtctccagcccaggttcaggtcggcctaggtggtctaggaaaacngtcgtcaacttcacaacctatcgagccggtcctggacctagggttccttagggaaaacgttttacgtttacgacgtttaagtttacttacgttagttactaagggtacttaaagttaattaagttgttaacgtttggttttacttaccgttaccgtttccgggtacccgtaagggtaaacctaaaggttcgttaacgttacgaaacggtacgtaacgttggttacgttcgtaacgtacctaacgtacgttcttacgttccttcgtaac

SEQ ID NO: 318328 - DNA, 575 bp, Homo sapiens
  misc_feature: GZ8MTXP01DP394.10.20.B09.1.454.CMB.2.raw
  modified_base (222)..(222): a, c, t, g, unknown or other
  misc_feature (222)..(222): n is a, c, g, or t
  modified_base (286)..(286): a, c, t, g, unknown or other
  misc_feature (286)..(286): n is a, c, g, or t
  modified_base (291)..(291): a, c, t, g, unknown or other
  misc_feature (291)..(291): n is a, c, g, or t
  modified_base (549)..(549): a, c, t, g, unknown or other
  misc_feature (549)..(549): n is a, c, g, or t
tcagcatagtagtgcacgaccggtgctcgatttagtgtagtgtgaaggggggaactgctcagttaggacccagacggaaccatggaagccccagcgcagcttctcttcctcctgctactctggctcccagacaacactgcagaaatagttatgacgcagtctccagccaccctgtctgtgtctccgaggggagagacgcccaccctctcctgcagggccgtnagaatattgctacaacttgcctaggtatacaacaaagctggccaggctccagactcctcatctntggtnctatcgtcgacggccagtggtctcccagcctaggttcaggtcggccaggtgggtctaggaacaaggtacgttccactcctaccaccatcgaggccggcctgcctagtctagtaaagttattttgacttaagtttactacgtgtacagtacgtaagttaataagttgtaacgtttgggtttactcgttacgtttcggccctagggaacctaaaggtgtatttcgaagttacgtacgtggttcggcttgcctaaccgttnttcgtgttccttcgttaacgttcccg

SEQ ID NO: 318329 - DNA, 570 bp, Homo sapiens
  misc_feature: GZ8MTXP01D008W.10.20.B09.1.454.CMB.2.raw
  modified_base (197)..(197): a, c, t, g, unknown or other
  misc_feature (197)..(197): n is a, c, g, or t
  modified_base (227)..(227): a, c, t, g, unknown or other
  misc_feature (227)..(227): n is a, c, g, or t
  modified_base (234)..(234): a, c, t, g, unknown or other
  misc_feature (234)..(234): n is a, c, g, or t
  modified_base (253)..(253): a, c, t, g, unknown or other
  misc_feature (253)..(253): n is a, c, g, or t
  modified_base (273)..(273): a, c, t, g, unknown or other
  misc_feature (273)..(273): n is a, c, g, or t
  modified_base (279)..(279): a, c, t, g, unknown or other
  misc_feature (279)..(279): n is a, c, g, or t
  modified_base (289)..(289): a, c, t, g, unknown or other
  misc_feature (289)..(289): n is a, c, g, or t
  modified_base (397)..(397): a, c, t, g, unknown or other
  misc_feature (397)..(397): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggcctcccagacaacactgcaagaaatagttatgacgcagtctccagccaccctgtctgtgtctccgagggganagacgcccaccctctcctgcgagggccgtnagtaatnttgctaccatagcctgtancaacaaagctgcagctccanactccnatctctggtnctatccgttcgaggcctagtcggtcgtcccagcctaggtcagtcggctaggtgggtctaggaaacagtgttcactctacacatcgacgcgctgcagtctagtaacgtnttttgcttagttactactgtactagggtactaagttaatattggtacgtttgggttttacttaccgttacgtttcccggtaccgtacgggtaacgtaaaggttggttaacttcggaagtaacgtacgttaggttcggcttggacctaacgtctcgttcttcttccgttaaccg

SEQ ID NO: 318330 - DNA, 741 bp, Homo sapiens
  misc_feature: GZ8MTXP01EZ2CV.10.20.B09.1.454.CMB.2.raw
  modified_base (178)..(178): a, c, t, g, unknown or other
  misc_feature (178)..(178): n is a, c, g, or t
  modified_base (191)..(191): a, c, t, g, unknown or other
  misc_feature (191)..(191): n is a, c, g, or t
  modified_base (194)..(194): a, c, t, g, unknown or other
  misc_feature (194)..(194): n is a, c, g, or t
  modified_base (207)..(207): a, c, t, g, unknown or other
  misc_feature (207)..(207): n is a, c, g, or t
  modified_base (458)..(458): a, c, t, g, unknown or other
  misc_feature (458)..(458): n is a, c, g, or t
  modified_base (469)..(469): a, c, t, g, unknown or other
  misc_feature (469)..(469): n is a, c, g, or t
  modified_base (549)..(549): a, c, t, g, unknown or other
  misc_feature (549)..(549): n is a, c, g, or t
  modified_base (677)..(677): a, c, t, g, unknown or other
  misc_feature (677)..(677): n is a, c, g, or t
tcagcatagtagtgcacgaccggtgctcgatttagtgtagtgtgaaggggaggaactgctcagttaggacccagacggaaccatggaagcccagcgcagcttctcttcctcctgctactctggctcccagacaacactgcagaaatagttatgacgcagtctccagccaccctgtctnaagtctcaggganagnacgcacctctctncgccgggtctcaagaattgtgtaccaaccttaagtcctcggtagtacaccaaaagaaactcggtccgacggacgtcccctaccgagtaccctccactacttccttcggttggggtccactacctttccgtacgggtaccggtaccctacggttcggttcccgtacccgaccgtaccggttacggtaccgtagggtcggacggtacggggttcggttacgggtaacggaacgtaacggtacgtaccgtaccnttccgtacccnaacctacgtacgacgggcccgtccgtcgtacgaacgttacgtaaggtaagtttagtttacgtacgtttaacgtttaacgntaacgttacgtacgtacgtaacgttaaacgttaacgttaaacgttacggtttacggtttacggttttaaccgtttaccgttaacccgttcccggttacccggtaaccggttaaaccgtaaacggttcncgaacggttaccgtaaacgtacggtaacggtacgttcggttaccgtaaccgttaacgtaacccg

SEQ ID NO: 318331 - DNA, 589 bp, Homo sapiens
  misc_feature: GZ8MTXP01AV6RA.10.20.B09.1.454.CMB.2.raw
  modified_base (196)..(196): a, c, t, g, unknown or other
  misc_feature (196)..(196): n is a, c, g, or t
  modified_base (227)..(227): a, c, t, g, unknown or other
  misc_feature (227)..(227): n is a, c, g, or t
  modified_base (234)..(234): a, c, t, g, unknown or other
  misc_feature (234)..(234): n is a, c, g, or t
  modified_base (545)..(545): a, c, t, g, unknown or other
  misc_feature (545)..(545): n is a, c, g, or t
  modified_base (561)..(561): a, c, t, g, unknown or other
  misc_feature (561)..(561): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagcccaccctgtctgtgtctccgagggganagacgcccaccctctcctgcgagggccgtanagtaatnttgactacacttagcctagtactacaaacaaacgctggccacggcctacccagacctcctcacttctcgtggtcgctacgttccgttacggacgggtccctacggttcgggtccgtacccgagtcccgtaggtttccgaggtcggcgtagggtcgggtcgtagggaaaccaggtcgttcacctctaccactagtccgagtcccgtctggctagtcgtagtaagttatttgacttagtttatacgtgtacaggtctaagttattagtcgtacgttggtttactctacgttcggacgtggaactaaggtgttnttcgagtactattggnttcgtgactctgtcttacgttcttctcc

SEQ ID NO: 318332 - DNA, 534 bp, Homo sapiens
  misc_feature: GZ8MTXP01CFQU7.10.20.B09.1.454.CMB.2.raw
  modified_base (192)..(192): a, c, t, g, unknown or other
  misc_feature (192)..(192): n is a, c, g, or t
  modified_base (220)..(220): a, c, t, g, unknown or other
  misc_feature (220)..(220): n is a, c, g, or t
  modified_base (514)..(514): a, c, t, g, unknown or other
  misc_feature (514)..(514): n is a, c, g, or t
tcagcatagtagtgcacgaccggtgctcgatttagtgtagtgtgaagggggaactgctcagttaggacccagacggaacaatggaagccccagcgcagcttctcttcctcctgctactctggctcccagacaacactgcagaaatagttatgacgcagtctccagccaccctgtctgtgtctccgagggganagagcccaccctctcctgcagggccgtnagaatattgctaccaacttagcctaggtatacaaacaaagcctggccaggcctacccagacctcctcatctctggtgcatctcgaggccacgtggtcgtccagccaggttcagtgcaggtggtctagaacagtatcactctcacatcagcgctgcagtctagaagtattttgcttagtttatactgtacagtactagttaataattgtacgtttgggtttactcgtacgtttccggccgttagggaacctaaaggtggtatttcgagacgtaacgtgttacggcttgcctactnttctgttcttcgctttcccg

SEQ ID NO: 318333 - DNA, 540 bp, Homo sapiens
  misc_feature: GZ8MTXP01CLNLK.10.20.B09.1.454.CMB.2.raw
  modified_base (152)..(152): a, c, t, g, unknown or other
  misc_feature (152)..(152): n is a, c, g, or t
  modified_base (193)..(193): a, c, t, g, unknown or other
  misc_feature (193)..(193): n is a, c, g, or t
  modified_base (225)..(225): a, c, t, g, unknown or other
  misc_feature (225)..(225): n is a, c, g, or t
  modified_base (232)..(232): a, c, t, g, unknown or other
  misc_feature (232)..(232): n is a, c, g, or t
  modified_base (368)..(368): a, c, t, g, unknown or other
  misc_feature (368)..(368): n is a, c, g, or t
  modified_base (390)..(390): a, c, t, g, unknown or other
  misc_feature (390)..(390): n is a, c, g, or t
  modified_base (410)..(410): a, c, t, g, unknown or other
  misc_feature (410)..(410): n is a, c, g, or t
  modified_base (517)..(517): a, c, t, g, unknown or other
  misc_feature (517)..(517): n is a, c, g, or t
tcagcatagtagtgcacgaccggtgctcgatttagtgtagtgtgaaggggggaactgctcagttaggacccagacggaaccatggaagccccagcgcagcttctcttcctcctgctactctggctcccagacaacactgcagaaatagttangacgcagtctccagccaccctgtctgtgtctccgagggganagacgcccaccctctcctggccaggggccgtnaagaatnttgctaccaattgcctggtatcaacaaagctggccaggctccagactcctcatctctggtcgcatcttcgagggccactggtcgtccagccaggttcagtggccaggtggtctggaacagacgttcactctcaccntcgagcgctgcagtctgaagtnttttgcttagtttattacgnttcagactagtattaacgtgtacgtttggtttactcgtacctttcggcccgtaggtaacctaaggttggtattcgaagttacgtaagttggacgttcttcgctactntcttcgttctaacgttcttcccg

SEQ ID NO: 318334 - DNA, 561 bp, Homo sapiens
  misc_feature: GZ8MTXP01B8KQW.10.20.B09.1.454.CMB.2.raw
  modified_base (247)..(247): a, c, t, g, unknown or other
  misc_feature (247)..(247): n is a, c, g, or t
  modified_base (277)..(277): a, c, t, g, unknown or other
  misc_feature (277)..(277): n is a, c, g, or t
  modified_base (283)..(283): a, c, t, g, unknown or other
  misc_feature (283)..(283): n is a, c, g, or t
  modified_base (384)..(384): a, c, t, g, unknown or other
  misc_feature (384)..(384): n is a, c, g, or t
  modified_base (398)..(398): a, c, t, g, unknown or other
  misc_feature (398)..(398): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcaagaaatagttatgacgcagtctccagccaccctgtctgtgtctccgaggggagagacgccaccctctcctgcgagggccgtcagaatatgctacacttgctgancaacaagctgcaggctccagctctcatctntggtcncatcgttcggacgggccacgtcggtcgtcccagcctaggttcaggtcggcgtaggtcgggtcaggaaacagtcgttcactctacactatcagccgtctgcnggtctagtaagttnttttcgacgttagtttatacttgtccaaggtctaagttatagttggtactttgggttttactcgtacgtttccggaccgtaggaacctaaaggtcggttatttcgagaacgtacgttggttacgcgtcgtctaaccgtatcgttacgttcctttcgtaacccg

SEQ ID NO: 318335 - DNA, 648 bp, Homo sapiens
  misc_feature: GZ8MTXP01EOTQV.10.20.B09.1.454.CMB.2.raw
  modified_base (198)..(198): a, c, t, g, unknown or other
  misc_feature (198)..(198): n is a, c, g, or t
  modified_base (614)..(614): a, c, t, g, unknown or other
  misc_feature (614)..(614): n is a, c, g, or t
  modified_base (619)..(619): a, c, t, g, unknown or other
  misc_feature (619)..(619): n is a, c, g, or t
  modified_base (625)..(625): a, c, t, g, unknown or other
  misc_feature (625)..(625): n is a, c, g, or t
  modified_base (633)..(633): a, c, t, g, unknown or other
  misc_feature (633)..(633): n is a, c, g, or t
  modified_base (638)..(638): a, c, t, g, unknown or other
  misc_feature (638)..(638): n is a, c, g, or t
tcagcatagtagtgcacgaccggtgctcgatttagtgtagtgtgaaggggggaggaactgctcagttaggacccagacggaaccatggaagccccagcgcagcttctcttcctcctgctactctggcctcccagacaacactgcaagaaatagttatgacgcagtctccagccaccctgtctgtgtctccgagggganagacgccaccctctcctgcgacggggccgtacaagtaattattcgacctaaccaacgttagaccttaggtaactacaaaacaaacgccgtacggaccacggcctacccgagacctcctacactctcgtggtcgctattccgttacggacgggtcctagtcgggtcgtacccaggtcccgtaggttccaggttcgggcctagggttggggtactacggggaaaactaggtaacgtttaccaccttctaccacgtactcgacgccggtcctggactaggttctaggttaaattgtttttcgactttaagtttactaacgtgtacagggtacttaaggttaatagttagttaccgtttaggttttactaccgttacgtttcggaccgtagggaactaaagtggttatgaagacgtacgnggttnctaagntaaccttntcttnttccttcgtc

SEQ ID NO: 318336 - DNA, 566 bp, Homo sapiens
  misc_feature: GZ8MTXP01BBRED.10.20.B09.1.454.CMB.2.raw
  modified_base (196)..(196): a, c, t, g, unknown or other
  misc_feature (196)..(196): n is a, c, g, or t
  modified_base (225)..(225): a, c, t, g, unknown or other
  misc_feature (225)..(225): n is a, c, g, or t
  modified_base (230)..(230): a, c, t, g, unknown or other
  misc_feature (230)..(230): n is a, c, g, or t
  modified_base (247)..(247): a, c, t, g, unknown or other
  misc_feature (247)..(247): n is a, c, g, or t
  modified_base (251)..(251): a, c, t, g, unknown or other
  misc_feature (251)..(251): n is a, c, g, or t
  modified_base (256)..(256): a, c, t, g, unknown or other
  misc_feature (256)..(256): n is a, c, g, or t
  modified_base (266)..(266): a, c, t, g, unknown or other
  misc_feature (266)..(266): n is a, c, g, or t
  modified_base (271)..(271): a, c, t, g, unknown or other
  misc_feature (271)..(271): n is a, c, g, or t
  modified_base (276)..(276): a, c, t, g, unknown or other
  misc_feature (276)..(276): n is a, c, g, or t
  modified_base (279)..(279): a, c, t, g, unknown or other
  misc_feature (279)..(279): n is a, c, g, or t
  modified_base (407)..(407): a, c, t, g, unknown or other
  misc_feature (407)..(407): n is a, c, g, or t
  modified_base (550)..(550): a, c, t, g, unknown or other
  misc_feature (550)..(550): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagcccaccctgtctgtgtctccgagggganagacgcccaccctctcctgcagggccgtnagatntgctacattagctgtancaanaagcngcagctccanctctnatctngtnctatcgttcgaggtccacgtggtctcccagcctaggtcaggtcgctaggtcggtctagggaaaccagtaacgttccacgttcctacacctatccgagccggtcctaggcgtagtcgtagtaaagtttnttttacgactttagtttatacgttgtacaggtactaagttaacttagttcgttacgttttggtttaactcgtccgtttccggaccgtacggtaacgtaaggtgttacttacgagtaacgtagttggttcgactcgctaacgtntcgttcttcttcgtcc

SEQ ID NO: 318337 - DNA, 625 bp, Homo sapiens
  misc_feature: GZ8MTXP01EYMQ6.10.20.B09.1.454.CMB.2.raw
  modified_base (192)..(192): a, c, t, g, unknown or other
  misc_feature (192)..(192): n is a, c, g, or t
  modified_base (300)..(300): a, c, t, g, unknown or other
  misc_feature (300)..(300): n is a, c, g, or t
  modified_base (465)..(465): a, c, t, g, unknown or other
  misc_feature (465)..(465): n is a, c, g, or t
tcagcatagtagtgcacgaccggtgctcgatttagtgtagtgtgaaggggggaactgctcagttaggacccagacggaaccatggaagccccagcgcagcttctcttcctcctgctactctggctcccagacaacactgcagaaatagttatgacgcagtctccagccacctgtctgtgtctccgagggganagagcccacctctcctgcgagggcccgtcaagaattattgcctaaccaacttgcctggtatacaaacaaagcctggccaggcctccagactcctcactctcgtggtcnctatccgttcgacgggtccacgtcggtcgtcccgagccgtaggttcaggtcggccctaggtggtctaggaaccaaggtacttccacttctaccacctaatccgaggtcccgggtccctggcctagtcctaggtaagttacgttttgacgttagtttacttacgtntacgagtacgtaagttataaagttgtacgtttggtttacttcctacgttttccgggacccgttagggtaaaccctaaaggtcgttaacgtttacgagttaacgtaacgttgggttggcttcggtaacctactcttcgtcgttccttcgttaacttccccg

SEQ ID NO: 318338 - DNA, 632 bp, Homo sapiens
  misc_feature: GZ8MTXP01A1AA8.10.20.B09.1.454.CMB.2.raw
  modified_base (463)..(463): a, c, t, g, unknown or other
  misc_feature (463)..(463): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcaagaaatagttatgacgcagtctccagccaccctgtctgtgtctccgaggggagagacgcccaccctctccgtgcgaggggccggtcaagaattattgccttaaccaacttagccttaggtactacaaacgaaaagcctaggccaggcctcccagacctcctcatctcgtggtcgctattcgttcggagggccctacgttcgggttcgtccccaggtcccgtagggttccgaggttcgggccgtaggttcggggtctaggaaaactagtaacgttcaacttcaccaccatcgagcggtctggcctaggtctaggtaagttnttttagcttaggtttactacgtgtacagggtctaagttatacgtgttacgttggttttactcgtccgtttcggacccgttaggggtaaacctaagggttgttactttacggacgtaacgtaacttggttgcttaacggcctaactactcggttcttccgttcttaaccg

SEQ ID NO: 318339 - DNA, 686 bp, Homo sapiens
  misc_feature: GZ8MTXP01BT784.10.20.B09.1.454.CMB.2.raw
  modified_base (197)..(197): a, c, t, g, unknown or other
  misc_feature (197)..(197): n is a, c, g, or t
  modified_base (227)..(227): a, c, t, g, unknown or other
  misc_feature (227)..(227): n is a, c, g, or t
  modified_base (233)..(233): a, c, t, g, unknown or other
  misc_feature (233)..(233): n is a, c, g, or t
  modified_base (252)..(252): a, c, t, g, unknown or other
  misc_feature (252)..(252): n is a, c, g, or t
  modified_base (263)..(263): a, c, t, g, unknown or other
  misc_feature (263)..(263): n is a, c, g, or t
  modified_base (292)..(292): a, c, t, g, unknown or other
  misc_feature (292)..(292): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcaagaaattagttatgacgcagtctccagccaccctgtctgtgtctccgagggganagacgccaccctctccgtgcgagggccgtnagaatntgctaccaattgcctgtanacaacaaagcngcagctcccagacctctcatctctggtcncattcgtcggacggcctagtcgggtctcccgagcctaggttcaggtcggacgaggttgggtactggaaaactaggtgttccaacgttccaccgacctagtcgacggccggtaccctggactagttacgtaagtaaacggttagtttttagaccgtttaagtttaacttacggtagttacctagggtaactaaggtttaaattaagttacgtaacgttttgggttttaacttacccggttacgtttcccggggacccgttacggggtaaacccgtaaaagggtttcggttaaacttttccggaaaggttaaaccggttaacgtttccggggttggttaccgttaacggcctaaacccttggttccttaccggtttccgtttaaccgttaaccccg

SEQ ID NO: 318340 - DNA, 555 bp, Homo sapiens
  misc_feature: GZ8MTXP01AMVBY.10.20.B09.1.454.CMB.2.raw
  modified_base (195)..(195): a, c, t, g, unknown or other
  misc_feature (195)..(195): n is a, c, g, or t
  modified_base (286)..(286): a, c, t, g, unknown or other
  misc_feature (286)..(286): n is a, c, g, or t
  modified_base (296)..(296): a, c, t, g, unknown or other
  misc_feature (296)..(296): n is a, c, g, or t
  modified_base (370)..(370): a, c, t, g, unknown or other
  misc_feature (370)..(370): n is a, c, g, or t
  modified_base (428)..(428): a, c, t, g, unknown or other
  misc_feature (428)..(428): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagcccaccctgtctgtgtctccagggganagagcccaccctctcctgcgagggccgtcagaatattgctaccaacttagcctggtatcaaacaaagcctggccaggctcccagactcctnatctctggtnctatcttcgaggccacgtggtcgtcccagccaggttcagtcggcaggtggtctaggaacagtgtcactctcacntcagcgctgcagtctagaagtattttgacttagtttatactgtacaggactaggttanaagttgtacgtttgggttttataccgttacgtttccgggaccttcggggaacctaaaggtcggttatttaccgagtaacgtaacttgggttcgacctgactaacctattcgttgttccttctaaccg

SEQ ID NO: 318341 - DNA, 664 bp, Homo sapiens
  misc_feature: GZ8MTXP01B445F.10.20.B09.1.454.CMB.2.raw
  modified_base (195)..(195): a, c, t, g, unknown or other
  misc_feature (195)..(195): n is a, c, g, or t
  modified_base (200)..(200): a, c, t, g, unknown or other
  misc_feature (200)..(200): n is a, c, g, or t
  modified_base (210)..(210): a, c, t, g, unknown or other
  misc_feature (210)..(210): n is a, c, g, or t
  modified_base (223)..(223): a, c, t, g, unknown or other
  misc_feature (223)..(223): n is a, c, g, or t
  modified_base (299)..(299): a, c, t, g, unknown or other
  misc_feature (299)..(299): n is a, c, g, or t
  modified_base (626)..(626): a, c, t, g, unknown or other
  misc_feature (626)..(626): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagcccacctgtctgtgtctccgagggganagacnccacctctcngcgacgggcgtanaagattatgactactaattcgctagtacacaaacaaacgtcgtcgacgagtccaccagcctcctcattctgtggcnctattccgtacggacggtcctacgttcggtcgaccgacgtccgtaggtcgaggtccggacgtaggtcgggtactacggaaacaggttcgtacctacgtcctaccaacctacgtcgaccgggcccggtctggacgtacggttacgtagggttaaacgtttgttttcggaactttagtttacgtacgttgaccgagtacttaaggttaatacgttacggttaggtttttacggtttactaccggtttacggtttccgggacccgtaagggtaaaccgtaaagggttcgttaaacgttggaacgttaaaccgtgtttgggacgttctaanacccgttaactcggtttcttctttccttaacgttcccg

SEQ ID NO: 318342 - DNA, 669 bp, Homo sapiens
  misc_feature: GZ8MTXP01AW9VW.10.20.B09.1.454.CMB.2.raw
  modified_base (194)..(194): a, c, t, g, unknown or other
  misc_feature (194)..(194): n is a, c, g, or t
  modified_base (225)..(225): a, c, t, g, unknown or other
  misc_feature (225)..(225): n is a, c, g, or t
tcagcatagtagtgcacgaccggtgctcgatttagtgtagtgtgaaggggggaactgctcagttaggacccagacggaaccatggaagcaccagcgcagcttctcttcctcctgctactctggctcccagacaacactgcagaaatagttatgacgcagtctccagcccaccctgtctgtgtctccgagggganagacgccaccctctcctgcgagggccggtanagaatattgctaaccaacttagcctggtatacaaacaaacgcctggccaggcctcccagacctcctcatctctggtgctatcgtcgacgggcctacgtggtcgtcccgagccgaggttcaggtcggctagggtcgggtctagggaaactaggtcgttcaaccttctaccacctagtccgacgggccggtcctggctaaggttcctaggtaaaacgttgtttttagacgtttaagttttaacttacgttagtacctaagggggacttaaggttaattaaaggttcgttaacggttttgggtttttaaaccttccgttacccggttttccgggaccccgttaagggggaacccttaaaggggttggttaactttacggaaggtaaccggttaacgttgggttacggcttcggacctaacgtcgttcgttacgttccttcgtaaccg

SEQ ID NO: 318343 - DNA, 572 bp, Homo sapiens
  misc_feature: GZ8MTXP01B0U7B.10.20.B09.1.454.CMB.2.raw
  modified_base (197)..(197): a, c, t, g, unknown or other
  misc_feature (197)..(197): n is a, c, g, or t
  modified_base (385)..(385): a, c, t, g, unknown or other
  misc_feature (385)..(385): n is a, c, g, or t
  modified_base (400)..(400): a, c, t, g, unknown or other
  misc_feature (400)..(400): n is a, c, g, or t
  modified_base (413)..(413): a, c, t, g, unknown or other
  misc_feature (413)..(413): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagcccaccctgtctgtgtctccgaggggganagacgccaccctctcctgcgagggccgtcagaatattgctaccaacttgcctggtatcaacaaagcctggccaggctcccagactcctcatctctggtgcatcttcggagggcctacgtgggtctcccagcctaggttcaggtcggcaggtgggtctggaaacagtgttcacgtctcacatcagcgcngcagtctagtaagtntttgcttagtttntactgtcagggtactaagttataagtgtaacgttgggttttatcgtacgtttccggccgtagggtaacctaaaggttcgttaatttccgaaggtaaccgtaacgttggttcgggttacttcggcctaacctagttccgttcgttcctttaacgtaaccc

SEQ ID NO: 318344 - DNA, 645 bp, Homo sapiens
  misc_feature: GZ8MTXP01C7QUL.10.20.B09.1.454.CMB.2.raw
  modified_base (198)..(198): a, c, t, g, unknown or other
  misc_feature (198)..(198): n is a, c, g, or t
  modified_base (232)..(232): a, c, t, g, unknown or other
  misc_feature (232)..(232): n is a, c, g, or t
  modified_base (620)..(620): a, c, t, g, unknown or other
  misc_feature (620)..(620): n is a, c, g, or t
  modified_base (636)..(636): a, c, t, g, unknown or other
  misc_feature (636)..(636): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggcctcccagacaacactgacaagaaattagttatgacgcagtctccagccacctgtctgtgtctccgagggganagacgcccaccctctcctggcgacggggccgtanaagtaattattcgaccttaaccaactttagcccttagggtaaactaccaaaacgaaaacgcccgtacggcccaaggcctacccaagtacctccctacactcctcgtggtcgctacgttccgttacggacggggccctacggttggtccgtaccccgagtcccgtaggtttcgaggttcggcgtaggtcgggtctagggaaaactaggtcgttccacttcctacaccgatcgacggtccggtcctaggctacgtacgttaggtaaagtttgttttgactttaagtttactaagtcgttacagggtacttaagttattaacgtgttaacgttggttttaatcgtacgtttcggaccgtaggaactaaggtgttattacgagtacgattgngctgactctagtcttnttcttaatc

SEQ ID NO: 318345 - DNA, 750 bp, Homo sapiens
  misc_feature: GZ8MTXP01EAHP3.10.20.B09.1.454.CMB.2.raw
  modified_base (726)..(726): a, c, t, g, unknown or other
  misc_feature (726)..(726): n is a, c, g, or t
tcagcatagtagtgcacgaccggtgctcgatttagtgtagtgtgaaggggggaactgctcagttaggacccagacggaaccatggaagccccagcgcagcttctcttcctcctgctactctggctcccagacaacactgcagaaatagttatgacgcagtctccagccacctgtctgtgtctccgaggggagagacgcccaccctctcctggcgaggggccgtcaagaattattcgacctaacctaacgttacgccttaggtaactacaaacgaaacgccgtaggaccacgggcctacccgaagtacctcctactattcctcgtggtcgctacttccgttacgggaacggggtccctacggttcgggtccgtccccaacggtcccgtaagggtttccagggttcggacccgtaggggttcggggtacgtagggaaactaacgggttactttccacgttcctaccaacctagttaccggacgggcccggtacctggtacctacgggttctaagggtaaagtttcgtttttacggactttaaggttttaactacgtggtactaacggtacgttaaagtttaattaaacggttggttaacgttttacggggtttttaactttcccggtaaccggttttcccggaacccgggttaagggtaaaccctaaagggttcggttactttacgaaacggttacgtaacgttggttacggcttacgaactacgttnttcgtcttacctcgttccgtcccg

SEQ ID NO: 318346 - DNA, 617 bp, Homo sapiens
  misc_feature: GZ8MTXP01AZGXY.10.20.B09.1.454.CMB.2.raw
  modified_base (195)..(195): a, c, t, g, unknown or other
  misc_feature (195)..(195): n is a, c, g, or t
  modified_base (230)..(230): a, c, t, g, unknown or other
  misc_feature (230)..(230): n is a, c, g, or t
  modified_base (244)..(244): a, c, t, g, unknown or other
  misc_feature (244)..(244): n is a, c, g, or t
  modified_base (268)..(268): a, c, t, g, unknown or other
  misc_feature (268)..(268): n is a, c, g, or t
  modified_base (464)..(464): a, c, t, g, unknown or other
  misc_feature (464)..(464): n is a, c, g, or t
  modified_base (597)..(597): a, c, t, g, unknown or other
  misc_feature (597)..(597): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgagggganagacgccaccctctcctgcgagggccgtcagaatntgctacatgctgancaacaagctgcagctccagactcnatctcgtggtcactattcgttcggacgggcctacgtgggtctacccgagtccgtaggttcaggtcggctagggttgggtactagggaaaacagtcgttcaaccgttcaccaccatcgacgccggtacctggacctaggttctaaggtaacgttagtttttcgacgtttaattttacgtacgttagtacgaacggtntaaagttaagttaagttcgtacgttttgggtttttaactcccgttaacgttttcccgggaacccgttagggaaccctaagggttgttacttacgaaggtaccgtaagttcggttacggcttcgacctaacctntcgttcttccgttcgtaacc

SEQ ID NO: 318347 - DNA, 690 bp, Homo sapiens
  misc_feature: GZ8MTXP01D92VK.10.20.B09.1.454.CMB.2.raw
  modified_base (228)..(228): a, c, t, g, unknown or other
  misc_feature (228)..(228): n is a, c, g, or t
  modified_base (234)..(234): a, c, t, g, unknown or other
  misc_feature (234)..(234): n is a, c, g, or t
  modified_base (305)..(305): a, c, t, g, unknown or other
  misc_feature (305)..(305): n is a, c, g, or t
tcagcatagtagtgcacgaccggtgctcgatttagtgtagtgtgaaggggggaactgctcagttaggacccagacggaaccatggaagccccagcgcagcttctcttcctcctgctactctggcctcccagacaacactgcaagaaatagttatgacgcagtctccagccaccctgtctgtgtctccgaggggagagacgcccaccctctcctggcgacgggccgtanagaatnttgctaccaacttgctgtacacaaacaaacgcctggaccaggcctcccagtcctcctcactctcgtggtcnctatcgttacggacgggtcccacgttggtcccgtacccgagtccgtagggttcacgggtcgggaccctagggtcggggtactagggaaacgagttacgttcactcctaccgacctagtccgacgggtcccggtcctgtacctaggttccttaaggtaaacgttttacgttttacgacttttaacggttttattaaccgttggttaaaccgtagttacgttaaaggttttaataaacgggtttcgtttaaacggttttgggtttttaaactttccgttaaccggttttccggacccggttaagggaaccttaaagggtcgttaactttacgaacgttacgtacgtgttcggcttacgcctactgttcctgttccttcgcgtttccc

SEQ ID NO: 318348 - DNA, 716 bp, Homo sapiens
  misc_feature: GZ8MTXP01B5UPS.10.20.B09.1.454.CMB.2.raw
  modified_base (195)..(195): a, c, t, g, unknown or other
  misc_feature (195)..(195): n is a, c, g, or t
  modified_base (207)..(207): a, c, t, g, unknown or other
  misc_feature (207)..(207): n is a, c, g, or t
  modified_base (222)..(222): a, c, t, g, unknown or other
  misc_feature (222)..(222): n is a, c, g, or t
  modified_base (281)..(281): a, c, t, g, unknown or other
  misc_feature (281)..(281): n is a, c, g, or t
  modified_base (292)..(292): a, c, t, g, unknown or other
  misc_feature (292)..(292): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgagggganagagccaccctntcctgcagggccgtnagaatattgctacaacttgcctggtatcaacaaagcctggccaggctcccagactcctnatctctggtcncattcgttcgagggccacgtggtctcccagcctaggttcaggtcggctaggtcgggtactggaaaactaggtcgttcaccttctaccaacctacgttccgaacggcccgggtcccttggacctaggttcctaaggtaaacggtttatttttcggacgttaaggttttaaacttaaccgttgggttaccctaaaggggtacgtttaaaggtttaaattaaacggtttcggtaacccggtttttagggggttttttaactttaccccggttaaccggtttttccccggggacccgttacgggggtaaacccttaaaaggggttccggttaaattttacccgaaggtaacccggtaacgtttgggttcgggttaccttggacccgttaaccttaagttccgtttacggtttcctttccgttaacccg

SEQ ID NO: 318349 - DNA, 588 bp, Homo sapiens
  misc_feature: GZ8MTXP01ASNY2.10.20.B09.1.454.CMB.2.raw
  modified_base (196)..(196): a, c, t, g, unknown or other
  misc_feature (196)..(196): n is a, c, g, or t
  modified_base (226)..(226): a, c, t, g, unknown or other
  misc_feature (226)..(226): n is a, c, g, or t
  modified_base (247)..(247): a, c, t, g, unknown or other
  misc_feature (247)..(247): n is a, c, g, or t
  modified_base (349)..(349): a, c, t, g, unknown or other
  misc_feature (349)..(349): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcaagaaatagttatgacgcagtctccagccaccctgtctgtgtctccgagggganagacgcccaccctctcctgcgagggccgtnagaatatgctacattgctgancaacaaagctggcaggctccagactcctcatctctggtcgcatcttcgaggcctacgtggtcgtccagccgtaggttcagtcggctaggtggtctggaaacngtgttcactcgtcacatcgacgccggactgactagtctaggtaacgttgtttcgacgttatttactacgttgtacgagtacgtaagttaattaacgtaggtttaccgttaggtttttactaccgttacgtttccggacccgttacgggtaaaccgtaaggttgttacgtttacgacggtaaccgtaagttcggttacgttctaacggacctaacgtcgtacgttctcctttcgtaaccc

SEQ ID NO: 318350 - DNA, 689 bp, Homo sapiens
  misc_feature: GZ8MTXP01AOHPV.10.20.B09.1.454.CMB.2.raw
  modified_base (195)..(195): a, c, t, g, unknown or other
  misc_feature (195)..(195): n is a, c, g, or t
  modified_base (209)..(209): a, c, t, g, unknown or other
  misc_feature (209)..(209): n is a, c, g, or t
  modified_base (227)..(227): a, c, t, g, unknown or other
  misc_feature (227)..(227): n is a, c, g, or t
  modified_base (490)..(490): a, c, t, g, unknown or other
  misc_feature (490)..(490): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgagggganagacgcccaccctntcctgcgacggggccgtnagtaattattcgactaaccaacttagcctggtaactacgaaacaaacgcctaggccaggctacccagacctcctcattcctcgtaggtcgtctaattccgttacgggacgggtccctacggttcgggttcgtccccgaaggtccgtaagggtttccgaggttccgggacgtagggttcggggtactaggggaaacctagggtcttcaccgttcacaccgtatcgacggtccggtcctggacctaggtctaggtaaacgttttntttacgactttaagtttactacgtacgtactagggtactaaggttattacgttaggtttacggtttcggttttacttacccggttaccgtttccgggacccgttaacgggtaaacgtaaggttcggttaacttacgaacgttacggtaagttcggttacgttcctaagcctaacgtgttcgttcgttaaccttcgtccg

SEQ ID NO: 318351 - DNA, 554 bp, Homo sapiens
  misc_feature: GZ8MTXP02G76JC.10.20.B09.1.454.CMB.2.raw
  modified_base (193)..(193): a, c, t, g, unknown or other
  misc_feature (193)..(193): n is a, c, g, or t
  modified_base (220)..(220): a, c, t, g, unknown or other
  misc_feature (220)..(220): n is a, c, g, or t
  modified_base (398)..(398): a, c, t, g, unknown or other
  misc_feature (398)..(398): n is a, c, g, or t
tcagcatagtagtgcacgaccggtgctcgatttagtgtagtgtgaagggggaactgctcagttaggacccagacggaaccatggaagccccagcgcagcttctcttcctcctgctactctggctcccagacaacactgcaagaaatagttatgacgcagtctccagccaccctgtctgtgtctccgagggganagagccaccctctcctgcagggccgtnagaatattgctaccaacttagcctggtatcaaacaaaagcctggccaggcctcccagacctcctcatctcgtggtgctatcttcggaggccacgtggtcgtcccagccaggttcaggtggccaggtggtctggaacagagttcactctcaccatcagccggcctgcagtctagaagtntttgctagtttatactgtacagctagttataatgtacgttgggttttatcgtacgtttcggcccgtagggaacctaaaggttcggtatttcgaacggtaacgtaacgttggtacggtctagaaccgtacctagttctagtcctttacactttcccg

SEQ ID NO: 318352 - DNA, 514 bp, Homo sapiens
  misc_feature: GZ8MTXP02IWXZ5.10.20.B09.1.454.CMB.2.raw
  modified_base (193)..(193): a, c, t, g, unknown or other
  misc_feature (193)..(193): n is a, c, g, or t
  modified_base (290)..(290): a, c, t, g, unknown or other
  misc_feature (290)..(290): n is a, c, g, or t
  modified_base (349)..(349): a, c, t, g, unknown or other
  misc_feature (349)..(349): n is a, c, g, or t
  modified_base (384)..(384): a, c, t, g, unknown or other
  misc_feature (384)..(384): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccacctgtctgtgtctccagggganagagccacctctcctgcagggccgtcagaatattgctaccaacttagcctggtatcaacaaagcctggccaggctcccagactcctcatctctggtncatcttcgaggccactggtcgtcccagcctaggttcagtggcagtgggtctggaacagngttcactctcaccatcagcgctgcagtctgaagtntttgctagtttatactgtcagctagtataatgacttggtttatctacgtttcggccgtgggaacctaaaggtggtaatttcgaagtacgtaacgtgtacggtctgcctaccgtatctacgttcttactac

SEQ ID NO: 318353 - DNA, 501 bp, Homo sapiens
  misc_feature: GZ8MTXP02HE62K.10.20.B09.1.454.CMB.2.raw
  modified_base (292)..(292): a, c, t, g, unknown or other
  misc_feature (292)..(292): n is a, c, g, or t
  modified_base (348)..(348): a, c, t, g, unknown or other
  misc_feature (348)..(348): n is a, c, g, or t
  modified_base (350)..(350): a, c, t, g, unknown or other
  misc_feature (350)..(350): n is a, c, g, or t
  modified_base (386)..(386): a, c, t, g, unknown or other
  misc_feature (386)..(386): n is a, c, g, or t
tcagcatagtagtgcacgaccggtgctcgatttagtgtagtgtgaaggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaagcctggccaggctcccagactcctcatctctggtncatctcgaggccactggtcgtcccagcctaggtcagtcggcagtgggtctggaacngngttcactctcaccatcagccgctgcagtctgaagtntttgctagtttatactgtcagctagtatatgacttggtttatcgtactttcggcctgggactaaggtgtattcagtacgtaactgtagctgctaccgtatcgtacgtccttacac

SEQ ID NO: 318354 - DNA, 507 bp, Homo sapiens
  misc_feature: GZ8MTXP02FXL73.10.20.B09.1.454.CMB.2.raw
  modified_base (193)..(193): a, c, t, g, unknown or other
  misc_feature (193)..(193): n is a, c, g, or t
  modified_base (349)..(349): a, c, t, g, unknown or other
  misc_feature (349)..(349): n is a, c, g, or t
  modified_base (351)..(351): a, c, t, g, unknown or other
  misc_feature (351)..(351): n is a, c, g, or t
  modified_base (360)..(360): a, c, t, g, unknown or other
  misc_feature (360)..(360): n is a, c, g, or t
  modified_base (386)..(386): a, c, t, g, unknown or other
  misc_feature (386)..(386): n is a, c, g, or t
  modified_base (504)..(504): a, c, t, g, unknown or other
  misc_feature (504)..(504): n is a, c, g, or t
tcagcatagtagtgcacgaccggtgctcgatttagtgtagtgtgaaggggaggaactgctcagttaggacccagacggaaccatggaagccccagcgcagcttctcttcctcctgctactctggctcccagacaacactgcagaaatagttatgacgcagtctccagccaccctgtctgtgtctccagggganagagccaccctctcctgcagggccgtcagaatattgctaccaacttagcctggtatcaaacaaagcctggccaggctcccagactcctcatctctggtgcatcttcgagggccactggtgtcccagccaggttcagtcggcagtgggtctggaacngngttcactcncaccatcagcgctgcagtctgaaagnttttgctagtttatactagtcagcagtataatgacgttgggtttattctactttcggcctggggaacctaaaaggtggtatttcgaagtacgaactgtgctgcacctatctgtccttntac

SEQ ID NO: 318355 - DNA, 507 bp, Homo sapiens
  misc_feature: GZ8MTXP02IKOBF.10.20.B09.1.454.CMB.2.raw
  modified_base (350)..(350): a, c, t, g, unknown or other
  misc_feature (350)..(350): n is a, c, g, or t
  modified_base (352)..(352): a, c, t, g, unknown or other
  misc_feature (352)..(352): n is a, c, g, or t
  modified_base (495)..(495): a, c, t, g, unknown or other
  misc_feature (495)..(495): n is a, c, g, or t
tcagcatagtagtgcacgaccggtgctcgatttagtgtagtgtgaaggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaagcctggccaggctcccagacctcctcatctctggtgcatcttcgagggccacgtggtgtcccagccaggttcagtggcagtgggtctggaacngngttcactctcacatcagcgctgcagtctgaagtatttgactagttatctgtcagctagtataatgacttggtttatctactttcggcccttagggacctaaaaggtcggtatttcgaagtacgtactggtcggactgcaactntctcgttctctc

SEQ ID NO: 318356 - DNA, 541 bp, Homo sapiens
  misc_feature: GZ8MTXP02JESGG.10.20.B09.1.454.CMB.2.raw
  modified_base (291)..(291): a, c, t, g, unknown or other
  misc_feature (291)..(291): n is a, c, g, or t
  modified_base (352)..(352): a, c, t, g, unknown or other
  misc_feature (352)..(352): n is a, c, g, or t
  modified_base (389)..(389): a, c, t, g, unknown or other
  misc_feature (389)..(389): n is a, c, g, or t
tcagcatagtagtgcacgaccggtgctcgatttagtgtagtgtgaagggggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatatgctaccaacttagcctggtatcaacaaaagcctggccaggctcccagacctcctcatctctggtncatcttcgaggccacgtggtcgtcccagccaggttcaggtggccagtgggtctggaacagngttcactctcaccatcagcggcctgcagtctgaagtntttgactagtttatactgttcagctagttataatgtaacgttgggttttatctacgtttcggcccttaggggaaccctaaaaggttcggtatttacgacgaaccgtaacgttgtcggctcggaacacctaatctgttccttacactttcccg

SEQ ID NO: 318357 - DNA, 538 bp, Homo sapiens
  misc_feature: GZ8MTXP02GBVFN.10.20.B09.1.454.CMB.2.raw
  modified_base (195)..(195): a, c, t, g, unknown or other
  misc_feature (195)..(195): n is a, c, g, or t
  modified_base (294)..(294): a, c, t, g, unknown or other
  misc_feature (294)..(294): n is a, c, g, or t
  modified_base (359)..(359): a, c, t, g, unknown or other
  misc_feature (359)..(359): n is a, c, g, or t
  modified_base (361)..(361): a, c, t, g, unknown or other
  misc_feature (361)..(361): n is a, c, g, or t
  modified_base (400)..(400): a, c, t, g, unknown or other
  misc_feature (400)..(400): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgagggganagagccaccctctcctgcagggccgtcagaatattgctaccaacttagcctggtatcaaacaaagcctggccaggctcccagactcctcatctctggtncatcttcggagggccacgtggtcgtcccagcctaggttccaggtcggcaggtgggtctaggaacngngttcactctaccacatcgagcgcctgcagtctagaagtnttttgcttagtttactacgtgtcagctagtatatgtacgtttgggtttactcgtacgtttcggccgtagggacctaaagtcggtatttcgaagtacgtacgtgtacgctcgacacctatccgtagttccttactaccg

SEQ ID NO: 318358 - DNA, 503 bp, Homo sapiens
  misc_feature: GZ8MTXP02GC05H.10.20.B09.1.454.CMB.2.raw
  modified_base (193)..(193): a, c, t, g, unknown or other
  misc_feature (193)..(193): n is a, c, g, or t
  modified_base (291)..(291): a, c, t, g, unknown or other
  misc_feature (291)..(291): n is a, c, g, or t
  modified_base (349)..(349): a, c, t, g, unknown or other
  misc_feature (349)..(349): n is a, c, g, or t
  modified_base (351)..(351): a, c, t, g, unknown or other
  misc_feature (351)..(351): n is a, c, g, or t
  modified_base (385)..(385): a, c, t, g, unknown or other
  misc_feature (385)..(385): n is a, c, g, or t
tcagcatagtagtgcacgaccggtgctcgatttagtgtagtgtgaaggggaggaactgctcagttaggacccagacggaaccatggaagccccagcgcagcttctcttcctcctgctactctggctcccagacaacactgcagaaatagttatgacgcagtctccagccaccctgtctgtgtctccagggganagagccaccctctcctgcagggccgtcagaatattgctaccaacttagcctggtatcaacaaagcctggccaggctcccagactcctcatctctggtncatcttcgagggccactggtctcccagccaggttcaggtcggcagtgggtctggaacngngttcactctcaccatcagcgctgcagtctgagtnttttgctagtttattactgtcagctagtataatgtacttgggttttatctacttcgcctgggacctaaaggtggtatttcgagacgtaacgtgtggctgcacgtatcgtgtcttctac

SEQ ID NO: 318359 - DNA, 559 bp, Homo sapiens
  misc_feature: GZ8MTXP02IWCYB.10.20.B09.1.454.CMB.2.raw
  modified_base (191)..(191): a, c, t, g, unknown or other
  misc_feature (191)..(191): n is a, c, g, or t
  modified_base (290)..(290): a, c, t, g, unknown or other
  misc_feature (290)..(290): n is a, c, g, or t
tcagcatagtagtgcacgaccggtgctcgatttagtgtagtgtgaagggggaactgctcagttaggacccagacggaaccatggaagccccagcgcagcttctcttcctcctgctactctggctcccagacaacactgcagaaatagttatgacgcagtctccagccaccctgtctgtgtctccagggganagagccaccctctcctgcagggccgtcagaatattgctaccaacttagcctggtatcaaacaaaagcctggccaggctccagactcctcatctctggtncatctcgaggccacgtggtcgtcccagccaggttcagtggcctaggtggtctggaacagagttcactctacaccatcacgcggcctgctagtctagaagtatttgacttagtttatactgtacagctagttataagtgtaacttgggttttactctacgtttcggcccgttagggaacctaaaggttcggtatttacgaacggtacgtaacgttggtacggcttacgaacctaaccgtaattccgttagttcccttactactttccccg

SEQ ID NO: 318360 - DNA, 546 bp, Homo sapiens
  misc_feature: GZ8MTXP02GPNAF.10.20.B09.1.454.CMB.2.raw
  modified_base (362)..(362): a, c, t, g, unknown or other
  misc_feature (362)..(362): n is a, c, g, or t
  modified_base (404)..(404): a, c, t, g, unknown or other
  misc_feature (404)..(404): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgaggggagagagcccaccctctcctgcagggccggtcaagaatattgctaaccaacttagcctggtatacaaacaaagcctggccaggcctcccagactcctcatctctggtgcatctcggaggccacgtggtctcccagcctaggttcaggtcggcaggtgggtctagggaacngtacgttcactctacaccatcagccgcctgcagtctagaatnttttgacttagtttactacttgacagtactagtataagtgtacgtttggtttatctacgttcggccgtagggaaccaaaggttcgatttcgaaggtacgtacgtggtcggtctgacctactacttcgtcgttccttactacc

SEQ ID NO: 318361 - DNA, 494 bp, Homo sapiens
  misc_feature: GZ8MTXP02F2A1H.10.20.B09.1.454.CMB.2.raw
  modified_base (193)..(193): a, c, t, g, unknown or other
  misc_feature (193)..(193): n is a, c, g, or t
  modified_base (293)..(293): a, c, t, g, unknown or other
  misc_feature (293)..(293): n is a, c, g, or t
  modified_base (345)..(345): a, c, t, g, unknown or other
  misc_feature (345)..(345): n is a, c, g, or t
  modified_base (347)..(347): a, c, t, g, unknown or other
  misc_feature (347)..(347): n is a, c, g, or t
  modified_base (381)..(381): a, c, t, g, unknown or other
  misc_feature (381)..(381): n is a, c, g, or t
tcagcatagtagtgcacgaccggtgctcgatttagtgtagtgtgaaggggaggaactgctcagttaggacccagacggaaccatggaagccccagcgcagcttctcttcctcctgctactctggctcccagacaacactgcagaaatagttatgacgcagtctccagccaccctgtctgtgtctccagggganagagccaccctctcctgcagggccggtcagaatattgctaccaacttagcctggtatcaaacaaagcctggccaggctcccagactcctcatctctggtncatcttcgaggccatggtctcccagccaggttcagtgcagtggtctggaacngngttcactctcacatcagcgctgcagtctgaagtnttttgctagtttatactgtcagtcagtataatgtacttgggtttatctacgtttcggcctgggacctaaagtgatttcagacgtactgtcgctgacacgtatctgtcttctac

SEQ ID NO: 318362 - DNA, 656 bp, Homo sapiens
  misc_feature: GZ8MTXP02HAF8O.10.20.B09.1.454.CMB.2.raw
  modified_base (198)..(198): a, c, t, g, unknown or other
  misc_feature (198)..(198): n is a, c, g, or t
  modified_base (227)..(227): a, c, t, g, unknown or other
  misc_feature (227)..(227): n is a, c, g, or t
  modified_base (267)..(267): a, c, t, g, unknown or other
  misc_feature (267)..(267): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggcctcccagacaacactgcaagaaatagttatgacgcagtctccagcccaccctgtctgtgtctccgagggganagacgcccaccctctcctgcagggccgtnagaatattgctaccaacttgcctggtatcaaacaaagccnggccaggcctcccagacctcctcactcgtccggtgctatccgttcggacggcctacgtcggtcgtcccagccctaagggttcaggtggccctaggtcggggtactagggaacaggtacgtttccactactccaacctatcgaggtcccggccctggcctaaggttctaggtaaagttatttttcggacttaagttttacttaccgtgttacgacgtataagttaataattcggttaacgtttgggttttaacttccgttaccgttttccgggaccccgttaggggtaaaaccctaagggttcggtatttaccgaaacggtaacgtaacgttggtacgggtcttacggaacctaaacgtacttcgtcgtttaccttcctaactttccccg

SEQ ID NO: 318363 - DNA, 504 bp, Homo sapiens
  misc_feature: GZ8MTXP02FXMP7.10.20.B09.1.454.CMB.2.raw
  modified_base (218)..(218): a, c, t, g, unknown or other
  misc_feature (218)..(218): n is a, c, g, or t
  modified_base (350)..(350): a, c, t, g, unknown or other
  misc_feature (350)..(350): n is a, c, g, or t
tcagcatagtagtgcacgaccggtgctcgatttagtgtagtgtgaagggggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccgtnagaatattgctaccaacttagcctggtatcaacaaaagcctggccaggctccccagactcctcatctctggtgcatcttcgagggccactggtcgtcccagcccaggttcagtggccagtgggtctggaacngattcactctcaccatcagcgcctgcagtctgaatatttgctagtttatactgtacagcagtatatgacttggtttatctacgtttcggccctagggaccaagtcgtatttacagacgtaactgtacgcttgccactatctgtcttcacttccc

SEQ ID NO: 318364 - DNA, 504 bp, Homo sapiens
  misc_feature: GZ8MTXP02GGM4M.10.20.B09.1.454.CMB.2.raw
  modified_base (194)..(194): a, c, t, g, unknown or other
  misc_feature (194)..(194): n is a, c, g, or t
  modified_base (347)..(347): a, c, t, g, unknown or other
  misc_feature (347)..(347): n is a, c, g, or t
  modified_base (382)..(382): a, c, t, g, unknown or other
  misc_feature (382)..(382): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccagggganagagccaccctctcctgcagggccgtcagaatattgctaccaattagcctggtatcaacaaagcctggccaggctcccagactcctcatctctggtgcatcttcgagggccactggtgtcccagccaggttcagtggcagtggtctggacagngttcactctcaccatcagcgctgcagtctgaagtnttttgctagtttactactgtcagctagtataatgtacttgggttttatctactttcggccctagggacctaaaggttggatttcgagtacgaactgtagctgcacctatctcgtcttactac

SEQ ID NO: 318365 - DNA, 628 bp, Homo sapiens
  misc_feature: GZ8MTXP02GYMAO.10.20.B09.1.454.CMB.2.raw
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccacctgtctgtgtctccgaggggagagacgcccaccctctcctgcgagggccgtcagaatattgctaccaacttagcctggtatacaaacaaagcctggaccaggcctcccagacctccctcactcctcgtggtgctatccgttcggacgggccctacgttcgggtcgtcccagtccctaggttcaggtcggcgtagggtgggtctagggaaacaggtacgttccactccgtaccaacctatacgaggcccggtcctggacctagtctaggtaaagttcttttggacttaagtttactacgttgtacgaagtcgtaagttataagttcgtaacgtttagggttttacttcgttaccgtttccgggaccgttacggggaaacctaaaggtcggtaactttcgaaggtaaccgtaacgtggtcggtctaacgacaaccgtatccttagttaccttctaccg

SEQ ID NO: 318366 - DNA, 574 bp, Homo sapiens
  misc_feature: GZ8MTXP02I1ZLK.10.20.B09.1.454.CMB.2.raw
  modified_base (196)..(196): a, c, t, g, unknown or other
  misc_feature (196)..(196): n is a, c, g, or t
  modified_base (225)..(225): a, c, t, g, unknown or other
  misc_feature (225)..(225): n is a, c, g, or t
  modified_base (231)..(231): a, c, t, g, unknown or other
  misc_feature (231)..(231): n is a, c, g, or t
  modified_base (262)..(262): a, c, t, g, unknown or other
  misc_feature (262)..(262): n is a, c, g, or t
  modified_base (413)..(413): a, c, t, g, unknown or other
  misc_feature (413)..(413): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcaagaaatagttatgacgcagtctccagccaccctgtctgtgtctccgagggganagacgcccaccctctcctgcagggccgtnagaatnttgctacaattagctggtatcaacaaagccnggccaggcctcccagacctcctcatctcgtggtgcatcgttcgagggccacgtggtcgtcccagccgtaggttcaggtcggctagggtgggtctaggaacagtagttccacttcctacaacctatccaggccgcctggcagtctagaattntttgacttagtttatacgttgttacagtactaagtattaagtgttaacgtttgggtttacttcgtacgtttccggacccgttagggaaaccttaaaggtcggtaatttacgaaagacgtaacgtggtcgcgtaagcctaactacgtctcgttacttctacg

SEQ ID NO: 318367 - DNA, 496 bp, Homo sapiens
  misc_feature: GZ8MTXP02HC16K.10.20.B09.1.454.CMB.2.raw
  modified_base (191)..(191): a, c, t, g, unknown or other
  misc_feature (191)..(191): n is a, c, g, or t
  modified_base (203)..(203): a, c, t, g, unknown or other
  misc_feature (203)..(203): n is a, c, g, or t
  modified_base (218)..(218): a, c, t, g, unknown or other
  misc_feature (218)..(218): n is a, c, g, or t
  modified_base (245)..(245): a, c, t, g, unknown or other
  misc_feature (245)..(245): n is a, c, g, or t
  modified_base (249)..(249): a, c, t, g, unknown or other
  misc_feature (249)..(249): n is a, c, g, or t
  modified_base (251)..(251): a, c, t, g, unknown or other
  misc_feature (251)..(251): n is a, c, g, or t
  modified_base (257)..(257): a, c, t, g, unknown or other
  misc_feature (257)..(257): n is a, c, g, or t
  modified_base (267)..(267): a, c, t, g, unknown or other
  misc_feature (267)..(267): n is a, c, g, or t
  modified_base (276)..(276): a, c, t, g, unknown or other
  misc_feature (276)..(276): n is a, c, g, or t
  modified_base (292)..(292): a, c, t, g, unknown or other
  misc_feature (292)..(292): n is a, c, g, or t
  modified_base (323)..(323): a, c, t, g, unknown or other
  misc_feature (323)..(323): n is a, c, g, or t
  modified_base (334)..(334): a, c, t, g, unknown or other
  misc_feature (334)..(334): n is a, c, g, or t
  modified_base (366)..(366): a, c, t, g, unknown or other
  misc_feature (366)..(366): n is a, c, g, or t
tcagcatagtagtgcacgaccggtgctcgatttagtgtagtgtgaagggggaactgctcagttaggacccagacggaaccatggaagccccagcgcagcttctcttcctcctgctactctggctcccagacaacactgcaagaaatagttatgacgcagtctccagccacctgtctgtgtctccagggganagagccaccctntcctgcagggccgtnagaatatgctacaattgcctgatcaanaaancngcagcnccagactctnatctctgtncatctcgaggcatgtntccagccagttcagtgcagtggtctggaacngagttcactcncaccgatcagcggctgcatctgaagtattgtntagttattatgtatatatataataatagtagttagtttagttactacgttcgtccgtacgtaacgtaaagtacgtagttactacgaacgtaacgtacgtcgtcgtcgaacgactactctcgtctctactc

SEQ ID NO: 318368 - DNA, 546 bp, Homo sapiens
  misc_feature: GZ8MTXP02IT5IX.10.20.B09.1.454.CMB.2.raw
  modified_base (194)..(194): a, c, t, g, unknown or other
  misc_feature (194)..(194): n is a, c, g, or t
  modified_base (282)..(282): a, c, t, g, unknown or other
  misc_feature (282)..(282): n is a, c, g, or t
  modified_base (292)..(292): a, c, t, g, unknown or other
  misc_feature (292)..(292): n is a, c, g, or t
  modified_base (313)..(313): a, c, t, g, unknown or other
  misc_feature (313)..(313): n is a, c, g, or t
  modified_base (347)..(347): a, c, t, g, unknown or other
  misc_feature (347)..(347): n is a, c, g, or t
  modified_base (349)..(349): a, c, t, g, unknown or other
  misc_feature (349)..(349): n is a, c, g, or t
  modified_base (387)..(387): a, c, t, g, unknown or other
  misc_feature (387)..(387): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccagggganagagccaccctctcctgcagggccgtcagaatattgctaccaacttagcctggtatcaacaaagcctggccaggctcccagactcctnatctctggtncatcttcgagggccactggtntcccagccaggttcagtggcagtggtctggaacngngttcactctcaccatcagcgcctgcagtctgaaagttntttgacttagtttattactgtacagtactagttatagtgtacgtttgggttttacttcgtacgtttccggaccgtagggtaacctaaaggttgttaactttacgaacgtaacgtacgttcggtcggtactgacctactacttcttcgttacttactacg

SEQ ID NO: 318369 - DNA, 541 bp, Homo sapiens
  misc_feature: GZ8MTXP02HMP7H.10.20.B09.1.454.CMB.2.raw
tcagcatagtagtgcacgaccggtgctcgatttagtgtagtgtgaagggggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccgtcagaatattgctaccaacttagcctggtatcaacaaaagcctggccaggctcccagactcctcatctctggtgctatcttcgaggccacgtggtcgtcccagccaggttcagtggccagtgggtctggaacagagttcactctcaccatcagccggcctgcagtctagaagttattttgacttagtttattactgtacagactagttataattgtacttgggttttattctacgtttcggccctagggaacctaaaagtggtatttcgacgtaacgtaacttcggtggctcgaactacctattcgtattccttctactttcccg

SEQ ID NO: 318370 - DNA, 563 bp, Homo sapiens
  misc_feature: GZ8MTXP02GGETR.10.20.B09.1.454.CMB.2.raw
  modified_base (195)..(195): a, c, t, g, unknown or other
  misc_feature (195)..(195): n is a, c, g, or t
  modified_base (230)..(230): a, c, t, g, unknown or other
  misc_feature (230)..(230): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgagggganagacgccaccctctcctgcagggccggtcagaatnttgctaccaacttagcctggtatacaaacaaagcctggccaggcctcccagacctcctcatctctggtgcatcttcggaggcctacgtgggtcgtcccagcctaggttcaggtcggctaggtgggtctaggaacagtgttcactctcaccatcagcggcctgcagtctagtaacgtatttttgacttagtttactactgtacagtactagtataaagtgtaacgtttggtttatcgtacgtttcggacccgttagggaacctaaaggtggtaatttcgaagtacgtaacgtggtaggtactggtacctacctacgttctacgttctttactac

SEQ ID NO: 318371 - DNA, 569 bp, Homo sapiens
  misc_feature: GZ8MTXP02HC1V1.10.20.B09.1.454.CMB.2.raw
  modified_base (195)..(195): a, c, t, g, unknown or other
  misc_feature (195)..(195): n is a, c, g, or t
  modified_base (223)..(223): a, c, t, g, unknown or other
  misc_feature (223)..(223): n is a, c, g, or t
  modified_base (406)..(406): a, c, t, g, unknown or other
  misc_feature (406)..(406): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgagggganagagcccaccctctcctgcagggccgtnagaatattgctaccaattagcctggtatacaaacaaagcctggccaggctcccagactcctcatctctggtgctatcttacggacggcctacgtgggtcgtcccagccgtaggttcagtcggcaggtcgggtctaggaacaggtgttccactctacaccatcaggccgctgcagtcagaagtntttgacttaagtttatactgtacagtactagtaattaagtgtacgtttggtttactcgtacgtttccggaccgttagggaacctaaaggttcggtatttacgaacggtaacgtaacgttggtcggtactgtaccaccgttattccgttcgttcctttactacc

SEQ ID NO: 318372 - DNA, 632 bp, Homo sapiens
  misc_feature: GZ8MTXP02HI6F5.10.20.B09.1.454.CMB.2.raw
  modified_base (194)..(194): a, c, t, g, unknown or other
  misc_feature (194)..(194): n is a, c, g, or t
  modified_base (412)..(412): a, c, t, g, unknown or other
  misc_feature (412)..(412): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccagggganagagccaccctctcctgcagggccgtcagaatattgctaccattgcctggtatcaacaaagcctggccaggcctccagactcctcatctctggtgctatcttcgagggccacgtgggtcgtcccagcccaggttcaggtcggcaggtcgggtctagggaacaggcgttcacgtcctacacctagtccaggccggccttggcctagttctagaacgttnttttcggacttaagttttactacgttggtactagactagttaataagttagtacgtttagggttttacttcgttaccgtttccgggaccccgttaggggtaaacccgtaaaagggttcgggtaaacttttaccggaaacggttaaaccggtaaaccgttggttacgggacttaacggacctaaccgttacgttaccgtttcggttacctttaccgtaccg

SEQ ID NO: 318373 - DNA, 527 bp, Homo sapiens
  misc_feature: GZ8MTXP02HU02E.10.20.B09.1.454.CMB.2.raw
  modified_base (191)..(191): a, c, t, g, unknown or other
  misc_feature (191)..(191): n is a, c, g, or t
  modified_base (337)..(337): a, c, t, g, unknown or other
  misc_feature (337)..(337): n is a, c, g, or t
  modified_base (342)..(342): a, c, t, g, unknown or other
  misc_feature (342)..(342): n is a, c, g, or t
  modified_base (353)..(353): a, c, t, g, unknown or other
  misc_feature (353)..(353): n is a, c, g, or t
tcagcatagtagtgcacgaccggtgctcgatttagtgtagtgtgaagggggaactgctcagttaggacccagacggaaccatggaagccccagcgcagcttctcttcctcctgctactctggctcccagacaacactgcagaaatagttatgacgcagtctccagccaccctgtctgtgtctccagggganagagccaccctctcctgcagggccgtcagaatattgctaccaattagcctggtatcaacaaaagcctggccaggctcccagactcctcatctctggtgcatcttgacggccactggtcgtcccagccaggttcagtgcagtggtcnggacngagttcactcncacctatcagcggctgcagtctgaagtattttgctagtttattactgtcagctagttatatgtacttggtttatcgtacgtttcggacctgggaacctaaaggtcgtatttcgaacgtactaaactggtacggtctggaacctaaccgattccgtgtttcctttacactttccg

SEQ ID NO: 318374 - DNA, 547 bp, Homo sapiens
  misc_feature: GZ8MTXP02FSY1Q.10.20.B09.1.454.CMB.2.raw
  modified_base (251)..(251): a, c, t, g, unknown or other
  misc_feature (251)..(251): n is a, c, g, or t
  modified_base (297)..(297): a, c, t, g, unknown or other
  misc_feature (297)..(297): n is a, c, g, or t
  modified_base (400)..(400): a, c, t, g, unknown or other
  misc_feature (400)..(400): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgaggggagagagccaccctctcctgcagggccgtcagaatattgctaccaacttagcctggtanacaaacaaagcctggccaggcctcccagacctcctcatctctggtncatcttcgagggccacgtggtcgtcccagcccaggtccaggtcggcaggtgggtctaggaacagtcgttcacttctacacatcagcgcctgcagtctagaatnttttgacttagtttatctgtcagactagtaataagtgtaacgtttggtttatctacgtttccggccgttaggggaacctaaaagttggtaatttcgaaagtacgtaacgtggtggactgaccactacttcgttacgtccttactacc

SEQ ID NO: 318375 - DNA, 588 bp, Homo sapiens
  misc_feature: GZ8MTXP02H20RX.10.20.B09.1.454.CMB.2.raw
  modified_base (228)..(228): a, c, t, g, unknown or other
  misc_feature (228)..(228): n is a, c, g, or t
  modified_base (359)..(359): a, c, t, g, unknown or other
  misc_feature (359)..(359): n is a, c, g, or t
  modified_base (369)..(369): a, c, t, g, unknown or other
  misc_feature (369)..(369): n is a, c, g, or t
  modified_base (373)..(373): a, c, t, g, unknown or other
  misc_feature (373)..(373): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgaggggagagagccaccctctcctgcagggccgtcagaatnttgctaccaattagcctggtatcaacaaagcctggccaggcctcccagacctcctcatctctggtgctatccgttcggacggccacgtggtcgtcccagcctaggttcaggtggcaggtgggtctggaacngtgtcactcncacntcacgcgctgcagtctagaagttatttgcttagtttattactgttcagtctagttaataagtgtactttggggttttattccgtacgttttccgggaccgttagggggtaaacctaaaggttcgggttaaacttttacgaacggtaaacgtaaccgttaggtcgggaccttaaggccctaaccgtactttccgttcggtttacctttaccgaccg

SEQ ID NO: 318376 - DNA, 496 bp, Homo sapiens
  misc_feature: GZ8MTXP02IVWG4.10.20.B09.1.454.CMB.2.raw
  modified_base (314)..(314): a, c, t, g, unknown or other
  misc_feature (314)..(314): n is a, c, g, or t
  modified_base (349)..(349): a, c, t, g, unknown or other
  misc_feature (349)..(349): n is a, c, g, or t
  modified_base (384)..(384): a, c, t, g, unknown or other
  misc_feature (384)..(384): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccgtcagaatattgctaccaacttagcctggtatcaaacaaagcctggccaggctcccagacctcctcatctctggtgcatcttcgaggccactggtntcccagccaggttcagtgcagtggtctggaacagngttcactctcaccatcagcgctgcagtctgaagtntttgctagttatactgtcagctagtataatgacttggtttatctacgtttcgcctgggacctaaagtggtatttcgagtacgacgtgtggctgcacattctcgttcttctac

SEQ ID NO: 318377 - DNA, 699 bp, Homo sapiens
  misc_feature: GZ8MTXP02IQ3S2.10.20.B09.1.454.CMB.2.raw
  modified_base (195)..(195): a, c, t, g, unknown or other
  misc_feature (195)..(195): n is a, c, g, or t
  modified_base (222)..(222): a, c, t, g, unknown or other
  misc_feature (222)..(222): n is a, c, g, or t
  modified_base (280)..(280): a, c, t, g, unknown or other
  misc_feature (280)..(280): n is a, c, g, or t
  modified_base (285)..(285): a, c, t, g, unknown or other
  misc_feature (285)..(285): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagcccaccctgtctgtgtctccagggganagagccaccctctcctgcagggccgtnagaatatgctacaattgcctggtatcaacaaagctgccaggctccagactctcatctntggtnctatcgttcggaggccacgtggtcgtcccagacaggttcaggtcggcaggtcgggtactaggaactaggtacgtttccaacgttcctaccaaccctaagtccgaacggtcccgggacccttggacccgtaacggttccgttaaggtaaaaggtttatttttcggaccgttaaaggtttttactttaaccgttcgggttacctaaagtaccgttaaaggtttaattaaaaggttcgtaaaaccggttttgggtttttaacttacccgtaacgttttcccggggtacccccgttaagggggtaaacccttaaaagggttcggtaaattttccggaaaggttaaaccgtaaccgttggtacgggtaccttaaggaccctaaaccctgttaccttcggttaccgttttaccgtaaccg

SEQ ID NO: 318378 - DNA, 594 bp, Homo sapiens
  misc_feature: GZ8MTXP02JNDPS.10.20.B09.1.454.CMB.2.raw
tcagcatagtagtgcacgaccggtgctcgatttagtgtagtgtgaagggggaactgctcagttaggacccagacggaaccatggaagccccagcgcagcttctcttcctcctgctactctggctcccagacaacactgcagaaatagttatgacgcagtctccagccaccctgtctgtgtctccgaggggagagagccacccctctcctgcagggccgtcagaatatgctaccaacttgcctggtatcaacaaaagcctggccaggctcccagactcctcatctctggtgctatcttcgagggccacgtggtcgtcccagcctaggttcaggtggccgaggtgggtctagggacagtagttcactctcgaccatcgagccggctgcagtctgaagtatttgacttagtttattactgtacagtactagttataacttgtacgtttgggttttatacgttacgtttccgggacccgttaggggtaaacctaaagggttggttactttacgaacggtaaccggtaaacgttcgggtacggcttacggaacctaaccgttacgttcgttacggtttccctttacgtacgtttccccg

SEQ ID NO: 318379 - DNA, 742 bp, Homo sapiens
  misc_feature: GZ8MTXP02G25KW.10.20.B09.1.454.CMB.2.raw
  modified_base (195)..(195): a, c, t, g, unknown or other
  misc_feature (195)..(195): n is a, c, g, or t
  modified_base (295)..(295): a, c, t, g, unknown or other
  misc_feature (295)..(295): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgagggganagagccaccctctcctgcagggccgtcagaatattgctaccaattagcctggtatacaacaaagcctggccaggcctcccagacctcctcatctctggtncatcttcggagggccacgtggtcgtcccaggccctaggttcaggtcggcgaggtgggtctagggaacaggtcgttccacttcctaccaacctatccgaacgggtccgggtcccttgggacctacggttccgttaaggtaaaagttacgtttttcgggaacctttaaaggtttttaaactttaaccgttagggtttaccaaagggtccttaaaaggtttaaactttaaacggtttaggttaaaccggtttttagggggttttttaaactttacccggtttaaacccggttttttcccgggggaccccgtttaacgggggtaaaaccccttaaaaaggggtttcgggttaaactttttacccggaaagggttaaaccggtaaacgttcgggttcgggtactttcggaccctaacccttagttccgttacgtttcctttacgttaacccg

SEQ ID NO: 318380 - DNA, 533 bp, Homo sapiens
  misc_feature: GZ8MTXP02IHT3L.10.20.B09.1.454.CMB.2.raw
  modified_base (354)..(354): a, c, t, g, unknown or other
  misc_feature (354)..(354): n is a, c, g, or t
  modified_base (379)..(379): a, c, t, g, unknown or other
  misc_feature (379)..(379): n is a, c, g, or t
  modified_base (382)..(382): a, c, t, g, unknown or other
  misc_feature (382)..(382): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgaggggagagagccaccctctcctgcagggccgtcagaatatgctaccaattagcctggtatacaaacaaagcctggccaggcctcccagacctcctcatctctggtgcatcttcggaggccagtggtctcccagccaggttcagtcggctaggtgggtctggaacngtgttcactctacaccatcagcgcngcngtctagagtattttgcttaagtttatactgtcagtctaagttataagttgtaacgtttggttttatcgttacgttcgacccgtagggtacctaaagtggtatttcaagacgtactcggtgcttaacgcctactactcgttcttcttactcc

SEQ ID NO: 318381 - DNA, 573 bp, Homo sapiens
  misc_feature: GZ8MTXP02JHRU7.10.20.B09.1.454.CMB.2.raw
  modified_base (192)..(192): a, c, t, g, unknown or other
  misc_feature (192)..(192): n is a, c, g, or t
  modified_base (296)..(296): a, c, t, g, unknown or other
  misc_feature (296)..(296): n is a, c, g, or t
  modified_base (411)..(411): a, c, t, g, unknown or other
  misc_feature (411)..(411): n is a, c, g, or t
tcagcatagtagtgcacgaccggtgctcgatttagtgtagtgtgaagggggaactgctcagttaggacccagacggaaccatggaagccccagcgcagcttctcttcctcctgctactctggctcccagacaacactgcagaaatagttatgacgcagtctccagccaccctgtctgtgtctccgagggganagacgccaccctctcctgcgagggccggtcagaatattgctaccaacttagcctggtatcaaacaaaagcctggccaggcctccagactcctcatctcgtggtnctatcttcggaggccacgtggtcgtcccagccctaggttcaggtgccaggtcggtctaggaacaggtacgttcacctctacaccatcgagccggcctgacagtctaggtaagttntttgacttaagtttatacgtgtcagtctagtataagtgtacgttggtttactcgtacgtttccggcctaggggaacctaaaggttggtactttacgaaacggtacgtaacgttggtacgtctacgaacctacctagttccgtattccttacacgtttccccg

SEQ ID NO: 318382 - DNA, 557 bp, Homo sapiens
  misc_feature: GZ8MTXP02HLPKR.10.20.B09.1.454.CMB.2.raw
  modified_base (195)..(195): a, c, t, g, unknown or other
  misc_feature (195)..(195): n is a, c, g, or t
  modified_base (223)..(223): a, c, t, g, unknown or other
  misc_feature (223)..(223): n is a, c, g, or t
  modified_base (229)..(229): a, c, t, g, unknown or other
  misc_feature (229)..(229): n is a, c, g, or t
  modified_base (365)..(365): a, c, t, g, unknown or other
  misc_feature (365)..(365): n is a, c, g, or t
  modified_base (368)..(368): a, c, t, g, unknown or other
  misc_feature (368)..(368): n is a, c, g, or t
  modified_base (382)..(382): a, c, t, g, unknown or other
  misc_feature (382)..(382): n is a, c, g, or t
  modified_base (406)..(406): a, c, t, g, unknown or other
  misc_feature (406)..(406): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgagggganagagcccaccctctcctgcagggccgtnagaatnttgctaccaattgcctggtatcaacaaagcctggccaggctcccagacctcctcatctctggtcgcatccttcgaggggccctacgtcgggtcgtcccagccctagggttccaggtcggcaggtgggtctggaacnggngttcactctcaccntcagccgctgcagtctagaagttntttgactagtttactctgtcagtctagtatagtgtacgttgggtttactcgtacgtttccggccgtagggaacctaaagttcggtaatttacgaaggtaccgtaacgttggtacggcttcgacctaccgtatcctcggttctttacgtacc

SEQ ID NO: 318383 - DNA, 668 bp, Homo sapiens
  misc_feature: GZ8MTXP02H2AOX.10.20.B09.1.454.CMB.2.raw
  modified_base (195)..(195): a, c, t, g, unknown or other
  misc_feature (195)..(195): n is a, c, g, or t
  modified_base (224)..(224): a, c, t, g, unknown or other
  misc_feature (224)..(224): n is a, c, g, or t
  modified_base (230)..(230): a, c, t, g, unknown or other
  misc_feature (230)..(230): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgagggganagacgccaccctctcctgcgagggccgtnagaatnttgctaccattgcctgatcaacaaagctggccagctccagactcctcatctcgtggtcgctattccgttcggacgggtccctacgttgggtcgtcccgaggcccgtaggttcaggttcggacgtaggttcgggtactaggaacgagtacgttccaacgttcctaccaacctatccgacggcccggcctggcctaggtacgtagtaaagttacgtttttgacttaaggttttacttacgttaggttacgaacggtactaaggtttaaattaaggttacgtaacgtttttaggggttttaactttaccggtaacgtttttcccgggaccgtttaggggtaaaaccctaaaggtttacggtactttacgaacggtaaccgttaacgtcggtttacggccttaacgacctaaacctgttaccgtcgtttaccttacgttacc

SEQ ID NO: 318384 - DNA, 529 bp, Homo sapiens
  misc_feature: GZ8MTXP02I2N09.10.20.B09.1.454.CMB.2.raw
  modified_base (194)..(194): a, c, t, g, unknown or other
  misc_feature (194)..(194): n is a, c, g, or t
  modified_base (279)..(279): a, c, t, g, unknown or other
  misc_feature (279)..(279): n is a, c, g, or t
  modified_base (344)..(344): a, c, t, g, unknown or other
  misc_feature (344)..(344): n is a, c, g, or t
  modified_base (378)..(378): a, c, t, g, unknown or other
  misc_feature (378)..(378): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccagggganagagccacctctcctgcagggccgtcagaatattgctaccaattgcctggtatacaacaaagcctggccaggctccagactcctnatctctggtgcatcttcgaggccacgtggtctccagccaggttcagtcgcagtggtctggacagngttcactctcacatcagcgctgcagtctgaagtntttgcttagttactatgtcagctagtatatgtacgttggtttatcgtacgtttcggaccttaggggaaccctaaaaggttggtaacttttaccgaaaggtaccgtaacgttggtacggtactcgacacctagttccttcgttcttctaccg

SEQ ID NO: 318385 - DNA, 556 bp, Homo sapiens
  misc_feature: GZ8MTXP02JNY8F.10.20.B09.1.454.CMB.2.raw
  modified_base (195)..(195): a, c, t, g, unknown or other
  misc_feature (195)..(195): n is a, c, g, or t
  modified_base (300)..(300): a, c, t, g, unknown or other
  misc_feature (300)..(300): n is a, c, g, or t
  modified_base (407)..(407): a, c, t, g, unknown or other
  misc_feature (407)..(407): n is a, c, g, or t
tcagcatagtagtgcacgaccggtgctcgatttagtgtagtgtgaagggggaggaactactcagttaggacccagacggaaccatggaagccccagcgcagcttctcttcctcctgctactctggctcccagacaacactgcagaaatagttatgacgcagtctccagccaccctgtctgtgtcgtccggggganagagcccaccctctcctgcagggccggtcagaatattgctaaccaacttagcctggtatacaaacaaagcctggccaggcctcccagacctcctcatctctggtncatcttcggaggccagtggtctcccagcctaggttcaggtggcaggtgggtctaggaacaggtacgttcactctcaaccatcaggccgcctgctagtctagaagttntttgattaagtttatacgtgtacagtctaagtataagtgtacgttggttttatctacgtttcgccgtaggaactaagtgtacttcgagtaacgtactggtacgtctcgactaacgtattccgttgtaccttctactttcccgtaccccg

SEQ ID NO: 318386 - DNA, 516 bp, Homo sapiens
  misc_feature: GZ8MTXP02JLV5D.10.20.B09.1.454.CMB.2.raw
  modified_base (191)..(191): a, c, t, g, unknown or other
  misc_feature (191)..(191): n is a, c, g, or t
  modified_base (290)..(290): a, c, t, g, unknown or other
  misc_feature (290)..(290): n is a, c, g, or t
tcagcatagtagtgcacgaccggtgctcgatttagtgtagtgtgaagggggaactgctcagttaggacccagacggaaccatggaagccccagcgcagcttctcttcctcctgctactctggctcccagacaacactgcagaaatagttatgacgcagtctccagccaccctgtctgtgtctccagggganagagccaccctctcctgcagggccgtcagaatattgctaccaacttagcctggtatcaacaaaagcctggccaggctcccagactcctcatctctggtncatcttcgaggccactggtcgtcccagccaggttcagtgcagtggtctggacagagttcactctcaccatcagcggcctgcagtcagaagtatttgctagtttatactgtcagcagtataatgtacttggtttatcgtacgtttcggccctagggaacctaaaggtcggtactttacgaacgtacgtaacgtgtacggctgcacctatccgtgtcttcactttccc

SEQ ID NO: 318387 - DNA, 819 bp, Homo sapiens
  misc_feature: GZ8MTXP02FXZMH.10.20.B09.1.454.CMB.2.raw
  modified_base (195)..(195): a, c, t, g, unknown or other
  misc_feature (195)..(195): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgagggganagacgccaccctctcctgcgagggccgtcagaatattgctaccaacttagcctggtatacaaacaaagcctggccaggcctacccagacctcctcatctcgtggtgctatcgttcggacgggcctacgtgggtctcccgagtccgtaggttcaggtcggacgtaggttcggggtactaggaaacgtaggtcggtttccaaccttcctacccgaaccctaagtccgaacgggtcccggggtcccttacgggacctaaacggtttcctaagggtaaaaggtttcgtttttttacgggaaccttttaaaggtttttaacctttaacgttacggggtttacccaaagggttacccgttaaagggtttaaatttaaaacggtttacggggtttaaaacccgtttttgggggtttttttaaaacctttccccgggtttaaccggtttttcccccgggggtaacccccggtttaaacggggggtaaaaccccttaaaaggggttttacggggtttaaactttttaacccgggaaaacgggttaaaccgggttaaaccgttggggtacggtacccgttgggaacccccttaacgtaacgtttcctttcggtttaccctttactttaaccccg

SEQ ID NO: 318388 - DNA, 535 bp, Homo sapiens
  misc_feature: GZ8MTXP02HQA5K.10.20.B09.1.454.CMB.2.raw
  modified_base (222)..(222): a, c, t, g, unknown or other
  misc_feature (222)..(222): n is a, c, g, or t
  modified_base (293)..(293): a, c, t, g, unknown or other
  misc_feature (293)..(293): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtnagaatattgctaccaattagcctggtatacaacaaaagcctggccaggctcccagacctctcatctctgtncatcttcgagggccagtggtcgtcccagcctaggttcaggtggctaggtgggtctgggaacagtcgttcactctcacatcagcgctgcagtctgatattttgacttagtttacttactgtacagctagtataagttgtacttgggtttattcgtacgtttcggaccgttagggaaccgtaaaagttggtactttacgagtaacgtaactggtggctgccactactcgtgttccttactaccg

SEQ ID NO: 318389 - DNA, 594 bp, Homo sapiens
  misc_feature: GZ8MTXP02H3JBW.10.20.B09.1.454.CMB.2.raw
  modified_base (221)..(221): a, c, t, g, unknown or other
  misc_feature (221)..(221): n is a, c, g, or t
  modified_base (277)..(277): a, c, t, g, unknown or other
  misc_feature (277)..(277): n is a, c, g, or t
  modified_base (421)..(421): a, c, t, g, unknown or other
  misc_feature (421)..(421): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctccagacaacactgcagaaatagttatgacgcagtctccagccaccctgtctgtgtctccgaggggagagagccaccctctcctgcagggccgtnagaatatgctaccattagcctggtatcaacaaagcctgccaggctccagactcctnactctctggtcgcatccttacggacgggcctacgtggtcgtcccagccgtaggtctaggtcggcgtaggtcggggtactaggaactagtgtttccacttcctaccgaacctatcacggccggcctggctagtctagtaaagttntttgactagttttatacgtgtcagatagtaatagttgtaacgtttggtttacttcgaacgtttccggaccctaggggtaacctaaaggttcgggtaattttacgaaacggtaacgttaaacgtggttaggaccttaaggaccctaacgtacttcgtacgtttccttactaccg

SEQ ID NO: 318390 - DNA, 501 bp, Homo sapiens
  misc_feature: GZ8MTXP02IDPAZ.10.20.B09.1.454.CMB.2.raw
  modified_base (224)..(224): a, c, t, g, unknown or other
  misc_feature (224)..(224): n is a, c, g, or t
  modified_base (230)..(230): a, c, t, g, unknown or other
  misc_feature (230)..(230): n is a, c, g, or t
  modified_base (249)..(249): a, c, t, g, unknown or other
  misc_feature (249)..(249): n is a, c, g, or t
  modified_base (254)..(254): a, c, t, g, unknown or other
  misc_feature (254)..(254): n is a, c, g, or t
  modified_base (280)..(280): a, c, t, g, unknown or other
  misc_feature (280)..(280): n is a, c, g, or t
  modified_base (339)..(339): a, c, t, g, unknown or other
  misc_feature (339)..(339): n is a, c, g, or t
  modified_base (380)..(380): a, c, t, g, unknown or other
  misc_feature (380)..(380): n is a, c, g, or t
  modified_base (475)..(475): a, c, t, g, unknown or other
  misc_feature (475)..(475): n is a, c, g, or t
  modified_base (486)..(486): a, c, t, g, unknown or other
  misc_feature (486)..(486): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgagggggagagacgccaccctctcctgcagggccgtnagaatntgctacattgctgatcaanaagcngcagctccagctcctcatctctggtncatcttcggagggccagtggcgtcccagccaggttcagtcggcaggtgggctaggaacngtgttcacttctcaccatcagccgcctgcagtctagaagtnttttgcttagtttattactgtacagactagtataagtgaacgtttggtttattcacgtttcgccgtaggactaaagtgtattcacgacactggtnactgactaccngtctcgttctctacc

SEQ ID NO: 318391 - DNA, 565 bp, Homo sapiens
  misc_feature: GZ8MTXP02GMTQ3.10.20.B09.1.454.CMB.2.raw
  modified_base (301)..(301): a, c, t, g, unknown or other
  misc_feature (301)..(301): n is a, c, g, or t
  modified_base (367)..(367): a, c, t, g, unknown or other
  misc_feature (367)..(367): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctcgaaggggagagagcccaccctctcctgcagggccgtcagaatattgctaccaacttagcctaggtatacaaacaaagcctggccaggcctacccagacctcctcactctctggtncatcgttcggacggtccacgtggtcgtcccagcctaggttcaggtcggcaggtgggtctaggaacngtagttccactctaccacctatcgacgccgcctgctagtctagagtatttgacttagttatactgtcagtctaagtataagtgtaacgtttgggttttactcgtacgtttcggacccgtaggggtaacctaaaggttggtaacttcggaaagtaccgtaatggtacggctcgactacctatccttgtccttactaacc

SEQ ID NO: 318392 - DNA, 538 bp, Homo sapiens
  misc_feature: GZ8MTXP02JA5CO.10.20.B09.1.454.CMB.2.raw
  modified_base (191)..(191): a, c, t, g, unknown or other
  misc_feature (191)..(191): n is a, c, g, or t
  modified_base (286)..(286): a, c, t, g, unknown or other
  misc_feature (286)..(286): n is a, c, g, or t
  modified_base (340)..(340): a, c, t, g, unknown or other
  misc_feature (340)..(340): n is a, c, g, or t
  modified_base (377)..(377): a, c, t, g, unknown or other
  misc_feature (377)..(377): n is a, c, g, or t
tcagcatagtagtgcacgaccggtgctcgatttagtgtagtgtgaagggggaactgctcagttaggacccagacggaaccatggaagccccagcgcagcttctcttcctcctgctactctggctcccagacaacactgcagaaatagttatgacgcagtctccagccaccctgtctgtgtctccagggganagagccaccctctcctgcagggccggtcagaatatgctaccaattagcctgtatcaacaaagcctggccaggctccagactcctcatctctggtnctatcttcgaggccagtggtcgtcccagccagtcagtgcagtggtctggacagngttcactctcaccatcagcgcctgcagtctagaagtntttgacgtagtttatacgtgtacagtctagttatatgtacgtttgggtttatcgtacgtttcggccttaggggacctaaaggttcggtactttacgaacggtaacgtaacgtggtacggtctacgcctaccgtatcgtacgttccttacgtactttccccg

SEQ ID NO: 318393 - DNA, 558 bp, Homo sapiens
  misc_feature: GZ8MTXP02IEOZG.10.20.B09.1.454.CMB.2.raw
  modified_base (222)..(222): a, c, t, g, unknown or other
  misc_feature (222)..(222): n is a, c, g, or t
  modified_base (228)..(228): a, c, t, g, unknown or other
  misc_feature (228)..(228): n is a, c, g, or t
  modified_base (279)..(279): a, c, t, g, unknown or other
  misc_feature (279)..(279): n is a, c, g, or t
  modified_base (290)..(290): a, c, t, g, unknown or other
  misc_feature (290)..(290): n is a, c, g, or t
  modified_base (300)..(300): a, c, t, g, unknown or other
  misc_feature (300)..(300): n is a, c, g, or t
  modified_base (340)..(340): a, c, t, g, unknown or other
  misc_feature (340)..(340): n is a, c, g, or t
  modified_base (346)..(346): a, c, t, g, unknown or other
  misc_feature (346)..(346): n is a, c, g, or t
  modified_base (348)..(348): a, c, t, g, unknown or other
  misc_feature (348)..(348): n is a, c, g, or t
  modified_base (388)..(388): a, c, t, g, unknown or other
  misc_feature (388)..(388): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggcctcccagacaacactgcagaaatagttatgacgcagtctccagccaccctgtctgtgtctccaggggagagagccaccctctcctgcagggccgtnagaatnttgctaccaattagcctggtatcaacaaagctgccaggctcccagactccncatctctggtncatcttcggnggccatggtctcccagccaggttcaggtcggcagtggtcnggaacngngttcactctacaccatcagccgcctggcagtctgaaagtnttttgacttagtttatatgtcagctaagtataaatcgtaacgttgggttttactcgttaccgtttcggacccttaggggaacctaaaaggttcggtatttaccgaacgtaacgtaacgtggttcgacgttaacggcctaaccgtactttctacggttactttacctaccg

SEQ ID NO: 318394 - DNA, 587 bp, Homo sapiens
  misc_feature: GZ8MTXP02HEFYP.10.20.B09.1.454.CMB.2.raw
  modified_base (195)..(195): a, c, t, g, unknown or other
  misc_feature (195)..(195): n is a, c, g, or t
  modified_base (295)..(295): a, c, t, g, unknown or other
  misc_feature (295)..(295): n is a, c, g, or t
  modified_base (307)..(307): a, c, t, g, unknown or other
  misc_feature (307)..(307): n is a, c, g, or t
  modified_base (393)..(393): a, c, t, g, unknown or other
  misc_feature (393)..(393): n is a, c, g, or t
  modified_base (399)..(399): a, c, t, g, unknown or other
  misc_feature (399)..(399): n is a, c, g, or t
  modified_base (425)..(425): a, c, t, g, unknown or other
  misc_feature (425)..(425): n is a, c, g, or t
  modified_base (481)..(481): a, c, t, g, unknown or other
  misc_feature (481)..(481): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgagggganagacgcccaccctctcctgcgaggggccggtcaagaatattgactaccaattgcctggtactacaaacaaagcctggccaggcctacccagacctccctnactctcgtggtnctactcgttcggacgggccctacgttgggtcctcccgaggcctaggttcaggtcgtcgaggtggtctaggaacagtgttcactccncaaccntcacgcgcctgactagtctagagttntttggacttagtttatactgtactagactagtataagtgtacgtttgggttttacncgttacgtttccggaccgtagggaaaccctaaggtcggtactttacgaaacggtacgtaacgtggtacggtctaacggactaccgtacttctcgttcttacgtacc

SEQ ID NO: 318395 - DNA, 651 bp, Homo sapiens
  misc_feature: GZ8MTXP02IFM4S.10.20.B09.1.454.CMB.2.raw
  modified_base (195)..(195): a, c, t, g, unknown or other
  misc_feature (195)..(195): n is a, c, g, or t
  modified_base (244)..(244): a, c, t, g, unknown or other
  misc_feature (244)..(244): n is a, c, g, or t
  modified_base (248)..(248): a, c, t, g, unknown or other
  misc_feature (248)..(248): n is a, c, g, or t
  modified_base (263)..(263): a, c, t, g, unknown or other
  misc_feature (263)..(263): n is a, c, g, or t
  modified_base (269)..(269): a, c, t, g, unknown or other
  misc_feature (269)..(269): n is a, c, g, or t
  modified_base (281)..(281): a, c, t, g, unknown or other
  misc_feature (281)..(281): n is a, c, g, or t
tcagcatagtagtgcacgaccggtgctcgatttagtgtagtgtgaagggggaggaactgctcagttaggacccagacggaaccatggaagccccagcgcagcttctcttcatcctgctactctggctcccagacaacactgcagaaatagttatgacgcagtctccagccaccctgtctgtgtctccgagggganagagcccacctctcctgcgagggccgtcagatattgctacatgctgtancaanaagctgcagctccanactctnatctcgtggtcnctacttcgtacggacggtcctacgtcggtcctacccgaggtcccgtaggttcgagggtcggacgtggttcgggtacgtacggaactggtacgttacaccttccaccactagtacccgacgccggtccgtacgacgtacgttacgtagtaacgtttagttttcgtacgtttagtttacttacgttcgtacgtagtacgtaagttaattaagttacgttacgttttaggttttacttaccgtttaccgtttccggtaccgttaacgggtaaaccgttaagggttacgttaacgtttaacggaaacggttaacgtaacggttcgtacggtaacgtacgtacctaccgttacgttccgttacgtttacctaccg

SEQ ID NO: 318396 - DNA, 602 bp, Homo sapiens
  misc_feature: GZ8MTXP02GBUAD.10.20.B09.1.454.CMB.2.raw
  modified_base (194)..(194): a, c, t, g, unknown or other
  misc_feature (194)..(194): n is a, c, g, or t
  modified_base (222)..(222): a, c, t, g, unknown or other
  misc_feature (222)..(222): n is a, c, g, or t
  modified_base (249)..(249): a, c, t, g, unknown or other
  misc_feature (249)..(249): n is a, c, g, or t
  modified_base (286)..(286): a, c, t, g, unknown or other
  misc_feature (286)..(286): n is a, c, g, or t
  modified_base (291)..(291): a, c, t, g, unknown or other
  misc_feature (291)..(291): n is a, c, g, or t
  modified_base (336)..(336): a, c, t, g, unknown or other
  misc_feature (336)..(336): n is a, c, g, or t
  modified_base (342)..(342): a, c, t, g, unknown or other
  misc_feature (342)..(342): n is a, c, g, or t
  modified_base (350)..(350): a, c, t, g, unknown or other
  misc_feature (350)..(350): n is a, c, g, or t
  modified_base (355)..(355): a, c, t, g, unknown or other
  misc_feature (355)..(355): n is a, c, g, or t
  modified_base (357)..(357): a, c, t, g, unknown or other
  misc_feature (357)..(357): n is a, c, g, or t
  modified_base (363)..(363): a, c, t, g, unknown or other
  misc_feature (363)..(363): n is a, c, g, or t
tcagcatagtagtgcacgaccggtgctcgatttagtgtagtgtgaaggggggaactgctcagttaggacccagacggaaccatggaagccccagcgcagcttctcttcctcctgctactctggctcccagacaacactgcaagaaatagttatgacgcagtctccagccaccctgtctgtgtctccgagggganagagccaccctctcctgcaggggccgtnagatatgctaccaacttagctgtatanaaacaaaagctcggccagctcccagactcctcatctntggtncatcttcgacggcacctggtcgtcccagccaggtcagtggcgtgngggtcnggaacagngttcncnctcacntcacggcgcctgctcgtactgtaaagtagttttcgcgtagttttaatacctgttacacgtataaagttattaagtacgtagtttacgggttttatttacgtaccgtttacggtcccgtaacggggtaaccgaaaaggttaggttaccgtttaactaacggaacgttaaaccgttggttacggtccttacggaaccttaacccggtacttacgttcgtttacctttacacctttccccgg

SEQ ID NO: 318397 - DNA, 534 bp, Homo sapiens
  misc_feature: GZ8MTXP02HC6ZG.10.20.B09.1.454.CMB.2.raw
  modified_base (197)..(197): a, c, t, g, unknown or other
  misc_feature (197)..(197): n is a, c, g, or t
  modified_base (228)..(228): a, c, t, g, unknown or other
  misc_feature (228)..(228): n is a, c, g, or t
  modified_base (233)..(233): a, c, t, g, unknown or other
  misc_feature (233)..(233): n is a, c, g, or t
  modified_base (235)..(235): a, c, t, g, unknown or other
  misc_feature (235)..(235): n is a, c, g, or t
  modified_base (247)..(247): a, c, t, g, unknown or other
  misc_feature (247)..(247): n is a, c, g, or t
  modified_base (252)..(252): a, c, t, g, unknown or other
  misc_feature (252)..(252): n is a, c, g, or t
  modified_base (255)..(255): a, c, t, g, unknown or other
  misc_feature (255)..(255): n is a, c, g, or t
  modified_base (257)..(257): a, c, t, g, unknown or other
  misc_feature (257)..(257): n is a, c, g, or t
  modified_base (263)..(263): a, c, t, g, unknown or other
  misc_feature (263)..(263): n is a, c, g, or t
  modified_base (266)..(266): a, c, t, g, unknown or other
  misc_feature (266)..(266): n is a, c, g, or t
  modified_base (268)..(268): a, c, t, g, unknown or other
  misc_feature (268)..(268): n is a, c, g, or t
  modified_base (270)..(271): a, c, t, g, unknown or other
  misc_feature (270)..(271): n is a, c, g, or t
  modified_base (274)..(274): a, c, t, g, unknown or other
  misc_feature (274)..(274): n is a, c, g, or t
  modified_base (277)..(277): a, c, t, g, unknown or other
  misc_feature (277)..(277): n is a, c, g, or t
  modified_base (279)..(279): a, c, t, g, unknown or other
  misc_feature (279)..(279): n is a, c, g, or t
  modified_base (288)..(288): a, c, t, g, unknown or other
  misc_feature (288)..(288): n is a, c, g, or t
  modified_base (293)..(293): a, c, t, g, unknown or other
  misc_feature (293)..(293): n is a, c, g, or t
  modified_base (296)..(296): a, c, t, g, unknown or other
  misc_feature (296)..(296): n is a, c, g, or t
  modified_base (302)..(302): a, c, t, g, unknown or other
  misc_feature (302)..(302): n is a, c, g, or t
  modified_base (306)..(307): a, c, t, g, unknown or other
  misc_feature (306)..(307): n is a, c, g, or t
  modified_base (311)..(311): a, c, t, g, unknown or other
  misc_feature (311)..(311): n is a, c, g, or t
  modified_base (316)..(316): a, c, t, g, unknown or other
  misc_feature (316)..(316): n is a, c, g, or t
  modified_base (331)..(331): a, c, t, g, unknown or other
  misc_feature (331)..(331): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggcctcccagacaacactgcagaaatagttatgacgcagtctccagcccaccctgtctgtgtctccgagggganagacgcccaccctctcctgcaggggccgtanagatntnctacatgctganacaanaancngcagcncancncnntcntgncntcgtgcgcngtgcnccngctgtngcgnngtgnagacngtctcactcacacancgacgcgctgcgtagtcgtagtattagtttgtacttagtttactactagtactagtataagtaattagttacgttacgtttaggtttacttaccgttacgtttccggtaccgtaacgggtaactaaggttcgtacgtttacgaacggtacgtacgttacggtcgtacgtaacgacctacgtacgttcgtcttaccttctaccg

SEQ ID NO: 318398 - DNA, 495 bp, Homo sapiens
  misc_feature: GZ8MTXP02IHRM1.10.20.B09.1.454.CMB.2.raw
  modified_base (222)..(222): a, c, t, g, unknown or other
  misc_feature (222)..(222): n is a, c, g, or t
  modified_base (293)..(293): a, c, t, g, unknown or other
  misc_feature (293)..(293): n is a, c, g, or t
  modified_base (352)..(352): a, c, t, g, unknown or other
  misc_feature (352)..(352): n is a, c, g, or t
  modified_base (354)..(354): a, c, t, g, unknown or other
  misc_feature (354)..(354): n is a, c, g, or t
  modified_base (382)..(382): a, c, t, g, unknown or other
  misc_feature (382)..(382): n is a, c, g, or t
  modified_base (475)..(475): a, c, t, g, unknown or other
  misc_feature (475)..(475): n is a, c, g, or t
  modified_base (485)..(485): a, c, t, g, unknown or other
  misc_feature (485)..(485): n is a, c, g, or t
  modified_base (489)..(489): a, c, t, g, unknown or other
  misc_feature (489)..(489): n is a, c, g, or t
  modified_base (494)..(494): a, c, t, g, unknown or other
  misc_feature (494)..(494): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagacgccaccctctcctgcagggccgtnagaatattgctaccaattgcctggtatcaaacaaaagcctggccaggcctccagacctcctcatctctgtncatcttcggaggccactggtcgtcccagtccaggttcagtcggctagtggtctggaacngngttcactctcaccgatcagccgctgacnggtcagagtatttgctagttatactgtcagctagtatatgtattcggtttatctacgtttcgcctagggacctaaagtcgattcagaacatgngctgcaactntctntctcnc

SEQ ID NO: 318399 - DNA, 647 bp, Homo sapiens
  misc_feature: GZ8MTXP02G0GSM.10.20.B09.1.454.CMB.2.raw
  modified_base (192)..(192): a, c, t, g, unknown or other
  misc_feature (192)..(192): n is a, c, g, or t
  modified_base (315)..(315): a, c, t, g, unknown or other
  misc_feature (315)..(315): n is a, c, g, or t
  modified_base (331)..(331): a, c, t, g, unknown or other
  misc_feature (331)..(331): n is a, c, g, or t
  modified_base (353)..(353): a, c, t, g, unknown or other
  misc_feature (353)..(353): n is a, c, g, or t
  modified_base (378)..(378): a, c, t, g, unknown or other
  misc_feature (378)..(378): n is a, c, g, or t
tcagcatagtagtgcacgaccggtgctcgatttagtgtagtgtgaagggggaactgctcagttaggacccagacggaaccatggaagccccagcgcagcttctcttcctcctgctactctggctcccagacaacactgcagaaatagttatgacgcagtctccagccaccctgtctgtgtctccgagggganagagccaccctctcctgcgagggccggtcagaatattgctacaacttagcctggtatcaacaaaagcctggccaggctcccagactcctcatctctggtgcatcttcgagtcgctagtgtccncgcgacgtgtgtgcgngtggtcgtcgagagagtcgtcnctcaccgactactcgacggccgtcncgacgtacgtagtaagtaagtttacgttcgtaacgttttaagtttacttcgttacgtacgtacgtaacgttaagttaaagttaggttaacgtttacgggtttttacgttttacgtttaccgtttaccgggttccccgttacggggtaacccgtaaaacgtttacgggttacggtttacttacggaaacgtaaacgttaacggttcgggtacgtacggtaaccgtaccctaaacggttcttcggtttacgtttaccttaactttcccccg

SEQ ID NO: 318400 - DNA, 555 bp, Homo sapiens
  misc_feature: GZ8MTXP02HXQ7C.10.20.B09.1.454.CMB.2.raw
  modified_base (193)..(193): a, c, t, g, unknown or other
  misc_feature (193)..(193): n is a, c, g, or t
  modified_base (296)..(296): a, c, t, g, unknown or other
  misc_feature (296)..(296): n is a, c, g, or t
  modified_base (319)..(319): a, c, t, g, unknown or other
  misc_feature (319)..(319): n is a, c, g, or t
tcagcatagtagtgcacgaccggtgctcgatttagtgtagtgtgaaggggggaactgctcagttaggacccagacggaaccatggaagccccagcgcagcttctcttcctcctgctactctggctcccagacaacactgcagaaatagttatgacgcagtctccagccaccctgtctgtgtctccgagggganagagcccaccctctcctgcgagggccggtcagaatattgactaccaattgcctggtatcaaacaaaagcctggccaggctcccagacctcctcatctctggtncatctcggaggcctacgtggtcncccagccgaggttcagtggcctaggtgggtctaggacaggagttccactctaccaccatcagccggcctgcagtctagaagttatttgcttagtttattacgtgtactagactagttaataagttaggtacgtttggttttaactcttacgtttcggacccgttagggaacctaaaggttggtactttacggaagtacgtatggtacgctgccactatctagtccttacacttccc

SEQ ID NO: 318401 - DNA, 595 bp, Homo sapiens
  misc_feature: GZ8MTXP02JSZBT.10.20.B09.1.454.CMB.2.raw
  modified_base (227)..(227): a, c, t, g, unknown or other
  misc_feature (227)..(227): n is a, c, g, or t
  modified_base (233)..(233): a, c, t, g, unknown or other
  misc_feature (233)..(233): n is a, c, g, or t
  modified_base (286)..(286): a, c, t, g, unknown or other
  misc_feature (286)..(286): n is a, c, g, or t
  modified_base (298)..(298): a, c, t, g, unknown or other
  misc_feature (298)..(298): n is a, c, g, or t
  modified_base (366)..(366): a, c, t, g, unknown or other
  misc_feature (366)..(366): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgaggggagagacgcccaccctctcctgcgacgggccggtnagaatntgctaccattgctggtatcaaacaaagcatggccaggcctcccagacctcctnactctcgtggtnctatcgtcggaggcctacggtcggtcgtaccagccgtaggttcaggtcggcaggtcgggtctaggaanggtcttcactctaccgactatcgacgccggtcctagctacggttctaggtaaagtttgtttacgactttagttttattacgtcgttacgacgtagtagttaattaagtcggttactttagggtttacttcgttacgttaccggtccgtaacgggtacctaaaggtccgtaagttacaacggtacgtacgttggacgcgttagacctacgtattccgttcgtacctttac

SEQ ID NO: 318402 - DNA, 668 bp, Homo sapiens
  misc_feature: GZ8MTXP02IRE6D.10.20.B09.1.454.CMB.2.raw
  modified_base (224)..(224): a, c, t, g, unknown or other
  misc_feature (224)..(224): n is a, c, g, or t
  modified_base (230)..(230): a, c, t, g, unknown or other
  misc_feature (230)..(230): n is a, c, g, or t
  modified_base (276)..(276): a, c, t, g, unknown or other
  misc_feature (276)..(276): n is a, c, g, or t
  modified_base (287)..(287): a, c, t, g, unknown or other
  misc_feature (287)..(287): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtcctccgaggggagagacgccacctctcctgcgagggccgtnagaatntgctaccattgcctgtatacaacaaagctggcagctccagactccncatctctggtnctactcgttcggagggccacgttcgggtcgtcccacggtcccgtagggttccaggttccgggcgtagggttcggggtacgttaggaaaccgtagtacggtttccaacgttccctaccaacccgtatccgacggcccgggtcctggcctaaggttctaggtaaaagtttcgtttttcgaccgtttaaaggttttacttacgttacgtacgtaaggtacttaagtttaattaaaggttacgtaccgtttttagggtttttaacttccgttaacgtttttccgggaccgttacgggtaaacctaaaaggttcgtaagtttaccgaaaggtacgtaacgttggtacgcgttaagacctaacgtcttcttcgtttacttactaccg

SEQ ID NO: 318403 - DNA, 567 bp, Homo sapiens
  misc_feature: GZ8MTXP02I20RL.10.20.B09.1.454.CMB.2.raw
  modified_base (284)..(284): a, c, t, g, unknown or other
  misc_feature (284)..(284): n is a, c, g, or t
  modified_base (416)..(416): a, c, t, g, unknown or other
  misc_feature (416)..(416): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccgtcagaatattgctaaccaacttgcctggtatacaaacaaagcctggccaggcctccagactcctnactcctctggtgcatccgttacggacgggcccacgttgggtctccccgagcccgtaggttcaggtcggcaggttggggtctaggaacagtgttccactcgtccaccatcagccggctgcagtctagtaaatnttttgacttagtttacttacgtgtacaggtctaagttaataagttcgtacgtttgggtttacttcgtacgtttccggaccgtagggaactaaaggttcgtattacgaagtacgacgtagtcggactaagtcaactatcttcgttctactac

SEQ ID NO: 318404 - DNA, 547 bp, Homo sapiens
  misc_feature: GZ8MTXP02HWPAT.10.20.B09.1.454.CMB.2.raw
  modified_base (296)..(296): a, c, t, g, unknown or other
  misc_feature (296)..(296): n is a, c, g, or t
  modified_base (364)..(364): a, c, t, g, unknown or other
  misc_feature (364)..(364): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgaggggagagagccaccctctcctgcgagggccggtcagaatattgctaaccattagcctggtatcaacaaaagcctggccaggctcccagacctcctcatctctggtncatcgttcggacgggccacgtggtcgtcccagcctaggttcaggtcggacaggtgggtctggaacagngttcactctcacatcagcgctgcagtctgaagtatttgcttaagtttatactgtacagtctaagtataatgtacgttggttttatctacgtttccggcccgttagggaacctaaaggttggtaatttcgaggtaacgtaacgttggtaggtctggcctaactacgttctacgttctttacacg

SEQ ID NO: 318405 - DNA, 554 bp, Homo sapiens
  misc_feature: GZ8MTXP02JLF3C.10.20.B09.1.454.CMB.2.raw
  modified_base (195)..(195): a, c, t, g, unknown or other
  misc_feature (195)..(195): n is a, c, g, or t
  modified_base (283)..(283): a, c, t, g, unknown or other
  misc_feature (283)..(283): n is a, c, g, or t
  modified_base (359)..(359): a, c, t, g, unknown or other
  misc_feature (359)..(359): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgagggganagagcccaccctctcctgcgagggccgtcagaatattgctaccaattagcctggtatcaaacaaagcctggcagctcccagacctccncatctcgtgtgctatcttcggacggccacgtgtcgtcccaggcctaggtccagtcggctaggtggtctaggaaccnggtagtttccacgttctccactatcgacgtccggctggcagtctagtaacttgtttagacttaagtttacttacgtgtcctagtactagtatagtgtacgtttggtttactcgtacgtttcggaccgtagggacctaaaggtcgtaattacgagtacgtagtcggtggactcgctaactcgtcttgtacttctac

SEQ ID NO: 318406 - DNA, 637 bp, Homo sapiens
  misc_feature: GZ8MTXP02I92EZ.10.20.B09.1.454.CMB.2.raw
  modified_base (194)..(194): a, c, t, g, unknown or other
  misc_feature (194)..(194): n is a, c, g, or t
  modified_base (230)..(230): a, c, t, g, unknown or other
  misc_feature (230)..(230): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctccagacaacactgcaagaaatagttatgacgcagtctccagccacctgtctgtgtctccgagggganagacgccaccctctcctgcacgggccgtacagaatnttgactaaccaattgcctaggtactacaaacaaacgcctacggaccacggcctacccacgacctcctcactactcgtcggtgactactcgttacggacggtcctacgtcggtcgtaccgacgtccgtacggtacgaggtcggacgtacggtcgggtcgtaggaacgagtacgttacgtactaccggggtaccaccgtactacgacggccgtccgtacgacgtacgtcgtagtaagttacgtttgtacgttagtttacttacgttagtacagtactagtaattagtagtacgttagtttacttcgttacgttccgtaccgtacggtaacgtaaggttacgtattacgtaacgtaacgtacgtacgtacgtactaacgacgtactactacgttacgttcttacttaccg

SEQ ID NO: 318407 - DNA, 564 bp, Homo sapiens
  misc_feature: GZ8MTXP02HPIFF.10.20.B09.1.454.CMB.2.raw
  modified_base (293)..(293): a, c, t, g, unknown or other
  misc_feature (293)..(293): n is a, c, g, or t
  modified_base (359)..(359): a, c, t, g, unknown or other
  misc_feature (359)..(359): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaattagcctggtatcaacaaagcctggccaggctcccagacctcctcatctccggtnctatcttcgaggccacgtggtcgtcccgagccgaggttcaggtggccaggtcgggtctgggaaacnggtagttccacgttctacaccagtcagcccggtcctgcctagttctaggtaaacgttatttttgacttagttttaatacgtgtacagtcaagttataatgtacttggtttatctacgttcggcctagggacctaaaggtcggtactttcgacgtacgtaacgtgtacggtctcggcctacgacttctcgtcctttctacttcccg

SEQ ID NO: 318408 - DNA, 624 bp, Homo sapiens
  misc_feature: GZ8MTXP02GDNL2.10.20.B09.1.454.CMB.2.raw
  modified_base (231)..(231): a, c, t, g, unknown or other
  misc_feature (231)..(231): n is a, c, g, or t
  modified_base (604)..(604): a, c, t, g, unknown or other
  misc_feature (604)..(604): n is a, c, g, or t
  modified_base (610)..(610): a, c, t, g, unknown or other
  misc_feature (610)..(610): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgaggggagagacgccaccctctcctgcgagggccggtcagaatnttgctaccaacttagccttggtatacaaacaaacgcctcggaccaggcctcccagacctcctcatccgtccggtgctacttccgttacggacggggtcccacgttcggtcgtccccgagtcccgtaggttccgaggttcggccctagggttcggggtctagggaaacaggttacttccacttctaccacctatcgacggtccggcctggacctagttcgtaaggaaagtttcttttcgacgtttaagttttattaccgtgtacaggtactaaggtttaataagttggttaacgtttgggtttttaactcgttaaccggtttcggaccgtaggggtaactaaggtgtactttagagtacagtcgtgctgctacnttcgtntctacgtcttcccg

SEQ ID NO: 318409 - DNA, 673 bp, Homo sapiens
  misc_feature: GZ8MTXP02FNFT4.10.20.B09.1.454.CMB.2.raw
  modified_base (224)..(224): a, c, t, g, unknown or other
  misc_feature (224)..(224): n is a, c, g, or t
  modified_base (230)..(230): a, c, t, g, unknown or other
  misc_feature (230)..(230): n is a, c, g, or t
  modified_base (276)..(276): a, c, t, g, unknown or other
  misc_feature (276)..(276): n is a, c, g, or t
  modified_base (287)..(287): a, c, t, g, unknown or other
  misc_feature (287)..(287): n is a, c, g, or t
tcagcatagtagtgcacgaccggtgctcgatttagtgtagtgtgaaggggggaactgctcagttaggacccagacggaaccatggaagccccagcgcagcttctcttcctcctgctactctggctcccagacaacactgcaagaaatagttatgacgcagtctccagccaccctgtctgtgtctccgaggggagagacgcccaccctctcctgcgagggccgtnagaatntgctacaacttgctgactacaacaaagctgcagcctccagactccncatctctggtnctagtctggacggcctagtggtcgtccaggcctaggtcaggtggccgtagggtcggtcgaggaacaggtacgttccaccttactaccaacctacgtacggtacggcccggtccgtgaccgtacggttacttaggtaaagtttagttttcggactttaaggttttattacgtcgttacgtaggtactaaagttaaagtttaacgttacggttaacgtttttacggggtttttacttaccggtttaaccggttttaccgggacccggttaaggggtaaaccttaaaagggttggttaactttacggaaacggtacgtaaacgttcgggtaacgtccttacggaaccgtaaacttcgttacttcgttacctttacgtaccgtttccccg

SEQ ID NO: 318410 - DNA, 506 bp, Homo sapiens
  misc_feature: GZ8MTXP02I0M6J.10.20.B09.1.454.CMB.2.raw
  modified_base (194)..(194): a, c, t, g, unknown or other
  misc_feature (194)..(194): n is a, c, g, or t
  modified_base (284)..(284): a, c, t, g, unknown or other
  misc_feature (284)..(284): n is a, c, g, or t
  modified_base (348)..(348): a, c, t, g, unknown or other
  misc_feature (348)..(348): n is a, c, g, or t
  modified_base (350)..(350): a, c, t, g, unknown or other
  misc_feature (350)..(350): n is a, c, g, or t
  modified_base (387)..(387): a, c, t, g, unknown or other
  misc_feature (387)..(387): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccagggganagagccaccctctcctgcagggccggtcagaatattgctaccaacttagcctggtatcaaacaaagcctggccaggctcccagacctccncatctctggtgcatcttcgaggccatggtctccagcctaggtcagtcggcagtggtctggaacngngttcactctcacatcagcgctgctagtctagtaagtnttttgacttagtttatctgtcagctagtattatgtacgtttggtttatcgtactttccggctagggactaaaggtgtattcgagtacgtatggtgtctgctacgtatctcgttctactc

SEQ ID NO: 318411 - DNA, 541 bp, Homo sapiens
  misc_feature: GZ8MTXP02JE71H.10.20.B09.1.454.CMB.2.raw
  modified_base (193)..(193): a, c, t, g, unknown or other
  misc_feature (193)..(193): n is a, c, g, or t
  modified_base (312)..(312): a, c, t, g, unknown or other
  misc_feature (312)..(312): n is a, c, g, or t
  modified_base (345)..(345): a, c, t, g, unknown or other
  misc_feature (345)..(345): n is a, c, g, or t
  modified_base (347)..(347): a, c, t, g, unknown or other
  misc_feature (347)..(347): n is a, c, g, or t
  modified_base (385)..(385): a, c, t, g, unknown or other
  misc_feature (385)..(385): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccacctgtctgtgtctccagggganagagccaccctctcctgcagggccggtcagaatattgctaccaattgcctggtatcaacaaagcctggccaggctcccagactcctcatctctggtgcatcttcgagggccactgggtntcccagccaggttcagtgcagtggtctggaacngngttcactctcaccatcagtcgctgcagtctgaaagttntttgcttagtttacttacgtgtactagtctaagttaatacgttagtacgtttggtttacttcgtacgtttccggtaccgtaggaaacgtaaggttcgtactttacgacggtaacgtacgtggtcgtctgacctactacttcgtcgttccttctacg

SEQ ID NO: 318412 - DNA, 560 bp, Homo sapiens
  misc_feature: GZ8MTXP02JK2S0.10.20.B09.1.454.CMB.2.raw
  modified_base (194)..(194): a, c, t, g, unknown or other
  misc_feature (194)..(194): n is a, c, g, or t
  modified_base (292)..(292): a, c, t, g, unknown or other
  misc_feature (292)..(292): n is a, c, g, or t
  modified_base (352)..(352): a, c, t, g, unknown or other
  misc_feature (352)..(352): n is a, c, g, or t
  modified_base (354)..(354): a, c, t, g, unknown or other
  misc_feature (354)..(354): n is a, c, g, or t
  modified_base (389)..(389): a, c, t, g, unknown or other
  misc_feature (389)..(389): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccagggganagagccaccctctcctgcagggccggtcagaatattgctaccaattagcctggtatcaacaaagcctggccaggctcccagactcctcatctctggtncatctcggagggccacgtgggtctcccagcctaggttcagtcggcaggtggtctggaacngngttcactctcacatcagcgcctgcagtctgaagtntttgacttagtttactacgtgtcagctaagtataagtgtacgtttgggttttactcgtacgtttccggaccgttagggaacctaaaaggttggtatttaccgaaggtaacgtaacgttggtacgggtacttcggccctaaaccgtgttccgtacgtttacccttctaaccg

SEQ ID NO: 318413 - DNA, 542 bp, Homo sapiens
  misc_feature: GZ8MTXP02F7TBR.10.20.B09.1.454.CMB.2.raw
  modified_base (221)..(221): a, c, t, g, unknown or other
  misc_feature (221)..(221): n is a, c, g, or t
  modified_base (294)..(294): a, c, t, g, unknown or other
  misc_feature (294)..(294): n is a, c, g, or t
  modified_base (393)..(393): a, c, t, g, unknown or other
  misc_feature (393)..(393): n is a, c, g, or t
  modified_base (430)..(430): a, c, t, g, unknown or other
  misc_feature (430)..(430): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccgtnagaatattgctaccaacttgcctggtatacaaacaaagcctggccaggcctcccagactcctcatctctggtncatctcggaggccacgtggtcgcccagccaggttcagtcggcaggtgggtctggaacagtcgttcactctacacctatcagccgcctgcagtctgaatnttttgacttagtttatctgtcagtctagtaattaagngtaccgttggtttttactccgttaacgtttccgaccggttagggtaacctaaaggttcgtactttcgaagtacgtaactggtcggtactaacgcacctatcttcgtctctac

SEQ ID NO: 318414 - DNA, 650 bp, Homo sapiens
  misc_feature: GZ8MTXP02I2LYI.10.20.B09.1.454.CMB.2.raw
  modified_base (195)..(195): a, c, t, g, unknown or other
  misc_feature (195)..(195): n is a, c, g, or t
  modified_base (225)..(225): a, c, t, g, unknown or other
  misc_feature (225)..(225): n is a, c, g, or t
  modified_base (231)..(231): a, c, t, g, unknown or other
  misc_feature (231)..(231): n is a, c, g, or t
  modified_base (382)..(382): a, c, t, g, unknown or other
  misc_feature (382)..(382): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgagggganagacgcccaccctctcctgcgagggccgtnagaatntgctaccaattagcctggtatacaaacaaagcctggccaggcctcccagacctcctcatcctctggtgctattccgttcggacgggccctacgtgggtcgtaccccaggcctagggtttcaggttcggcgtaggtgggtacctaggaaacnggtacgttccacgttcctaccgacctagtaccacggcccggccttggaccgtaaggttctaggtaaaagtttcgtttttacggactttaaagttttacttaccgttagttaccagtacttaagttaattaacggttagttaacgtttgggtttttaacttcgttaaccgtttccgggtacccgttagggaaaccttaaaggttggtaactttaccgaaggtaccgtaagtcgtcggactggcctaacgtcttctcgtttactactacc

SEQ ID NO: 318415 - DNA, 637 bp, Homo sapiens
  misc_feature: GZ8MTXP02JN6RP.10.20.B09.1.454.CMB.2.raw
tcagcatagtagtgcacgaccggtgctcgatttagtgtagtgtgaagggggaggaactgctcagttaggacccagacggaaccatggaagccccagcgcagcttctcttcctcctgctactctggctcccagacaaccctgcagaaatagttatgacgcagtctccagccaccctgtcctgtgtctccagggagagagccaccctcctcctgcgaggccggtcagaatattgctaccaacttagcctggtattcaacaaaagacctgccaggctcccagacctacctcatctctggtgcgatcttcgaggccgacctggtcgtccacgccgacgttcgagtcggcgagtgggtcgtggaacgagtggttctactcttcaccactacagccggccgttgcgaacgtccgtgtaagtatttgtactacgtttagtttacgttgtctagacgtagtaagttaagttagtacgttacggtttttaacgtttcgttaacgtttccgggttacccgttacgggtaacccggtaaaagttaccgggttagttacccgtaagggtaacggaaaccgttaggtacgggtacggttccggtacggtacccgtaacgttccgttacgtttaccgttttcgtaaccccg

SEQ ID NO: 318416 - DNA, 579 bp, Homo sapiens
  misc_feature: GZ8MTXP02FLP4D.10.20.B09.1.454.CMB.2.raw
  modified_base (220)..(220): a, c, t, g, unknown or other
  misc_feature (220)..(220): n is a, c, g, or t
  modified_base (295)..(295): a, c, t, g, unknown or other
  misc_feature (295)..(295): n is a, c, g, or t
  modified_base (564)..(564): a, c, t, g, unknown or other
  misc_feature (564)..(564): n is a, c, g, or t
  modified_base (568)..(568): a, c, t, g, unknown or other
  misc_feature (568)..(568): n is a, c, g, or t
tcagcatagtagtgcacgaccggtgctcgatttagtgtagtgtgaagggggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcgagggccggtnagaatattgctaccaacttagcctggtatcaaacaaaagcctggccaggcctcccagacctcctcatctctggtnctatcgttcgagggccctacgtggtcgtcccaggtccctaggttcaggttcggcctaggttggggtactagggaactaggtacgtttccacttcctcaacccatccgaggccggtccctggactagttctaggtaaagtacttttgacttaagttttatacgttgtacaggtactagttaataagttgtaactttgggttttaacttctacgtttcggaccctggggtaacctaaggtgtacttgacgtacgatcgtcgctcgcacgtntctntctctactccg

SEQ ID NO: 318417 - DNA, 606 bp, Homo sapiens
  misc_feature: GZ8MTXP02F1BFA.10.20.B09.1.454.CMB.2.raw
  modified_base (196)..(196): a, c, t, g, unknown or other
  misc_feature (196)..(196): n is a, c, g, or t
  modified_base (441)..(441): a, c, t, g, unknown or other
  misc_feature (441)..(441): n is a, c, g, or t
  modified_base (594)..(594): a, c, t, g, unknown or other
  misc_feature (594)..(594): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagcccaccctgtctgtgtctccgagggganagacgccaccctctcctgccgaggggccgtacagaatattgacctaccaacttgcctggtatacaaacaaacgcctaggccaggcctcccagacctcctacatcctcgtggtcgctattccgttcggacgggccctaggttcgggtcgtaccccgaggtcccgtaggttcaggtcggactagggtcggggtactaggaacaggtcgttcactctaccacatcaggcgcctgctagtctagtaatntttgacttatttactactgtacagtactagttaactaagttgtacgtttagggttttactcgttacgtttccggaccgttaggggaacctaaaggttcggtactttacgaaagtacgtaacgttgtcggtactaacgacctaccgtatcgttntcctttctaacc

SEQ ID NO: 318418 - DNA, 687 bp, Homo sapiens
  misc_feature: GZ8MTXP02F3T6G.10.20.B09.1.454.CMB.2.raw
  modified_base (195)..(195): a, c, t, g, unknown or other
  misc_feature (195)..(195): n is a, c, g, or t
  modified_base (224)..(224): a, c, t, g, unknown or other
  misc_feature (224)..(224): n is a, c, g, or t
  modified_base (297)..(297): a, c, t, g, unknown or other
  misc_feature (297)..(297): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgagggganagagccaccctctcctgcaggggccggtnagaatattgcctaccaattagcctggtatacaaacaaagcctggccaggctcccagactcctcatctctggtnctatccgttcggacgggcctagtggtcgtccccagcccgtaggttcaggtcggcctagggtggggtctagggaaacctagggtacgttcaacttcctaccaacctatacgacgtccggcctcggctaagttcgtaggaaagttactttttggacttaaggtttttaactacgttcggtacaggtactaagttaatttaaacgtaggttaacggtttaggggttttttaacttaccgtttaaccgttttccggggacccccgtttagggggtaaaaccctaaaacgggtttggttaactttttacgaaaacgggttaccgtaaaacgtttgggtcgggtacttaacggaacctaacccttacgttccgtcggtttaccctttcttaaaccc

SEQ ID NO: 318419 - DNA, 680 bp, Homo sapiens
  misc_feature: GZ8MTXP02HU52K.10.20.B09.1.454.CMB.2.raw
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccacctgtctgtgtctccgaggggagagacgccaccctctcctgcgacggggccggtacaagaattattcgaccttaaccaacttagcctaggtaactacaaaacaaagcctggccaggcctcccagcctcctcactctgtggtgctacttcgttcggacgggtcctacgttcgggtcgtcccgagccgtaggttcaggtcggacgtaggttcggggtactaggaaccgagttcgttccactcctaccaccagtaccgacggtccgctaggcgtacgtctaaggtaacgtttcgttttgactttaagttttactaccgttagtcgtaagtacgttaagttaaacgttaggttacggttaacggtttttgggtttttaaccttcggttaaccggtttccggaacccggttacggggtaaaaccttaaaggggttcgtttaaacgtttacgaacggttaacgtaacgttggttacgctaacgactaacgttctcgtttacgtctttactacccg

SEQ ID NO: 318420 - DNA, 741 bp, Homo sapiens
  misc_feature: GZ8MTXP02GEQR3.10.20.B09.1.454.CMB.2.raw
  modified_base (195)..(195): a, c, t, g, unknown or other
  misc_feature (195)..(195): n is a, c, g, or t
tcagcatagtagtgcacgaccggtgctcgatttagtgtagtgtgaagggggagtaactgctcagttaggacccagacggaaccatggaagccccagcgcagcttctcttcctcctgctactctggctcccagacaacactgcagaaatagttatgacgcagtctccagccaccctgtctgtgtctccgagggganagagcccaccctctcctgcgacgggccggtcaggaatattgactaccaacttagccttaggtatacaaacaaagcctggccaggcctacccgagactcctcactctcgtggtgctatcgttcggacgggtcctacgtcgggtcgtaccccgagtacccgtaggttccaggtcgggactacggggttcggggttaccgtaacgggtaaaccgtaggtacggttttacccaaccgtttccgtacccaacccgtaattccgacgggcccgggtcccttacggaccgtaacggtttcgtaaggttaaaacggttttcgtttttacggacgttttaagttttaacgttacgttacggttacgacgttacttaaaggtttaacttaacggttacggtttaacgtttttacgggttttactttacccgttaacggtttcccgggaaccggttacggtaaacgttaaggttacggttaacttacggaacgttaaccgtaggttacggtacgtacgtaacgtacctacgtacttcgttacgttccttaccgtccg

SEQ ID NO: 318421 - DNA, 625 bp, Homo sapiens
  misc_feature: GZ8MTXP02I2H03.10.20.B09.1.454.CMB.2.raw
  modified_base (192)..(192): a, c, t, g, unknown or other
  misc_feature (192)..(192): n is a, c, g, or t
  modified_base (219)..(219): a, c, t, g, unknown or other
  misc_feature (219)..(219): n is a, c, g, or t
tcagcatagtagtgcacgaccggtgctcgatttagtgtagtgtgaaggggggaactgctcagttaggacccagacggaaccatggaagccccagcgcagcttctcttcctcctgctactctggctcccagacaacactgcagaaatagttatgacgcagtctccagccaccctgtctgtgtctccagggganagagccaccctctcctgcagggccgtnagatatgcacaactagctgtatcaacaaaagctgcaggctccacgactcctcatctctggtgcatcttcgacggcctctggtcgtcccagccaggttcagtggccgaggtgggtctaggaacgtagacgttcgacctccgtccacccacttacgaacggccgggtcccgtgtaccgaacgttccgtagtaaaggtactttttggtacgtagtttttaattacctgttacgagtactaaggttaattaattggtaacgtttacgggttttattactaccggttttcggccccggtaaggtacgtaaaacgtttgggtactttacaacggtaacggtaaactttggggtacggtcttacgggaacctaacctaattccggttagttaccctttactaccttttacccg

SEQ ID NO: 318422 - DNA, 603 bp, Homo sapiens
  misc_feature: GZ8MTXP02HSZ3Q.10.20.B09.1.454.CMB.2.raw
  modified_base (195)..(195): a, c, t, g, unknown or other
  misc_feature (195)..(195): n is a, c, g, or t
  modified_base (221)..(221): a, c, t, g, unknown or other
  misc_feature (221)..(221): n is a, c, g, or t
  modified_base (581)..(581): a, c, t, g, unknown or other
  misc_feature (581)..(581): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgagggganagagccacctctcctgcagggccgtnagaatatgactacaacttgcctggtatcaacaaagcctggaccaggcctcccagacctcctcatctcgtggtcgctagtcttcggacgggcctacgttgggtcgtacccagcctaggttcagtcggcaggtggtcgtggaacagtcgtttccactctaccgaccagtacgacgccgtcctagctagtccgttagtaagttatttttggacctttaaggtttacttacttgtactacgacttaagttattaaagtgtaacgtttgggttttaacttcgtacgtttaccggcgtaggggtaacctaaaggttcggttattcgaaggtacgtaacgtggtacggtcttcggacctaaccgttntccgtttacttcttacgttacc

SEQ ID NO: 318423 - DNA, 693 bp, Homo sapiens
  misc_feature: GZ8MTXP02JQT8S.10.20.B09.1.454.CMB.2.raw
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgaggggagagagcccaccctctcctgcgagggccgtcagaatattgctaccaacttagcctggtatacaacaaagcctggccaggcctacccgagacctcctcatcctcgtggtgctatccgttcggacgggtcccacgttcgggtcgtccccgagtcccgtagggttcaggtcgggctaggggttcgggtacgtagggaaaccgtaggtacgttaccaaccttccgtacccaacctacgtccgacgggcccgggtccctggaccgtaggttacctagggtaaagtttctttttcggactttaacggttttacttacgttgtaccgtagtacgtaaggtttaactaaggttacggttaacgttttaggggtttttaacttaccgttaccgttttcccggggacccgtagggtaaacccgtaaagggttcggttactttacggaacggtaacgttacgtggtacggctaacgacctaccgtattaccgtcgttaccttacgtacccg

SEQ ID NO: 318424 - DNA, 561 bp, Homo sapiens
  misc_feature: GZ8MTXP02IV4Z3.10.20.B09.1.454.CMB.2.raw
  modified_base (196)..(196): a, c, t, g, unknown or other
  misc_feature (196)..(196): n is a, c, g, or t
  modified_base (225)..(225): a, c, t, g, unknown or other
  misc_feature (225)..(225): n is a, c, g, or t
  modified_base (257)..(257): a, c, t, g, unknown or other
  misc_feature (257)..(257): n is a, c, g, or t
  modified_base (280)..(280): a, c, t, g, unknown or other
  misc_feature (280)..(280): n is a, c, g, or t
  modified_base (285)..(285): a, c, t, g, unknown or other
  misc_feature (285)..(285): n is a, c, g, or t
  modified_base (393)..(393): a, c, t, g, unknown or other
  misc_feature (393)..(393): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagcccaccctgtctgtgtctccgagggganagacgcccaccctctcctgcagggccgtnagatatgctacaattgctgtatcaacaaagcngccagctccagactcctcatctntggtncatcttcggaggccacgtggtcgtcccagcctaggttcaggtcggctaggtcggtctaggaacagtcgttcactctacacatcgagccgctgctagtctagtaagttnttttgacttaagtttactacgtgtacagtactagttaactagttagtacgtttaggttttactcgttacgtttccggacccgttagggaaccttaaaggtcggttaatttccgaagtacgtacgttcggtcggactcgactaactacgtcttcgttaccttactaccg

SEQ ID NO: 318425 - DNA, 567 bp, Homo sapiens
  misc_feature: GZ8MTXP02JTPMZ.10.20.B09.1.454.CMB.2.raw
  modified_base (288)..(288): a, c, t, g, unknown or other
  misc_feature (288)..(288): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgccagggccggtcagaatattgctaccaattagcctggtatcaacaaagcctggccaggctcccagactcctcatctntggtgctatcttcggagggccacgtggtcgtcccagcctaggttcaggtcggctaggtcgggtctggaacaggtgttcactctcaccatccagcgcctgctagtctagtagtacttttgacttagtttacttacgtgtcagctagtatagtgtacgttgggttttactacgtacgtttcggaccgttcgggaacctaaaaggttcggtactttacggaaggtaaccgtaacgttggtcggacttaacggcctaaccctagtcctacgttccttctaccg

SEQ ID NO: 318426 - DNA, 788 bp, Homo sapiens
  misc_feature: GZ8MTXP02JGKH0.10.20.B09.1.454.CMB.2.raw
  modified_base (195)..(195): a, c, t, g, unknown or other
  misc_feature (195)..(195): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgagggganagagcccaccctctcctgcgagggccggtcagaatattgacctaaccaacttacgcctaggtactacaaacaaagcctaggccaggcctacccagtacctcctcatcctgtggtcgcctagttccgttacggacgggcccctacgttcgggttcgtacccccgaggtcccgtaagggtttcgaaggtccggggactaaggggttcggggtactaggggaaacctaggtacggtttccaaccgttcctaccaacccgtaacgttccgaacgggtcccgggtcccttagggccctaaacgggttccttaaagggtaaaacgtttgtttttcggaaccgtttaaaggtttttacttaccgttcggttaacctaaaggttaccgttaaagttaaagtttaagtttacgggttaaaccgtttttaggggtttttaactttacccgttaaccggtttttccccgggggacccgtttaaacgggggaaaacccttaaaaggggttcggttaaacctttacggaaaccggttaaaccgtaagtttcgggtaggtacccttaaggaccctaaaccgttcgttcgttcgttaccttactaccg

SEQ ID NO: 318427 - DNA, 575 bp, Homo sapiens
  misc_feature: GZ8MTXP02F0GI9.10.20.B09.1.454.CMB.2.raw
  modified_base (196)..(196): a, c, t, g, unknown or other
  misc_feature (196)..(196): n is a, c, g, or t
  modified_base (231)..(231): a, c, t, g, unknown or other
  misc_feature (231)..(231): n is a, c, g, or t
  modified_base (253)..(253): a, c, t, g, unknown or other
  misc_feature (253)..(253): n is a, c, g, or t
  modified_base (292)..(292): a, c, t, g, unknown or other
  misc_feature (292)..(292): n is a, c, g, or t
  modified_base (297)..(297): a, c, t, g, unknown or other
  misc_feature (297)..(297): n is a, c, g, or t
  modified_base (375)..(375): a, c, t, g, unknown or other
  misc_feature (375)..(375): n is a, c, g, or t
  modified_base (411)..(411): a, c, t, g, unknown or other
  misc_feature (411)..(411): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctggtgtctccgagggganagacgcccaccctctcctgcagggccgtcagaatntgactaccaacttgcctggtancaaacaaagcctggccaggcctccagacctcctcatctntggcncattcgtcggaggccacgttgggtctcccagccgtaggttcagtcggacagggtcgggtctaggaacagtcgttaccncgtctccacatcgagccgctgcagtctgtaaagttntttagactttagtttactacgttagtacgagtactaagttacttagttagttacgttttaggtttacttcgttacgttccggaccgttaggaacgtaaggtggttacttacgaacgtacgtacgtggtcgtcgtaacgacactacttcgttcttccgttctacg

SEQ ID NO: 318428 - DNA, 534 bp, Homo sapiens
  misc_feature: GZ8MTXP02I9U2A.10.20.B09.1.454.CMB.2.raw
  modified_base (194)..(194): a, c, t, g, unknown or other
  misc_feature (194)..(194): n is a, c, g, or t
  modified_base (221)..(221): a, c, t, g, unknown or other
  misc_feature (221)..(221): n is a, c, g, or t
  modified_base (227)..(227): a, c, t, g, unknown or other
  misc_feature (227)..(227): n is a, c, g, or t
  modified_base (283)..(283): a, c, t, g, unknown or other
  misc_feature (283)..(283): n is a, c, g, or t
  modified_base (293)..(293): a, c, t, g, unknown or other
  misc_feature (293)..(293): n is a, c, g, or t
  modified_base (360)..(360): a, c, t, g, unknown or other
  misc_feature (360)..(360): n is a, c, g, or t
  modified_base (405)..(405): a, c, t, g, unknown or other
  misc_feature (405)..(405): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccacctgtctgtgtctccgagggganagacgccacctctcctgcagggccgtnagaatntgctaccaacttgcctggtatacaacaaagcctggccaggcctcccagacctcctnatctcgtggnctagtctcgacgggccacgtgggtctccccgagtcctaggttcaggtggcaggtgggtctggaaacngtgttcacttctacaccatcgacgcgtctgctagtctagtaagtntttgacttagtttactactaggttacagtactaagtattagtgtacgttggtttactcgtacttcggcgtaggactaagtgtattcacgtacgtactggtacgctaacgctactactctcgtctacttc

SEQ ID NO: 318429 - DNA, 613 bp, Homo sapiens
  misc_feature: GZ8MTXP02IHQHD.10.20.B09.1.454.CMB.2.raw
  modified_base (195)..(195): a, c, t, g, unknown or other
  misc_feature (195)..(195): n is a, c, g, or t
  modified_base (229)..(229): a, c, t, g, unknown or other
  misc_feature (229)..(229): n is a, c, g, or t
  modified_base (400)..(400): a, c, t, g, unknown or other
  misc_feature (400)..(400): n is a, c, g, or t
  modified_base (421)..(421): a, c, t, g, unknown or other
  misc_feature (421)..(421): n is a, c, g, or t
  modified_base (425)..(425): a, c, t, g, unknown or other
  misc_feature (425)..(425): n is a, c, g, or t
  modified_base (431)..(431): a, c, t, g, unknown or other
  misc_feature (431)..(431): n is a, c, g, or t
  modified_base (446)..(446): a, c, t, g, unknown or other
  misc_feature (446)..(446): n is a, c, g, or t
  modified_base (465)..(465): a, c, t, g, unknown or other
  misc_feature (465)..(465): n is a, c, g, or t
  modified_base (473)..(473): a, c, t, g, unknown or other
  misc_feature (473)..(473): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgagggganagacgcccaccctctcctgcgacggggccggtanaagaattattgaccttaaccaactttagcctaggtaactacaaacaaaacgcctggaccaggcctaccacgacctcctcatcctcgtggtcgctatccgttacggacgggtccacgtcgggtcgtcccaggccgtaggttcgaggtcggctaggtcgggtactaggaaccngtacgttcactcctacacctntacncgcgcngccagtctagagttntttgacttagttattacgngtacagtntaatattagtgtacgtttggtttattcgtacgttttccggaccgttagggaaccttaaaagggtgttaacttacgaaacggtaacctaacgttcggttcgacgttaacgccgtaactacttcgttcgttactttcacccg

SEQ ID NO: 318430 - DNA, 803 bp, Homo sapiens
  misc_feature: GZ8MTXP02GZXY9.10.20.B09.1.454.CMB.2.raw
  modified_base (194)..(194): a, c, t, g, unknown or other
  misc_feature (194)..(194): n is a, c, g, or t
  modified_base (280)..(280): a, c, t, g, unknown or other
  misc_feature (280)..(280): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccagggganagagccaccctctcctgcagggccgtcagaatattgctaccaacttgcctggtatcaacaaagcctggccaggctcccagactccncatctctggtgcatccttacggacgggccctactgggtcgtccccgagccctaggggtttccaggtcggacctagggttcggggtctggggaaacctagggtcggtttaccaacgttccttaccgaaaccctagttacccaaagggtccccgggcctttacggaccgtaacggtttcccgttaagggtaaaaaggtttcgtttttttacgggaccctttaaagggtttttaaccgttttaaccgtttagggttaccccgtaaggttacccgtaaaggtttaaccttaaaaggtttacggttaaccgttttaggggggtttttttaaactttcccgttaaacccgtttttcccgggggaacccccgtttagggggtaaaaccccttaaaaaggggtttcgggttaaacctttttacggaaaacggttaaaccggtaaaccggttaggggttccggtaacgtttccgggaacccttaaacccgttaacgttccgttacggtttcccgtttttaaccctaaccccg

SEQ ID NO: 318431 - DNA, 610 bp, Homo sapiens
  misc_feature: GZ8MTXP02H2505.10.20.B09.1.454.CMB.2.raw
  modified_base (195)..(195): a, c, t, g, unknown or other
  misc_feature (195)..(195): n is a, c, g, or t
  modified_base (209)..(209): a, c, t, g, unknown or other
  misc_feature (209)..(209): n is a, c, g, or t
  modified_base (269)..(269): a, c, t, g, unknown or other
  misc_feature (269)..(269): n is a, c, g, or t
  modified_base (275)..(275): a, c, t, g, unknown or other
  misc_feature (275)..(275): n is a, c, g, or t
  modified_base (281)..(281): a, c, t, g, unknown or other
  misc_feature (281)..(281): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctggtgtctccagggganagagccacctctcngcagggcgtcagatatgctacacttgctgatcaacaaagcctggcagctcccagctaccnatctcnggtgcntcttcgaggccacgtgtcggtcccagaccgtaggttcaggtcgggcaggttaggggccgttaggaaacgtaacgtggtttcctaacgtcccttccaacccaatcccggaaagccggtacccgttcgcgaacgttccgtagtaagttagtttacgtagtactttagtttaacttggttactgtactagtaacgttatagtacgtttgggtttattttacgcgttttaaccggtcccggtacgttaccggtaagtacggttaaagtttacgtacgtaacggttaacgtcggtactacgggtctctaacgtcctacgtacgtctttacgtcc

SEQ ID NO: 318432 - DNA, 691 bp, Homo sapiens
  misc_feature: GZ8MTXP02IS3DX.10.20.B09.1.454.CMB.2.raw
  modified_base (307)..(307): a, c, t, g, unknown or other
  misc_feature (307)..(307): n is a, c, g, or t
  modified_base (440)..(440): a, c, t, g, unknown or other
  misc_feature (440)..(440): n is a, c, g, or t
tcagcatagtagtgcacgaccggtgctcgatttagtgtagtgtgaaggggggaactgctcagttaggacccagacggaaccatggaagccccagcgcagcttctcttcctcctgctactctggcctcccagacaacactgcaagaaatagttatgacgcagtctccagcccaccctgtctgtcgtctccgaggggagagacgcccaccctctcctgcgaggggccgtcagaatattcgactaccaacttagcctggtactacaaacaaaagcctggccaggcctccagacctcctcatctcgtggtnctatcttcggacggcctacgtggtccgtcccgagcccgtaggttccaggtcggccgtaggttgggtcgtaggaacagtacttcgacctctccaccatcgacgccggcctgcgtacgtacgtaggtaaacgttnttttcgacgtttaagttttaactaccgttgtaccgaaggttactaaagttaagttaagttggttaaccggttttagggtttttaacttccgtttaccggttttacccgggtaccccggttaaggggtaaaacccgttaaaaggtttcgggtacttttacggaacgggtaaacgtaacgttcggtaacgggttctacgggtccctaaacccgtagtttccgttacgtttaccctttcgaaccttttcccccg

SEQ ID NO: 318433 - DNA, 654 bp, Homo sapiens
  misc_feature: GZ8MTXP02F8BCM.10.20.B09.1.454.CMB.2.raw
  modified_base (195)..(195): a, c, t, g, unknown or other
  misc_feature (195)..(195): n is a, c, g, or t
  modified_base (626)..(626): a, c, t, g, unknown or other
  misc_feature (626)..(626): n is a, c, g, or t
  modified_base (630)..(630): a, c, t, g, unknown or other
  misc_feature (630)..(630): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcaagaaatagttatgacgcagtctccagccacctgtctgtgtctccgagggganagacgcccaccctctcctgcgacggggccggtacaagaattattgacctaaccaacttagcctaggtatacaaaacaaagcctaggccaaggccctacccagacctcctacactctcgtggtgcctattccgttacgggacgggtccctacggttcgggtcccgtaccccgtaacggtccccgtaagggtttaccgaggttccgggaccgtaggggttcggtacgtagggaaaccgtggttacgtccacttcgacccaaccgtactccgacggtcccggtccctggacccgtaagtccgttaagaaacgtttgttttacgacgtttagtttactacgtgtacagtactagttaatacgttgttacgtttggtttaactcgttaccgttcggtacccgtagtaacgtaagtcgttattacgataccgtatgngtcncgactactactctcgtactcgtac

SEQ ID NO: 318434 - DNA, 707 bp, Homo sapiens
  misc_feature: GZ8MTXP02JKAZO.10.20.B09.1.454.CMB.2.raw
  modified_base (194)..(194): a, c, t, g, unknown or other
  misc_feature (194)..(194): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccacctgtctgtgtctccgagggganagacgccacctctccgtgcgacgggccggtcaagaatattcgactaacctaacttgcctggtacacaacaaagcctgcagcctccgagactcctcatctcgtgtgctacgtcgttacggacggcctacgtgggtcgtcccgacgtccgtaggttcaggtcggtacgtagggtgggtcgtaggaaaccgagttcggttaccaccgttcctaccgaacctaacgtcgacgggtcccggtcgttacggacccgtacgttaccgttaaggtaaacgtttcgtttttacggaacgttttagttttacgttaacggttcgttacgaaacgtaccgttaaaggttaacttaaggttacgttacggttttacgggttttaacttccgtttaaccggtttcccgggacccgttaaagggggtaaccctaaaagggtttcggttactttaccggaaaggttaaccgacggttagttcggctaacggtacgtaccttacgtcgttacgttacctcgttaccccg

SEQ ID NO: 318435 - DNA, 676 bp, Homo sapiens
  misc_feature: GZ8MTXP02IUOJ5.10.20.B09.1.454.CMB.2.raw
  modified_base (195)..(195): a, c, t, g, unknown or other
  misc_feature (195)..(195): n is a, c, g, or t
  modified_base (252)..(252): a, c, t, g, unknown or other
  misc_feature (252)..(252): n is a, c, g, or t
  modified_base (257)..(257): a, c, t, g, unknown or other
  misc_feature (257)..(257): n is a, c, g, or t
  modified_base (266)..(267): a, c, t, g, unknown or other
  misc_feature (266)..(267): n is a, c, g, or t
  modified_base (278)..(278): a, c, t, g, unknown or other
  misc_feature (278)..(278): n is a, c, g, or t
  modified_base (283)..(283): a, c, t, g, unknown or other
  misc_feature (283)..(283): n is a, c, g, or t
tcagcatagtagtgcacgaccggtgctcgatttagtgtagtgtgaaggggggaactgctcagttaggacccagacggaaccatggaagccccagcgcagcttctcttcctcctgctactctggcctcccagacaacactgcaagaaatagttatgacgcagtctccagccaccctgtctgtgtctccgagggganagacgcccaccctctcctgcgagggccgtcagatattcgactacatgctgtatcaanaagcngcagctccnnctctcatctcnggtcnctatcgtcgacggcctagtcggtctcccgagcccgtaggttccgaggtcggccgtagggtcgggttacgtacgggtaacagggttaccgttcctaaccgttcccttccgaacccctagttacccggaagggtcccggtcccgtaggtaccctaggttaccgtaaggtaaagtttacgtttttccggaactttaagtttttaactagtcgttacgaacgtacgtaaagtttagtaacgttacggttacgtttacgggtttttactaccgttcggttttaaccggccggttaaacgggaaaccttaagggttacgttactttacggtaacgtaaacgttacgtggttacggcttcgaacgacccttagtcttacgtttctacctacgtttccccg

SEQ ID NO: 318436 - DNA, 801 bp, Homo sapiens
  misc_feature: GZ8MTXP02G4WJA.10.20.B09.1.454.CMB.2.raw
  modified_base (198)..(198): a, c, t, g, unknown or other
  misc_feature (198)..(198): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggcctcccagacaacactgacaagaaatagttatgacgcagtctccacgccacctgtctgtcgtctcgagggganagacgcccaccctctccgtgcgacgggccgtacaagtaattattcgacctaacctaacttacgccgtaggtaactaacaaaacgaaaacgccgtacggaccacggacctacccgagtaccctcctactacttccgtcgtggtacgactacttccgttacggacggtcccgtacgttcgggtccgtacccgacggtaccgtagggttcgacggtcggtaccgtaggggttcgggtaacgtacgggaaaacacgggttaccgttacctaacctaccccgtaaacctaacccgtacgtaccgggtaccgggtcccgttaccgtacggtaccggttaccggttaagttaaacgggtttaaacttttggttaacgtttaaaccggttttaaagtttaccgttaccggttagtaacgttaaacgtaaacgtttaaagttactttaaagggttacgtttacgtttttaacggttaccgttacgtttaccggtccgggttaacggtaaacgtaaagttacggtacgtttaactaacggggaactacggttacgtcggtaccgtacgtaaccgtcttaaaccggtcttacgtccgtttacctactttccccg

SEQ ID NO: 318437 - DNA, 609 bp, Homo sapiens
  misc_feature: GZ8MTXP02IJOZY.10.20.B09.1.454.CMB.2.raw
  modified_base (195)..(195): a, c, t, g, unknown or other
  misc_feature (195)..(195): n is a, c, g, or t
  modified_base (252)..(252): a, c, t, g, unknown or other
  misc_feature (252)..(252): n is a, c, g, or t
  modified_base (258)..(258): a, c, t, g, unknown or other
  misc_feature (258)..(258): n is a, c, g, or t
  modified_base (272)..(272): a, c, t, g, unknown or other
  misc_feature (272)..(272): n is a, c, g, or t
  modified_base (283)..(283): a, c, t, g, unknown or other
  misc_feature (283)..(283): n is a, c, g, or t
  modified_base (372)..(372): a, c, t, g, unknown or other
  misc_feature (372)..(372): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgagggganagagccaccctctcctggcacgggccgtcagaatatgctaccattagctgtatcaanaaagcngcagctccagctcncatctctggtnctactcttcggacggcctacgttggttccgtaccccgagtacccgtagggtttcaggttcgggacctaggtcggggtctagggaaaccngtacggttccaactccgtaccacctatcgacgcgctcgctagtctagagttactttacgacttaagtttactcgttgtacgagtactagttaacgttatagtacgtttaggggtttttactcgttaccggtttcgacccggtacggtaaccgtaaaggttggtaaactttcgaaacggtaacgtacgttacggtgaccgttgaccctaacttcttacgtttcttccttactaacccg

SEQ ID NO: 318438 - DNA, 538 bp, Homo sapiens
  misc_feature: GZ8MTXP02IXGP0.10.20.B09.1.454.CMB.2.raw
  modified_base (195)..(195): a, c, t, g, unknown or other
  misc_feature (195)..(195): n is a, c, g, or t
  modified_base (295)..(295): a, c, t, g, unknown or other
  misc_feature (295)..(295): n is a, c, g, or t
  modified_base (316)..(316): a, c, t, g, unknown or other
  misc_feature (316)..(316): n is a, c, g, or t
  modified_base (352)..(352): a, c, t, g, unknown or other
  misc_feature (352)..(352): n is a, c, g, or t
  modified_base (363)..(363): a, c, t, g, unknown or other
  misc_feature (363)..(363): n is a, c, g, or t
tcagcatagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgagggganagagcccaccctctcctgcagggccgtcagaatatgactaccaacttgccgtgtatcaacaaagcctggccaggcctcccagacctcctcatctctggtncatcttcgaggccacgtggtntcccagccgaggttcagtcgcaggtggtctggaacngcgttcactcncacatcagccgctgcgagtctagagttatttgcttacgtttatccttagtactaggactaagtacttaagtgtaacgttggtttacttcgtacgtttccgacgtgaacgttaagtggtacttcgagacgtaacgtgaggtctaagccctacgtactctacgttccttacgtaccg

SEQ ID NO: 318439 - DNA, 529 bp, Homo sapiens
  misc_feature: GZ8MTXP01CKXRR.3.81.H04.1.454.CMB.2.raw
  modified_base (468)..(468): a, c, t, g, unknown or other
  misc_feature (468)..(468): n is a, c, g, or t
tcagagacgcactccacgaccggtgctcgatttagtagtgtagattcgcgggctggtggagtctggggaggcttggtccagcctgggggtccctgagactctcctgtgcagcctctggattcagctttagtaccaattggatgaactgggtccgccaggctccagggaagggctggagtggctggcccacataaacccagatggaacttattcacactatgtggactctgtgaggggccattcaccatctccagagacaaagccaagaactcactgtatctaggaaatgaacagcctgagagccgaggacacggctgtgtattactgtgcgagagggccggctttgggggtcaggaccgtcctacgctatgggacgtcgtggggccaagggccacggtcaccgtctcctcagcctccacaaggcccatcggtctcccctgggcgccctgctccagcgcaccgtcgagngcacaagcggcccgtgggctggccttggcaagggcctacgttccgagtgcgtcgttcgtgg

SEQ ID NO: 318440 - DNA, 575 bp, Homo sapiens
  misc_feature: GZ8MTXP01AWVZV.3.81.H04.1.454.CMB.2.raw
tcagagacgcactccacgaccggtgctcgatttagtagtgtagattcgcgggctggtggagtctggggaggcttggtccagcctggggggtccctgagactctcctgtgcagcctctggattcagctttagtaccaattggatgaactgggtccgccaggctccagggaagggctggagtggctggcccacataaacccagatggaacttatcacactatgtggactctgtgaggggccattcacatctccagagacaaccccaagaactcactgttctgcaaatggacagcctgagagccgaggacacggctgtatattactgtgcgagagatatgaagaaactcaatagaataagaaatcgagggagtgggggaccagggaacccgtgtcaccgtctcctcacgcctccaccgaacgggcccacgtccggtccttccccgtcggggcccgcccgtcgcctccgacggacgaccaccctccgacgacgccgacgaacggccggcccgtcgggccgtcggcccgttcggttcaacgggtaacctacgttccgacgtccgttctcgttggaacggg

SEQ ID NO: 318441 - DNA, 702 bp, Homo sapiens
  misc_feature: GZ8MTXP01C08DQ.3.81.H04.1.454.CMB.2.raw
  modified_base (193)..(193): a, c, t, g, unknown or other
  misc_feature (193)..(193): n is a, c, g, or t
  modified_base (278)..(278): a, c, t, g, unknown or other
  misc_feature (278)..(278): n is a, c, g, or t
  modified_base (322)..(322): a, c, t, g, unknown or other
  misc_feature (322)..(322): n is a, c, g, or t
  modified_base (349)..(349): a, c, t, g, unknown or other
  misc_feature (349)..(349): n is a, c, g, or t
tcagagacgcactccacgaccggtgctcgatttagtagtgtagattcgcgggctggtggagtctgggggaggcttggtccagcctggggggtccctgagactctcctgtgcagcctctggattcagctttagtaccaattggatgaactgggtccgccaggctccgagggaagggctggagtggctggcccanataaacccagatggaacttatcacactatgtggactctgtgagggccattcacatctccagagacaacccaagactcactgttcngacaaatggacagctgagagccgagacacggctgtatattacgngtgcgaagagatatacgaagaaactanaataagaataagaaagtcggaaggggaggacgggggaccgaaacgggtaacccgtcggtacctaccgtcctaccgtacgaccgtacccctacccgaaccggtaaccggccccttacgttccccggttaccccttcccccggtcggggtccccgtccccgtcgtacccgtaccgaacggaccgacccgtaacccgtaccggaaggaccgtacccgaaccgggtccgggccccgggttcccggtcggggttccgtaccgggtcccggttacggggttacccgaaaccgggttaacccctttacccggttaaccgggtacggttcccggttacccggtttccgttcgggtaacggg

SEQ ID NO: 318442 - DNA, 628 bp, Homo sapiens
  misc_feature: GZ8MTXP01EY6QJ.3.81.H04.1.454.CMB.2.raw
  modified_base (192)..(192): a, c, t, g, unknown or other
  misc_feature (192)..(192): n is a, c, g, or t
  modified_base (201)..(201): a, c, t, g, unknown or other
  misc_feature (201)..(201): n is a, c, g, or t
  modified_base (279)..(279): a, c, t, g, unknown or other
  misc_feature (279)..(279): n is a, c, g, or t
tcagagacgcactccacgaccggtgctcgatttagtagtgtagattcgcgggctggtggagtctgggggaggcttggtccagcctggggggtccctgagactctcctgtgcagcctctggattcagctttagtaccaattggatgaactgggtccgccaggctccagggaagggctggagtggctggcccanataaacccngatgaactattcacactatgtgcactgtgaggggccattcaccatctccagagacaaccccaagaactcactgtttcngcaaatggacagcctgagagccgaggacgacgactgtatagtactgtgacgagagacgtaatagagaaactacaaaatagaagtaagaaagtacgagggacggtacggggtaccgacgggtaacccgtaccggtaccgtacccgtcccgtcccgtacccaccgaccctacccgaccccgaaacgggtcccccgtacctccggtcccgttccccccgccgccgccccgtcgccgtcccgacggacgccacccgtcccgacgacgccgaaccgacgccggccccgttcgggtccgtttcccgttcgggttcctaacgggacctaacgttcccgacgttcgtccgttcgtcg

SEQ ID NO: 318443 - DNA, 602 bp, Homo sapiens
  misc_feature: GZ8MTXP01DJRHV.3.81.H04.1.454.CMB.2.raw
  modified_base (233)..(233): a, c, t, g, unknown or other
  misc_feature (233)..(233): n is a, c, g, or t
  modified_base (282)..(282): a, c, t, g, unknown or other
  misc_feature (282)..(282): n is a, c, g, or t
  modified_base (329)..(329): a, c, t, g, unknown or other
  misc_feature (329)..(329): n is a, c, g, or t
  modified_base (355)..(355): a, c, t, g, unknown or other
  misc_feature (355)..(355): n is a, c, g, or t
  modified_base (361)..(361): a, c, t, g, unknown or other
  misc_feature (361)..(361): n is a, c, g, or t
  modified_base (411)..(411): a, c, t, g, unknown or other
  misc_feature (411)..(411): n is a, c, g, or t
  modified_base (481)..(481): a, c, t, g, unknown or other
  misc_feature (481)..(481): n is a, c, g, or t
tcagagacgcactccacgaccggtgctcgatttagtagtgtagattcgcgggctggtggagtctgggggaggcttggtccagcctgggggggtccctgagactctcctgtgcagcctctggattcagctttagtaccaattggatgaactgggtccgccaggctccgagggaagggctggagtggctggcccaacaataaacccagatggaacttattcacactatgtgactntgtgagggccattcacatctacagacgacaacccaagactcactgttcngacaaatggacagcctagagcgaccgagacacggctgtatattacgngtgcgagagatactagaaagaaactnaaatanaataagaaatggaagggagtcggggacaagggaaccctggtacaccgtcnctacacgaccctaccgaacgaccgggcccacgttcccgtcccgttccccccgtcgggcccgtcccgtccnccgtaccgacgccgacctacccgaccgagacgccgaacgccggtcccgcggttcggacgtcggtccgttacggacgaaccgttaacctaccgttcggacgtccgcgttcgttccggaaggg

SEQ ID NO: 318444 - DNA, 611 bp, Homo sapiens
  misc_feature: GZ8MTXP01CPCM5.3.81.H04.1.454.CMB.2.raw
  modified_base (229)..(229): a, c, t, g, unknown or other
  misc_feature (229)..(229): n is a, c, g, or t
  modified_base (299)..(299): a, c, t, g, unknown or other
  misc_feature (299)..(299): n is a, c, g, or t
tcagagacgcactccacgaccggtgctcgatttagtagtgtagattcgcgggctggtggagtctgggggaggcttggtccagcctggggggtccctgagactctcctgtgcagcctctggattcagcttttagtaccaattggatgaactgggtccgccaggctccagggaagggctggagtggctggcccacataaacccagatggaacttatcacactatgtgactntgtgagggccattcacatctccagacacaaccccaagactcactgttctgacaaatggacagcctagagngccgaggacacggctagtatattacgtgtgacgagagattatagaagaaactcaaatagaataagaaatcgagggagtcgggggacaacgggaccctggtaccaccgtctcctcgacgaccctaccgaccgaacgggcccagttccggtcccttcccccgtgggggccctcccgtcgcctccgaggaccgccacccgtccgagacgcaaccgcggcccggcccgtggggcctcgggtcccgttagggttacccgttaaacgggtcccttaccgtttcccgggagttccggttaccgttccgttcgtaagggg

SEQ ID NO: 318445 - DNA, 552 bp, Homo sapiens
  misc_feature: GZ8MTXP02HTSED.3.81.H04.1.454.CMB.2.raw
  modified_base (463)..(463): a, c, t, g, unknown or other
  misc_feature (463)..(463): n is a, c, g, or t
tcagagacgcactccacgaccggtgctcgatttagtagtgtagattcgcgggctggtggagtctgggggaggcttggtccagcctggggggtccctgagactctcctgtgcagcctctggattcagctttagtaccaattggatgaactgggtccgccaggctccagggaaggggctggagtggctggcccacataaacccagatggaacttattcacactatgtggactctgtgaggggccgattcaccatctccagagacaaccccaagaactcactgttctgcaaatggacagcctgagagccgaggacacggctgtatattactgtgcgagagatatgagaaactcaatgatagaaatcgagggagtgggggaccagggaaccctggtcaccgtctcctcacgcctccacaacgggcccatcggtccttcccccgtgccgtccctcgcctccgaggacncacctccgagacgcacacgccggccctcgggccttcgccgtcggtaccaaagggtaacctacgttcccggagtcgccgttctcgtcggg

SEQ ID NO: 318446 - DNA, 546 bp, Homo sapiens
  misc_feature: GZ8MTXP02GO129.3.81.H04.1.454.CMB.2.raw
  modified_base (541)..(541): a, c, t, g, unknown or other
  misc_feature (541)..(541): n is a, c, g, or t
tcagagacgcactccacgaccggtgctcgatttagtagtgtagattcgcgggctggtggagtctggggaggcttggtccagcctgggggtccctgagactctcctgtgcagcctctggattcagctttagtaccaattggatgaactgggtccgccaggctccagggaagggctggagtggctggcccacataaacccagatggaacttatcacactatgtggactctgtgagggccgattcaccatctccagagacaaccccaagaactcactgttctgcaaatggacagcctgagagccgaggacacggctgtatattactgtgcgagagatatgagaaactcaatgatagaaatcgagggatgggggccaaggggaaccctggtccaccgtctcctcacgcctccaccgaaacgggcccaagtccgggtccttcccccgtggccgtcccctggcctcccgaggacgccacctccgagacgcacacgccggccctggggcctgacccgtggtccaagggctacgttccgagtcgcgtcncgtgg

SEQ ID NO: 318447 - DNA, 557 bp, Homo sapiens
  misc_feature: GZ8MTXP02GSTG3.3.81.H04.1.454.CMB.2.raw
  modified_base (327)..(327): a, c, t, g, unknown or other
  misc_feature (327)..(327): n is a, c, g, or t
  modified_base (471)..(471): a, c, t, g, unknown or other
  misc_feature (471)..(471): n is a, c, g, or t
tcagagacgcactccacgaccggtgctcgatttagtagtgtagattcgcgggctggtggagtctgggggaggcttggtccagcctggggggtccctgagactctcctgtgcagcctctggattcagctttagtaccaattggatgaactgggtccgccaggctccagggaaggggctggagtggctggcccacataaacccagatggaacttattcacactatgtggactctgtgaggggccattcaccatctccagagacaaccccaagaactcactgttctgcaaatggacagcctgagagccgaggacacggctgtatattacngtgcgagagatatgagaaactcaatgaatagaaatcaggggatgggggccaaggggaaccctgtcaccgtctcctcagccctccaccgaacgggcccatccggtccttcccccgtggcccgtccctcggcctacccacgggacnccacctccgagacgcacacggtccggcccgtgggcctcgtcccgtcggtacaaggaaccttacgttccgagtcgcgtcctcgtcgg

SEQ ID NO: 318448 - DNA, 574 bp, Homo sapiens
  misc_feature: GZ8MTXP02GW8D7.3.81.H04.1.454.CMB.2.raw
tcagagacgcactccacgaccggtgctcgatttagtagtgtagattcgcgggctggtggagtctgggggaggcttggtccagcctggggggtccctgagactctcctgtgcagcctctggattcagctttagtaccaattggatgaactgggtccgccaggctccagggaaggggctggagtggctggcccacataaacccagatggaacttattcacactatgtggactctgtgaggggccattcaccatctccagagacaaccccaagaactcactgttctgcaaatggacagcctgagagccgaggacacggctgtatattactgtgcgagagatagtgaagaaactcaatgaatagaaatcgagggagtcgggggacaggggaaccctggtcacccggtctcctcacgccctaccaaccgaacgggcccagtccggttccttcccccgtggcccgtccctcgcctaccgacggacgcccaccgtccggagacgcaaccgacggcccggcccgtcgggcctcggcccgtggtaccaagggtcctacgttccggagtcgtcgtctcgtcggg

SEQ ID NO: 318449 - DNA, 588 bp, Homo sapiens
  misc_feature: GZ8MTXP02FX02S.3.81.H04.1.454.CMB.2.raw
tcagagacgcactccacgaccggtgctcgatttagtagtgtagattcgcgggctggtggagtctgggggaggcttggtccagcctggggggtccctgagactctcctgtgcagcctctggattcagctttagtaccaattggatgaactgggtccgccaggctccagggaaggggctggagtggctggcccacataaacccagatggaacttattcacactatgtggactctgtgaggggccattcaccatctccagagacaaccccaagaactcactgttctgcaaatggacagcctgagagccgaggacacggctgtatattactgtgcgagagatatgaagaaactcaatgaatagaaatcgaaggggatgggggaccaggggaaccctggtcaccgtctcctcacgcctccaccgaacgggcccagtccggtcccttccccccgtggccccgtcccgtcgccctaccgacggacgccacccgtccgacgacgccgaacacggccggccccgtggggccttcggccgttacggccgaaaacgggtccttaaaccgttccggacgtccgttcgtcgtacggcgggg

SEQ ID NO: 318450 - DNA, 567 bp, Homo sapiens
  misc_feature: GZ8MTXP02FZD3J.3.81.H04.1.454.CMB.2.raw
tcagagacgcactccacgaccggtgctcgatttagtagtgtagattcgcgggctggtggagtctgggggaggcttggtccagcctggggggtccctgagactctcctgtgcagcctctggattcagctttagtaccaattggatgaactgggtccgccaggctccagggaaggggctggagtggctggcccacataaacccagatggaacttattcacactatgtggactctgtgagggccattcaccatctccagagacaaccccagaactcactgttctgcaaatggacagcctgagagccgaggacacggctgtatattactgtgcgagagatatagagaaactcaatgaatagaaatcgaggggagtgggggaccaggggaaaccctggtccacccgtctcctcagccctccaccgaaacgggccccaagtccggtcccttccccccgtgggcccgtcccctcgcctaccgacgggacgccaccctccgagacgcacgacggccgcccgtcgggctcgccgtggtacgaaacggaactaccgttcggacgtcgcgtctcgtgg

SEQ ID NO: 318451 - DNA, 619 bp, Homo sapiens
  misc_feature: GZ8MTXP02G3Q6H.3.81.H04.1.454.CMB.2.raw
  modified_base (283)..(283): a, c, t, g, unknown or other
  misc_feature (283)..(283): n is a, c, g, or t
  modified_base (354)..(354): a, c, t, g, unknown or other
  misc_feature (354)..(354): n is a, c, g, or t
tcagagacgcactccacgaccggtgctcgatttagtagtgtagattcgcgggctggtggagtctgggggaggcttggtccagcctggggggtccctgagactctcctgtgcagcctctggattcagctttagtaccaattggatgaactgggtccgccaggctccgagggaaggggctgggagtggctggcccacataaacccagatggaacttattcacactatgtggactctgtgagggccattcaccatctccagacgacaacccaagactcactgttcngacaaatggacagcctgagagccgaggacacggctgtatattacgtgtgacgagagatatagaagaaactnaaatagaatagaaatcgaaggggagtcgggggaccaaacggggtaaccctggtacccaacccggtcctcctacaccgccctacccgaaccgaaacggggccccagtccgggttcccttcccccggtggccccgtccctggtcccaccgacggacgcccgtacccgccggacgacgacgaaccgacggtcccggcccgtgggccttaccggccgttacggaccgaaacggtaacctacgttacccggagttcgccgttctcggcgg

SEQ ID NO: 318452 - DNA, 634 bp, Homo sapiens
  misc_feature: GZ8MTXP02FZKGE.3.81.H04.1.454.CMB.2.raw
  modified_base (195)..(195): a, c, t, g, unknown or other
  misc_feature (195)..(195): n is a, c, g, or t
  modified_base (256)..(256): a, c, t, g, unknown or other
  misc_feature (256)..(256): n is a, c, g, or t
  modified_base (334)..(334): a, c, t, g, unknown or other
  misc_feature (334)..(334): n is a, c, g, or t
  modified_base (526)..(526): a, c, t, g, unknown or other
  misc_feature (526)..(526): n is a, c, g, or t
tcagagacgcactccacgaccggtgctcgatttagtagtgtagattcgcgggctggtggagtctgggggaggcttggtccagcctgggggggtccctgagactctcctgtgcagcctctggattcagcttttagtaccaattggatgaactgggtccgccaggctccagggaaggggctggagtggctggcccanataaacccagatggaacttattcacactatgtggactctgtggaggggccattcaccatcnccagagacaaaccccaagaactcactgtttctgacaaatggacagcctgagacgacgaggacacggctgtatattacngtgacgagagtatagtagaagaaactacaaatagaatagaaactacgtaagggtaggtcgggggacgaacgggggaaccctggggtacccacccggttcctcctacgacgtcccctacccgaacgaaccggggaccctacgtccggttccccttcccccgtcggcccgtccctcgccctacgaacgggaccncccgtaccgacggacgacgacgacgacggtcccggccgtcgggtcgtccggccgtacggaccgaaacgtaaccgttacgtaccggtacggtcgtccgtcgtacgtcgg

SEQ ID NO: 318453 - DNA, 589 bp, Homo sapiens
  misc_feature: GZ8MTXP02GUJ8J.3.81.H04.1.454.CMB.2.raw
  modified_base (280)..(280): a, c, t, g, unknown or other
  misc_feature (280)..(280): n is a, c, g, or t
tcagagacgcactccacgaccggtgctcgatttagtagtgtagattcgcgggctggtggagtctgggggaggcttggtccagcctggggggtccctgagactctcctgtgcagcctctggattcagctttagtaccaattggatgaactgggtccgccaggctccagggaaggggctggagtggctggcccacataaacccagatggaacttattcacactatgtggactctgtgagggccattcaccatctccagagacaacccaagactcactgttcngcaaatggacagcctgagagccgaggacacggctgtatattactgtgcgagagtatacgtagaagaaactcaaatagaatagaaatcgaaggggagtgggggaccaagggaacccgtggtccacccgtctcctcacgccctccgaaccgaacgggcccacgtccgttcccttcccccgtggcccgtccctgcccgtcccgaggcgaccctacccgtaccggagacgaccacgacggccgggtcccgtcgggctacggccgttacggacaaacggtaactaccgttccggagtcggccgttctcgtaggg

SEQ ID NO: 318454 - DNA, 608 bp, Homo sapiens
  misc_feature: GZ8MTXP02JO6BN.3.81.H04.1.454.CMB.2.raw
  modified_base (280)..(280): a, c, t, g, unknown or other
  misc_feature (280)..(280): n is a, c, g, or t
tcagagacgcactccacgaccggtgctcgatttagtagtgtagattcgcgggctggtggagtctgggggaggcttggtccagcctggggggtccctgagactctcctgtgcagcctctggattcagctttagtaccaattggatgaactgggtccgccaggctccagggaagggctggagtggctggcccacataaacccagatggaacttattcacactatgtggactctgtgaggggccgattcaccatctccagacgacaaccccaagaactcactntttctgacaaatggacagcctgagagccgaggacacggctgtatattactgtgcgagagatatgagaaactcaatgaatagaaatcgaggggagtcgggggacagggaaccctggtccaccgtctctcacgccctaccaaccgaacgggccctacgtccggttacccttcccccgtcgggccccgtccccgtcgcccgttacccgacggacgcccgaccccgtcgacgacgccgaacgtacggcccggtcccgtcgggggcctcggtcccgtacgggtactaacgggaaccttaccgttccggacggtccgtcgttccgtacgacggg

SEQ ID NO: 318455 - DNA, 581 bp, Homo sapiens
  misc_feature: GZ8MTXP01D41W6.19.36.D03.1.454.CMB.2.raw
  modified_base (343)..(343): a, c, t, g, unknown or other
  misc_feature (343)..(343): n is a, c, g, or t
tcagtactctcgtgcacgaccggtgctcgatttagctgcgtcacgacccaaaaaccacacccctccttgggagaatcccctagatcacagctcctcaccatggactggacctggagcatccttttcttggtggcagcagcaacaggtgcccactctcagggtcagctggtgcagtctggagctgaggttaagagccgtggggcctcagtgaaggtcgcctgcaaggcctctgattacacctttagcaactacggcatcaccgtgggtgcgacacggcccctggacaagggcttgagtggagtgggatggatcgagcgcttacagtacaataacaacaaactangacaaccgaaactccgaaagggcaaggagtaccaaaccaataaacccacagaaccacataccacgagacaacagaccctaacagtaggaaactggaaggagccgtagaagacgctagaaccgacgaccgggtaccgttgttaacttacgtggtgaacggtaaaaggttgggggaagttaagttagtttagttaagttggaatggtacctaaccgttggtctttcgtcgttgggtaacc

SEQ ID NO: 318456 - DNA, 616 bp, Homo sapiens
  misc_feature: GZ8MTXP01AKIJL.19.36.D03.1.454.CMB.2.raw
  modified_base (192)..(192): a, c, t, g, unknown or other
  misc_feature (192)..(192): n is a, c, g, or t
  modified_base (333)..(333): a, c, t, g, unknown or other
  misc_feature (333)..(333): n is a, c, g, or t
tcagtactctcgtgcacgaccggtgctcgatttagctgcgtcacgatctctcttgggagaatcccctagatcacagctcctcaccatggactggacctggagcattccttttcttggtggcagcagcaacaggtgcccactctcagggtcagctggtgcagtctggagctgaggttaagagccgtgggcctnagtgaaggtcgcctgcaggcctctgattacacctttagcaactacggcatccaccgtgggtgcgacacggcccctggacaagggcttggagtggagtggggatggatcgaggcgtcttacagtacaataaacaacaaactntcgaccaaccgaaacctccgaagggacaagaacgtaccaaccaataaacccacaacgaacaacactaccaacgacgaccaacacgaccctaacgagtaacgggaactagggaacggacgtaccgtaggggaacgtaggccgtacggaaccggaccgaccgggtaccgttagttaacttaccggtggtacggacggtaaaggtgggggaaggtattagttaggttacgttagttacgttcggtaacccttacgtcgtacctttcgttcgtcggttcctttaacg

SEQ ID NO: 318457 - DNA, 588 bp, Homo sapiens
  misc_feature: GZ8MTXP01E1NRM.19.36.D03.1.454.CMB.2.raw
  modified_base (444)..(444): a, c, t, g, unknown or other
  misc_feature (444)..(444): n is a, c, g, or t
  modified_base (572)..(572): a, c, t, g, unknown or other
  misc_feature (572)..(572): n is a, c, g, or t
tcagtactctcgtgcacgaccggtgctcgatttagctgcgtcacgatctctcttgggttttggggggaagaggaagactgacggtcctgccacaggtggtgctgggcacggtgggcactcgacacaacatttgcgctcaactgtcttgtccactctcagggtcagctggtgcagtctggagctgaggttaagagccgtggggcctcagtgaaggtcgctgcaaggcctctgattacacctttagcaactacggcatcaccgtgggtgccgacacggccccgtaggacgaagggtcttgaggtggagtgggatggatcagcgactttaacagtacaataaacaacaaactactacgacaaaccgaaactccgaaagggacaagacgtaccaaaccactaaaccacacgaaccacactacccaacggacaccaacacgaccctaanagtacggaaactgggaacggcaccggtaggaacggacgccgtaggaaccgaccggaaccggtccgtagtaactacgtgacggaagaaagggttgggggaattagtattagacgttgactgaccttctntcttctcgttgtaacc

SEQ ID NO: 318458 - DNA, 614 bp, Homo sapiens
  misc_feature: GZ8MTXP01DHRS1.19.36.D03.1.454.CMB.2.raw
tcagtactctcgtgcacgaccggtgctcgatttagctgcgtcacgatctctcttgggttttggggggaagaggaagactgacggtcctgccacaggtggtgctgggcacggtgggcactcgacacaacatttgcgctcaactgtcttgtccactctcagggtcagctggtgcagtctggagctgaggttaagaagccgtggggcctcagtgaaggtcgcctgcaaggcctctgattactacctttagacaactacggcatcaccgtgggtgcgacacggcccctaggacgaagggcttgagtggagtggatggatcgagcgtctttaacgagtacaataaacacaaactatcgacaacccgaaactccgaagggacaacgtacgtaccaaaccaactaaacccgacaacgaacaacactacccgaagacgaccaaccaacgacctaacgagtacggaactagggaacgacgaccgtaggagaacgcgtagaaccgacgtaccggtaccgttagtaagttaccgtggtagaacggtaaaggttgggggtaattagttacgttgttacgttgacgttcgtaccttaacgttcgtcgtttccttcgttcgggtaacc

SEQ ID NO: 318459 - DNA, 632 bp, Homo sapiens
  misc_feature: GZ8MTXP01AP2WC.19.36.D03.1.454.CMB.2.raw
  modified_base (194)..(194): a, c, t, g, unknown or other
  misc_feature (194)..(194): n is a, c, g, or t
  modified_base (218)..(218): a, c, t, g, unknown or other
  misc_feature (218)..(218): n is a, c, g, or t
  modified_base (256)..(256): a, c, t, g, unknown or other
  misc_feature (256)..(256): n is a, c, g, or t
  modified_base (313)..(313): a, c, t, g, unknown or other
  misc_feature (313)..(313): n is a, c, g, or t
  modified_base (336)..(336): a, c, t, g, unknown or other
  misc_feature (336)..(336): n is a, c, g, or t
  modified_base (376)..(376): a, c, t, g, unknown or other
  misc_feature (376)..(376): n is a, c, g, or t
  modified_base (383)..(383): a, c, t, g, unknown or other
  misc_feature (383)..(383): n is a, c, g, or t
  modified_base (448)..(448): a, c, t, g, unknown or other
  misc_feature (448)..(448): n is a, c, g, or t
tcagtactctcgtgcacgaccggtgctcgatttagctgcgtcacgatctctcttgggagaatcccctagatcacagctcctcaccatggactggacctggagcattcctttttcttggtggcagcagcaacaggtgcccactctcagggtcagctggtgcagtctggagctgaggttaagaagcctggggcctnagtgaaggtcgcctgcaaggcctntgattacacctttagcaactacggcactcaccgtgggncgacacggcccctggacaagggtcttggaggtggatggggatggatcgagcgcttanagttacataaacaacaaacttancgacaacgaaacgtccgagggacaaggctaccaaccaaanaacccanacgaacaacacaccgaacgacgaccaactacgacccaaagagttacggaaacgtacggagggacnccgtggggaagtaacgcgaacggaacccggcgaaccgggccgtttagtaactttaccggaggttaggaaccggtaaagggtcggggggttaagttaagttacgtttaggtaaccgttcggaatttcccggaaccttaccccggtttcgttccgtttccggttcgttaacggttaacccgtttcg

SEQ ID NO: 318460 - DNA, 558 bp, Homo sapiens
  misc_feature: GZ8MTXP02HQEUQ.19.36.D03.1.454.CMB.2.raw
  modified_base (202)..(202): a, c, t, g, unknown or other
  misc_feature (202)..(202): n is a, c, g, or t
  modified_base (223)..(223): a, c, t, g, unknown or other
  misc_feature (223)..(223): n is a, c, g, or t
  modified_base (259)..(259): a, c, t, g, unknown or other
  misc_feature (259)..(259): n is a, c, g, or t
  modified_base (307)..(307): a, c, t, g, unknown or other
  misc_feature (307)..(307): n is a, c, g, or t
tcagtactctcgtgcacgaccggtgctcgatttagctgcgtcacgacccaaaaccacacccctccttgggagaatcccctagatcacagctcctcaccatggactggacctggagcatccttttcttggtggcagcagcaacaggtgcccactctcagggtcagctggtgcagtctggagctgagttaagagcctgggcctnagtgaggtcgctgcaaggctntgattacactttagcaactacggcatcacctgggtncgacacggcccctggacaagggcttgagtggatgggatggatcagcgnttacagtcaataacactaaactatgaccaacgaaactccgagggcagacgtcaaccaataaaccacaagaccactacaccaacgacacaacacgaccctaacgaacgtacgaacgtaggaacggacgacgtagaagacgacgtagaccgacgacggtacgtacgtacttacgtgtaggacgtaaaggtaggggaagtacgttagttacgtacgtagagtcgtactaccgtcgtactttcgtcgttacgtcg

SEQ ID NO: 318461 - DNA, 599 bp, Homo sapiens
  misc_feature: GZ8MTXP02GRP41.19.36.D03.1.454.CMB.2.raw
  modified_base (266)..(266): a, c, t, g, unknown or other
  misc_feature (266)..(266): n is a, c, g, or t
tcagtactctcgtgcacgaccggtgctcgatttagctgcgtcacgacccaaaaccacacccctccttgggagaatcccctagatcacagctcctcaccatggactggacctggagcatccttttcttggtggcagcagcaacaggtgcccactctcagggtcagctggtgcagtctggagctgaggttaagaagcctggggcctcagtgaaggtcgcctgcaaggcctctgattacacctttagcaactacggcatcacctgggtncgacaggcccctggacaagggcttgagtggatgggatggatcagcgcttacagtcaataacacaaactatgacaaccgaaaactccgaaggcagacgtacaaccaataaacccaacaacgaacaaccaactacccaacggaacaccaacaacgaccctaacaacgtagggaaacctaggaaagggacgacccgtaggaagacggacctaggaacccgaacgtaccgggacccgttagtaacttaccgtagtacgaccggaaaagtgggggaaggtaaagtagttagtaaccttggaatggactaacccgttgtcctttacgtcgttcggtacc

SEQ ID NO: 318462 - DNA, 521 bp, Homo sapiens
  misc_feature: GZ8MTXP02I2A0V.19.36.D03.1.454.CMB.2.raw
  modified_base (254)..(254): a, c, t, g, unknown or other
  misc_feature (254)..(254): n is a, c, g, or t
  modified_base (323)..(323): a, c, t, g, unknown or other
  misc_feature (323)..(323): n is a, c, g, or t
  modified_base (347)..(347): a, c, t, g, unknown or other
  misc_feature (347)..(347): n is a, c, g, or t
tcagtactctcgtgcacgaccggtgctcgatttagctgcgtcacgatctctcttgggagaatcccctagatcacagctcctcaccatggactggacctggagcatccttttcttggtggcagcagcaacaggtgcccactctcagggtcagctggtgcagtctggagctgaggttaagaagccgtggggcctcagtgaaggtcgcctgcaaggcctctgattacacctttagcaactacggcatcacctgggtncgacacggcccctggacagggcttgagtggatgggatggatcagcgcttacagtcaataacacaaactncgacaccgaaactccgaggccagngtcaaccataacccacagacacatccacgagacaacagacctacataggaactgaaggacgcctaggaacgagcgtagaaccgacgaccggccgtagtaacttacgtgtagacggaaaagtgggggaagtatagttcgtactgatgtctaccgtgtcttctcgtggtacttacg

SEQ ID NO: 318463 - DNA, 502 bp, Homo sapiens
  misc_feature: GZ8MTXP02IS3W1.19.36.D03.1.454.CMB.2.raw
  modified_base (368)..(368): a, c, t, g, unknown or other
  misc_feature (368)..(368): n is a, c, g, or t
tcagtactctcgtgcacgaccggtgctcgatttagctgcgtcacgacccaaaaccacacccctccttgggagaatccctagatcacagctcctcaccatggactggacctggagcatccttttcttggtggcagcagcaacaggtgcccactctcagggtcagctggtgcagtctggagctgaggttaagaagcctggggcctcagtgaaggtcgcctgcaaggcctctgattacacctttagcaactacggcatcacctggtgcgacaggcccctggaccaagggcttgagtggatgggatggatcagcgcttacagtcataacacaaactatgcaccgaaactccagggcagatcaccataaccanagacacatccacgagcacagcctaacatggaactgaggagcctgagagctagaccgacacggcgtagtattacgtgtagacgaaaagtgggggaggtaatagttgtaactgaatgctacctgtcttctgtggtc

SEQ ID NO: 318464 - DNA, 667 bp, Homo sapiens
  misc_feature: GZ8MTXP02F1XTF.19.36.D03.1.454.CMB.2.raw
tcagtactctcgtgcacgaccggtgctcgatttagctgcgtcacgacccaaaaaccacacccctccttgggagaatcccctagatcacagctcctcaccatggactggacctggagcatccttttcttggtggcagcagcaacaggtgcccactctcagggtcagctggtgcagtctggagctgaggttaagaagccgtggggcctcagtgaaggtcgcctgcaaggcctctgattacacctttagcaactacggcatcaccgtgggtgcgacacggcccctggacaagggcttgagtggatgggatggatcagcgtcttacagtacaataaacaactaaactatcgaccaaccgaaaactccgaagggcaggacgtaccaaaccaactaaacccaacaacgaacaaccactacccaacgaacgacaaccgtaacgacccttaacaacgtacgggaaacctggaaacgggacgtacccgtagggaacgacggacgtacggaaacccgaaccggaccggtacccggttaggttaactttaaccgtgggttacggaaaccggtaaaagggttaggggggaaagttaaagttaacgtttacggttaacgttaggtaacgttcggtacttaacccgttggtaccttttacgtaccgtttcgggtttaaccc

SEQ ID NO: 318465 - DNA, 594 bp, Homo sapiens
  misc_feature: GZ8MTXP02JWC5L.19.36.D03.1.454.CMB.2.raw
  modified_base (397)..(397): a, c, t, g, unknown or other
  misc_feature (397)..(397): n is a, c, g, or t
  modified_base (408)..(408): a, c, t, g, unknown or other
  misc_feature (408)..(408): n is a, c, g, or t
tcagtactctcgtgcacgaccggtgctcgatttagctgcgtcacgacccaaaaaccacacccctccttgggagaatcccctagatcacagctcctcaccatggactggacctggagcatccttttcttggtggcagcagcaacaggtgcccactctcagggtcagctggtgcagtctggagctgaggttaagaagccgtggggcctcagtgaaggtcgcctgcaaggcctctgattacacctttagcaactacggcatcaccgtgggtgcgacacggcccctaggacaagggcttgaggtggatggggatggatcgagcgtacttacagtacaataacaactaaactatacgaccaaccgaaactccgagggcagacgtaccaaccaataacccaanacgacaaccanacccaacgacgaccaacacgacctacaagtaggaacctaggaacggagccgtaggagtacgcgtacgaaccgaccgacgggtaccgtagtacgttacgtggtagacggtaaaagggtgggggaagtaacgttagttacgtacgtaggtatcggtaccttaccgtcgtacctttcgtcgttcggtac

SEQ ID NO: 318466 - DNA, 647 bp, Homo sapiens
  misc_feature: GZ8MTXP02H2Q5G.19.36.D03.1.454.CMB.2.raw
tcagtactctcgtgcacgaccggtgctcgatttagctgcgtcacgacccaaaaaccacacccctccttgggagaatcccctagatcacagctcctcaccatggactggacctggagcatccttttcttggtggcagcagcaacaggtgcccactctcagggtcagctggtgcagtctggagctgaggttaagaagcctggggcctcagtgaaggtcgctgcaaggcctctgattacactttagcaactacggcatcaccgtgggtgcgacacggcccctggacaaggctgagtggagtgggatggatcgagcgtcttacgagtacaataacaactaaactatacgaccgaaccgaaactccgaggggaccaggacgtaccaaccaactaaaacccacgaacgaacccaacaactacccgaacgacgacccaacgaacgtaccctaacgtaacgtaacggaacctagggaaacggacgtacccgtaggaagaacgccgtaggaaccgacggaccggtacgttagttaacgttacgtaggttacggacggtaaaaggttgggggaaagttagtttaaagtttcgtaaacgtggtaaacgttcgacccgttaaccgttcggttaactttcccgttcggttacggttcccg

SEQ ID NO: 318467 - DNA, 556 bp, Homo sapiens
  misc_feature: GZ8MTXP02HGE14.19.36.D03.1.454.CMB.2.raw
  modified_base (255)..(255): a, c, t, g, unknown or other
  misc_feature (255)..(255): n is a, c, g, or t
  modified_base (373)..(373): a, c, t, g, unknown or other
  misc_feature (373)..(373): n is a, c, g, or t
tcagtactctcgtgcacgaccggtgctcgatttagctgcgtcacgatctctcttgggagaatcccctagatcacagctcctcaccatggactggacctggagcatccttttcttggtggcagcagcaacaggtgcccactctcagggtcagctggtgcagtctggagctgaggttaagaagccgtggggcctcgagtgaaggtcgcctgcaaggcctctgattacacctttagcaactcggcatcaccgtgggcncgacacggcccctaggacaagggcttagagtggatgggatggatcgagcgcttacgagtacaataaacacaaactatcgaccaacgaaactcgaggacagcgtcaaccactaaaccanacgaacaacactaccaacgacacaactacgacctacatacggaactggagacgctaggagtagctagaaccgacgacgcgttagtaacttcgtagtacgacggtaaaaggtgggggaagtacttaagtacggttaacgagtactacgaaccgttacgtcgtccttcgtcgtacgttacttacg

SEQ ID NO: 318468 - DNA, 611 bp, Homo sapiens
  misc_feature: GZ8MTXP02H9CD3.19.36.D03.1.454.CMB.2.raw
  modified_base (215)..(215): a, c, t, g, unknown or other
  misc_feature (215)..(215): n is a, c, g, or t
tcagtactctcgtgcacgaccggtgctcgatttagctgcgtcacgatctctcttgggttttggggggaagaggaagactgacggtcctgccacaggtggtgctgggcacggtgggcactcgacacaacatttgcgctcaactgtcttgtccactctcagggtcagctggtgcagtctggagctgaggttaagagccgtggggctcagtgaggtcnctgcaggcctctgattacactttagcaactacggcatcaccgtgggtcgcgacgacggcccctggacgaagggcttggaggtggagtgggatgggatcgaggtcgtacttacagtacaaataaaccaactaaactctacgaccaaccgaaactccgaagggtcagacgtacaacccgaaactaaacccacaacgacaacacacccaacgacgacctaacgacgacctaagacgtacggactggaaacggacgtaccgaggaacgacgtaccgtacgaaccggtaacgaccgggtccgttaagttacgttaacgtggtaacggacggtaaaggtgggggaaatagttacgttagtacgttagacgttcgacctacgttcgtctttcgtcgtacgttc

SEQ ID NO: 318469 - DNA, 585 bp, Homo sapiens
  misc_feature: GZ8MTXP02F7W7G.19.36.D03.1.454.CMB.2.raw
  modified_base (321)..(321): a, c, t, g, unknown or other
  misc_feature (321)..(321): n is a, c, g, or t
tcagtactctcgtgcacgaccggtgctcgatttagctgcgtcacgacccaaaaaccacacccctccttgggagaatcccctagatcacagctcctcaccatggactggacctggagcatccttttcttggtggcagcagcaacaggtgcccactctcagggtcagctggtgcagtctggagctgaggttaagagcctggggcctcagtgaaggtcgcctgcaaggcctctgattacacctttagcaactacggcatcacgtgggtgcgacacggcccctggacaagggcttggagtggagtggatggatcgagcgcttacngtacaataacacaaactactcgaccaaccgaaactccgaggacaggactacaaccaactaaacccgaacaacgacaacctacacccgaacgaagaccaacgacgaccctaacgaactacgggaaacctggaaacggacgccgtaggaagacgaccgtaacgaccgacgacggtccgttagtactacgtgcgaacggaaaagtgggggaaatattagtcgtaacgtgagttcgaccttacgtcgtcgtttcgtacgtcggttacc

SEQ ID NO: 318470 - DNA, 617 bp, Homo sapiens
  misc_feature: GZ8MTXP02IS6TC.19.36.D03.1.454.CMB.2.raw
  modified_base (310)..(310): a, c, t, g, unknown or other
  misc_feature (310)..(310): n is a, c, g, or t
tcagtactctcgtgcacgaccggtgctcgatttagctgcgtcacgatctctcttgggagaatcccctagatcacagctcctcaccatggactggacctggagcatccttttcttggtggcagcagcaacaggtgcccactctcagggtcagctggtgcagtctggagctgaggttaagagcctggggcctcagtgaaggtcgcctgcaaggcctctgattacacctttagcaactacggcatcaccgtggtgcgacacggcccctggacgaagggctgagtggatggggatggatcgagcgtctttacgngtacaataaaccacaaaacctataccgacaaccgaaactcgagggcagcgtacaccataacccacaagacacactaccaccgagaccaacacgacctaccagtacgggaaactaggaacggagacccgtagaacgtagacccgtaggaccggaaccgaccgggtaccggttaggttaaacgttacggttacggtaggaacggtaaaagggttagggggtaagttaacgtttaaagtttcgttaacgtaggtaacgttcgtaaccgttaccgttcggtaccgtttctcggttacggtacctttaaccg

SEQ ID NO: 318471 - DNA, 593 bp, Homo sapiens
  misc_feature: GZ8MTXP02HIKZ5.19.36.D03.1.454.CMB.2.raw
  modified_base (331)..(331): a, c, t, g, unknown or other
  misc_feature (331)..(331): n is a, c, g, or t
tcagtactctcgtgcacgaccggtgctcgatttagctgcgtcacgatctctcttgggagaatcccctagatcacagctcctcaccatggactggacctggagcatccttttcttggtggcagcagcaacaggtgcccactctcagggtcagctggtgcagtctggagctgaggttaagaagccgtgggcctcagtgaaggtcgcctgcaaggcctctgattacacctttagcaactacggcatcaccgtgggtgcgacacggcccctggacaagggctgaggtggatggggatggatcgagcgacttacagtacaataaacaacaaaactnccgacaaccgaaactccgagggacaagacgtaccaaccaactaaacccacaacgaacaccaactacccgaacgacacaacacgaccctacagtacggaaacgtaggacggacgccgtaggacgagacgtacggaacgaccgaccgggtaccgttagttaacttacgtaggtacgacggtaaaaggtcgggggaatacgttaagttaggtactaggtacgtcgaaccgttaccgtcgtctttactcgttcggtacctttaacg

SEQ ID NO: 318472 - DNA, 548 bp, Homo sapiens
  misc_feature: GZ8MTXP02GS8B5.19.36.D03.1.454.CMB.2.raw
  modified_base (251)..(251): a, c, t, g, unknown or other
  misc_feature (251)..(251): n is a, c, g, or t
  modified_base (261)..(261): a, c, t, g, unknown or other
  misc_feature (261)..(261): n is a, c, g, or t
  modified_base (291)..(291): a, c, t, g, unknown or other
  misc_feature (291)..(291): n is a, c, g, or t
  modified_base (309)..(309): a, c, t, g, unknown or other
  misc_feature (309)..(309): n is a, c, g, or t
  modified_base (315)..(315): a, c, t, g, unknown or other
  misc_feature (315)..(315): n is a, c, g, or t
  modified_base (331)..(331): a, c, t, g, unknown or other
  misc_feature (331)..(331): n is a, c, g, or t
  modified_base (361)..(361): a, c, t, g, unknown or other
  misc_feature (361)..(361): n is a, c, g, or t
  modified_base (474)..(474): a, c, t, g, unknown or other
  misc_feature (474)..(474): n is a, c, g, or t
tcagtactctcgtgcacgaccggtgctcgatttagctgcgtcacgatctctcttgggagaatcccctagatcacagctcctcaccatggactggacctggagcattccttttcttggtggcagcagcaacaggtgcccactctcagggtcagctggtgcagtctggagctgaggttaagagccgtgggcctcagtgaaggtcgcctgcaaggctctgattacacctttagcaactacggcatcaccgtggncgacagcccngacaggctgagtgatgggatggatcgagcncttacagtacataaacanaaactncgacaaaccgtaaacncgaggacagacgacaaccgaataacccganaacaaccactaacacccgacgaacaccaactacgaacccacaagtacgaaacaggacggaatccgaagaagagtaccgaggaccgaacgtaccggaccggttgtaacttacgngttagacgtaaaaggtggggaaggtattagtagactggattgaaccttacgtgtcttactcgtcgtacttaacg

SEQ ID NO: 318473 - DNA, 570 bp, Homo sapiens
  misc_feature: GZ8MTXP02IV6F3.19.36.D03.1.454.CMB.2.raw
  modified_base (193)..(193): a, c, t, g, unknown or other
  misc_feature (193)..(193): n is a, c, g, or t
  modified_base (326)..(326): a, c, t, g, unknown or other
  misc_feature (326)..(326): n is a, c, g, or t
  modified_base (363)..(363): a, c, t, g, unknown or other
  misc_feature (363)..(363): n is a, c, g, or t
tcagtactctcgtgcacgaccggtgctcgatttagctgcgtcacgatctctcttgggagaatcccctagatcacagctcctcaccatggactggacctggagcatccttttcttggtggcagcagcaacaggtgcccactctcagggtcagctggtgcagtctggagctgaggttaagaagccgtggggcctnagtgaaggtcgctgcaaggcctctgattacacctttagcaactacggcatcactgggtgcgacaggcccctggacaagggcttgagtggatgggatggatcagcgtcttacgagtacaataacactaaaactntcgacaaccgaactccgaggacagcgtaccaacctanaaccacaagacacactaccacgacgacacacgacctacatacggaactggacgacgacctaggacgagctagggaaccgaaccgaccggtaccggtagttaacgttaccgtaggtggaaccggtaaaaggtgggggtaaagtagttaagttgttaaccgtagtagtcgtaacttacccgtgtcctttcctacgttcggtcctttacg

SEQ ID NO: 318474 - DNA, 625 bp, Homo sapiens
  misc_feature: GZ8MTXP02JY0GW.19.36.D03.1.454.CMB.2.raw
  modified_base (208)..(208): a, c, t, g, unknown or other
  misc_feature (208)..(208): n is a, c, g, or t
  modified_base (232)..(232): a, c, t, g, unknown or other
  misc_feature (232)..(232): n is a, c, g, or t
  modified_base (270)..(270): a, c, t, g, unknown or other
  misc_feature (270)..(270): n is a, c, g, or t
  modified_base (329)..(329): a, c, t, g, unknown or other
  misc_feature (329)..(329): n is a, c, g, or t
tcagtactctcgtgcacgaccggtgctcgatttagctgcgtcacgacccaaaaaccacacccctccttgggagaatcccctagatcacagctcctcaccatggactggacctggagcatccttttcttggtggcagcagcaacaggtgcccactctcagggtcagctggtgcagtctggagctggaggttaagaagccgtggggcctnagtgaaggtcgcctgcaaggcctntgacttacacctttagcaactacggcatcaccgtgggnccgacacggccccgtaggacagggcttggaggtggagtgggatggatcgagcgacttangtacaataaaccacaaaactgtacgaccaaccgtaaactcgaagggcaggacgtacaaccaataaacccgacaagaacctacaacctacccaacgaacgacccaacaaccggaccctaaacgaacgtacggaaaccgtaggaacgggtaccgaccgtagggaacgtacggtacgacggaaccgaccgtaccgggtacgttacgttagttacgtggacggacggtaaaggtgggggaacgtaagttagttacgacgttagaacgtcgtacgtacgtcgtccttcgtacgtcggtacc

SEQ ID NO: 318475 - DNA, 684 bp, Homo sapiens
  misc_feature: GZ8MTXP02FRX6B.19.36.D03.1.454.CMB.2.raw
  modified_base (191)..(191): a, c, t, g, unknown or other
  misc_feature (191)..(191): n is a, c, g, or t
  modified_base (216)..(216): a, c, t, g, unknown or other
  misc_feature (216)..(216): n is a, c, g, or t
  modified_base (299)..(299): a, c, t, g, unknown or other
  misc_feature (299)..(299): n is a, c, g, or t
  modified_base (387)..(387): a, c, t, g, unknown or other
  misc_feature (387)..(387): n is a, c, g, or t
  modified_base (400)..(400): a, c, t, g, unknown or other
  misc_feature (400)..(400): n is a, c, g, or t
tcagtactctcgtgcacgaccggtgctcgatttagctgcgtcacgatctctcttgggagaatcccctagatcacagctcctcaccatggactggacctggagcatccttttcttggtggcagcagcaacaggtgcccactctcagggtcagctggtgcagtctggagctgaggttaagagcctggggcctnaggtgaaggtcgcctgcaaggcctntgattacacctttagacaactacggcatcaccgtgggcgcgacacggcccctaggacgacggcttgagtggagtgggatggancgagcgtacttacgagtacaaactaaccaactaaactagcgaccctaaccgaaactccgagggaccaagcgtacaacaactaacccanaacgacacgaacnccgaacgacgcaacacgtaccaacacgacgggtaaacaggggacgacgaccgtgaaacgacgcgtaacggacggaacccgtacgggggtacccttaaggttaaacttaccgggtaagttacccgggggaaaacggttaaaacggggttagggggtaaacggttaagttttaaaaccgggttccgtttaaacggttaggtaaccgtttaccgtaaccccggtttaacgtttaccgttacccgtttttcgtttaaacccgggcggtttaaccctttttaaacccgg

SEQ ID NO: 318476 - DNA, 547 bp, Homo sapiens
  misc_feature: GZ8MTXP02FS041.19.36.D03.1.454.CMB.2.raw
  modified_base (250)..(250): a, c, t, g, unknown or other
  misc_feature (250)..(250): n is a, c, g, or t
  modified_base (255)..(255): a, c, t, g, unknown or other
  misc_feature (255)..(255): n is a, c, g, or t
  modified_base (300)..(300): a, c, t, g, unknown or other
  misc_feature (300)..(300): n is a, c, g, or t
  modified_base (350)..(350): a, c, t, g, unknown or other
  misc_feature (350)..(350): n is a, c, g, or t
  modified_base (365)..(365): a, c, t, g, unknown or other
  misc_feature (365)..(365): n is a, c, g, or t
  modified_base (383)..(383): a, c, t, g, unknown or other
  misc_feature (383)..(383): n is a, c, g, or t
  modified_base (396)..(396): a, c, t, g, unknown or other
  misc_feature (396)..(396): n is a, c, g, or t
  modified_base (520)..(520): a, c, t, g, unknown or other
  misc_feature (520)..(520): n is a, c, g, or t
tcagtactctcgtgcacgaccggtgctcgatttagctgcgtcacgatctctcttgggagaatcccctagatcacagctcctcaccatggactggacctggagcatccttttcttggtggcagcagcaacaggtgcccactctcagggtcagctggtgcagtctggagctgaggttaagaagcctgggcctcagtgaaggtcgcctgcaaggcctctgattacacctttagcaactacggcatcactgggncgacncggcccctggacaagggcttgaggtggatggggatggatcagcgnttacagtacataacacaaactataccgacaccgaaactccagggacagancaaccaataaccganacgacacatcccaacganacacacgacccanatacgaaactaggaggtaagcctaggacgacgcgtacgaacgacgacggcgtagttactcgtgtacgacggtaaagtgggggataacgtattacgtactaggaacttcggaactttacccggtnttaccgttcgtcgtacgttaccttacg

SEQ ID NO: 318477 - DNA, 581 bp, Homo sapiens
  misc_feature: GZ8MTXP02G87YU.19.36.D03.1.454.CMB.2.raw
  modified_base (266)..(266): a, c, t, g, unknown or other
  misc_feature (266)..(266): n is a, c, g, or t
  modified_base (522)..(522): a, c, t, g, unknown or other
  misc_feature (522)..(522): n is a, c, g, or t
tcagtactctcgtgcacgaccggtgctcgatttagctgcgtcacgatctctcttgggttttggggggaagaggaagactgacggtcctgccacaggtggtgctgggcacggtgggcactcgacacaacatttgcgctcaactgtcttgtccactctcagggtcagctggtgcagtctggagctgaggttaagagccgtggggcctcagtgaaggtcgcctgcaaggcctctgattacactttagcaactacggcatcacctgggtncgacacggcccctggacagggcttgagtggatgggatggatcagcgctacagtcaataacacaaactactgaccaaccgaaactccgaagggcagacgtacaaccaactaaccacacgaaccacactaccaacgacgacaaccgacgaccctaagaacgtacggtaaactggaaacgggacgacccgtaggaacgacgtccgtaggaaccgaaccgacggtaccgtagtacttaccgtgtacggacggtaaaaggngggggaacgtaatagttcgtactgaatcgaccgttacgcgtacttcgtacgtcggtacc

SEQ ID NO: 318478 - DNA, 665 bp, Homo sapiens
  misc_feature: GZ8MTXP02JQHSI.19.36.D03.1.454.CMB.2.raw
  modified_base (206)..(206): a, c, t, g, unknown or other
  misc_feature (206)..(206): n is a, c, g, or t
tcagtactctcgtgcacgaccggtgctcgatttagctgcgtcacgatctctcttgggttttggggggaagaggaagactgacggtcctgccacaggtggtgctgggcacggtgggcactcgacacaacatttgcgctcaactgtcttgtccactctcagggtcagctggtgcagtctggagctgaggttaagaagcctggggcctnagtgaaggtcgctgcaaggcctctgattacacctttagcaactacggcatcaccgtgggtcgcgacacggcccctggacaagggcttggagtggagtgggatggatcgaggcgtacgttacagtacaaataaaccaactaaaactactcgaaccgtaaacccgaaaacctccgaacggggacagggaccgtaaccaaaccctaaactaaacccgaacaacgtaaccaaccactaccccgaacgacgacccaacgacgaccctacgtaagtacggaacctagggaacggacgtacccgtaggaaggacgtccgaaggaaccgaaccggtacccgggtaccggttagttaaacgttaccgtaggtacgggaacgggtaaaagggtgggggaaagtaagttacggttagtaacgttacgaagttcgtaccttaccgtcgtccgtttccgtcggtacggtacc

SEQ ID NO: 318479 - DNA, 628 bp, Homo sapiens
  misc_feature: GZ8MTXP02GI5M7.19.36.D03.1.454.CMB.2.raw
  modified_base (357)..(357): a, c, t, g, unknown or other
  misc_feature (357)..(357): n is a, c, g, or t
  modified_base (463)..(463): a, c, t, g, unknown or other
  misc_feature (463)..(463): n is a, c, g, or t
tcagtactctcgtgcacgaccggtgctcgatttagctgcgtcacgatctctcttgggttttggggggaagaggaagactgacggtcctgccacaggtggtgctgggcacggtgggcactcgacacaacatttgcgctcaactgtcttgtccactctcagggtcagctggtgcagtctggagctgaggttaagagccgtggggcctcgagtgaaggtcgcctgcgaaggcctctgattacacctttagcaactacggcatcaccgtgggtcgcgacgacggcccctggaacgagggtcttagaggtaggagtgggatggatcgagcgacttacgagtcaataaaccaacgtaaaactntacgaccaaccgaaactccggaagggcaggactaccaaaccgaactaaacccaacgaacgaaccctaaacaactacccgaaacgacaaccaacgtacacccctaanagtacgaacgaggaaacggacgacccgtaggaagcggtacgaacgaacccgaccgacggtaccggtattaacgttacgtaggtacggaaacggtaaagggtgggggaaactagttacgttaggtactgtaagtcgtactacgtcgtcctttcgtacgtcgtttac

SEQ ID NO: 318480 - DNA, 671 bp, Homo sapiens
  misc_feature: GZ8MTXP02GATC8.19.36.D03.1.454.CMB.2.raw
tcagtactctcgtgcacgaccggtgctcgatttagctgcgtcacgatctctcttgggttttggggggaagaggaagactgacggtcctgccacaggtggtgctgggcacggtgggcactcgacacaacatttgcgctcaactgtcttgtccactctcagggtcagctggtgcagtctggagctgaggttaagagcgtgggcctcagtgaggtcgcctgcaggctctgattacaccttagcaactacggcatcaccgtgggtcgacgacgacggcccctaggaaccgtaagggtctggaggtggagtgggattgatcgagcgtactacgagtacaataacaacaaactactacgacctaaccgaaacctaccgaacggcgtagactaaccgaaaccaaactaaaccaacgaacgaccaaacactacccgaacggacaccgaacgacgtaccctaacgtagtaacggaacgtagggaacggtaaccgtcggtaaggacgaacgtaccggacgaaacccggtacggtaaccgggtccggttaacgttactttaaccggtgggttaaacggaaccgggtaaaaggggttgggggaaacttaaagttaggttacggtaacgtagtacgtaacgtcccgtttaacgtcggttcctttacttcccggtagtttacccg

SEQ ID NO: 318481 - DNA, 638 bp, Homo sapiens
  misc_feature: GZ8MTXP01EC1FC.44.4.A04.1.454.CMB.2.raw
  modified_base (308)..(308): a, c, t, g, unknown or other
  misc_feature (308)..(308): n is a, c, g, or t
tcagacagtatatacacgaccggtgctcgatttagagtagtgatcagggggagctacaacaggcaggcaggggcagcaagatggtgttgcggacccaggtcttcatttctctgttgctctggatctctggtgcctacggggacatcgtgatgacccagtctccagacttcctggccctgtctctgggcgagagggccaccatcaactgcacgtccagccagagtcttttcacagctccagcaataggaactacttacttggaaccaacagaaaccagggcacgccctaccagactactctatttacgnggacactaccgtaacccgggtaacgtccccgggggtccctacgaccgtattcgacggtcggcgaggcggtcgtaggggaactggtatttccaacttcctaccaaccatcacgctacgccgtgaccgaggtctaggaaagtagtggtcggtctttagtttaacttaccgtgttaacaaaaccgaagtacgtacctactttcccttacccttccctttaacgtttcgttttcgggaccggtaacgggaaccgttaagtccgttaggaacgtaacgttaaccgaaaacgttaccgtggtacggcgttcgaccttacctaacttcgtttaaccg

SEQ ID NO: 318482 - DNA, 599 bp, Homo sapiens
  misc_feature: GZ8MTXP01EC4EB.44.4.A04.1.454.CMB.2.raw
  modified_base (310)..(310): a, c, t, g, unknown or other
  misc_feature (310)..(310): n is a, c, g, or t
  modified_base (430)..(430): a, c, t, g, unknown or other
  misc_feature (430)..(430): n is a, c, g, or t
  modified_base (487)..(487): a, c, t, g, unknown or other
  misc_feature (487)..(487): n is a, c, g, or t
tcagacagtatatacacgaccggtgctcgatttagagtagtgatcagggggagctacaacaggcaggcaggggcagcaagatggtgttgcggacccaggtcttcatttctctgttgctctggatctctggtgcctacggggacatcgtgatgacccagtctccagacttcctggccctgtctctgggcgagagggccaccatcaactgcacgtccagccagagttcttttcacagctccagacaataggaactacttacttggaccaacagaaaccagggcacgccctaccagactactactatttacgnggacacttaccgtaacccgggtaacgtcccgggggtccctacgaccgtattcgagtcggacagggtcgggtcgtaacgggactaagtactttaccactcctaccacatcacgcacgtccngacacggctagaagtagtggtggtactttagtttacttactcgtaacaaacgagganctacttccttacccttccttatttcgtttacggcggtaacggggaaccaggtcgttaggaagtacttaacgaaacgttacgtggtacgcttagccacctaagttcgttaacg

SEQ ID NO: 318483 - DNA, 557 bp, Homo sapiens
  misc_feature: GZ8MTXP01D7865.44.4.A04.1.454.CMB.2.raw
  modified_base (299)..(299): a, c, t, g, unknown or other
  misc_feature (299)..(299): n is a, c, g, or t
  modified_base (403)..(403): a, c, t, g, unknown or other
  misc_feature (403)..(403): n is a, c, g, or t
tcagacagtatatacacgaccggtgctcgatttagagtagtgatcagggggagctacaacaggcaggcaggggcagcaagatggtgttgcggacccaggtcttcatttctctgttgctctggatctctggtgcctacggggacatcgtgatgacccagtctccagacttcctggccctgtctctgggcgagaggccaccatcaactgcacgtccagccagagtctttcacagctcagcaataggaactacttacttgaccaacagaaaccaggcacgcctaccagactactctattacnggacactcgtacccgggaagtccggggtcctgaccgtattcgagtggcaggtcggtcgtacgggactgtactttccactctacaacctagtacacgcacgccgngacgagacgtagaatgtgtcgtattagttacttacgtacgtaactaaagacgactctacttccttacctccttagtttcgtcggaccggaacggtacaggtcgttagactaacttaacgaaacgttacgtgcgtctcaccttactcgttcgtcg

SEQ ID NO: 318484 - DNA, 538 bp, Homo sapiens
  misc_feature: GZ8MTXP01DA045.44.4.A04.1.454.CMB.2.raw
  modified_base (277)..(277): a, c, t, g, unknown or other
  misc_feature (277)..(277): n is a, c, g, or t
  modified_base (411)..(411): a, c, t, g, unknown or other
  misc_feature (411)..(411): n is a, c, g, or t
  modified_base (448)..(448): a, c, t, g, unknown or other
  misc_feature (448)..(448): n is a, c, g, or t
  modified_base (502)..(502): a, c, t, g, unknown or other
  misc_feature (502)..(502): n is a, c, g, or t
  modified_base (533)..(533): a, c, t, g, unknown or other
  misc_feature (533)..(533): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccagacttcctggccctgtctctgggcgagagggccaccatcaactgcacgtccagccagagtctttctacagctccagacaataggaactacttactggtaaccaacagaaaccngggcagcctcccagactactcattactggcatccgtacccgggatcccggggtcctgaccgattccaggtggcgaggccgggtctgggaacagtactttcactcctcaccatcagcacgctgcaggctagaagntagtggtcttagtttattactggtacaaacgtaaganctattaccttcctcccttattcgtttggaaccgtaggggacctaagcgtagganaagttcaaacgtaatggtggctgctaaccgnttccg

SEQ ID NO: 318485 - DNA, 546 bp, Homo sapiens
  misc_feature: GZ8MTXP01DKNM1.44.4.A04.1.454.CMB.2.raw
  modified_base (306)..(306): a, c, t, g, unknown or other
  misc_feature (306)..(306): n is a, c, g, or t
  modified_base (413)..(413): a, c, t, g, unknown or other
  misc_feature (413)..(413): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccagacttcctggccctgtctctgggcgagagggccaccatcaactgcacgtccagccagagttcttttctacagctccagcaataggaactacttacttggaaccaacagaaaccagggcagcctcccagactactcatttacngggcatccgtaacccgggaagtccgggtcctgaccgattccaggtgcaggcgggtactggggcagtactttcgactcctcaccatcagcagcctgcaggctgaaagntgtggtcttgtttattactgtcagcagtataagtgactggtccctccgtcggaaccgaacgggcaacgacgtagggaattaacgttaaaacgacgttggtacgggtctacggacttaccctaagttcttaacg

SEQ ID NO: 318486 - DNA, 649 bp, Homo sapiens
  misc_feature: GZ8MTXP01BTV4L.44.4.A04.1.454.CMB.2.raw
  modified_base (282)..(282): a, c, t, g, unknown or other
  misc_feature (282)..(282): n is a, c, g, or t
  modified_base (305)..(305): a, c, t, g, unknown or other
  misc_feature (305)..(305): n is a, c, g, or t
  modified_base (315)..(315): a, c, t, g, unknown or other
  misc_feature (315)..(315): n is a, c, g, or t
tcagacagtatatacacgaccggtgctcgatttagagtagtgatcgagggggagctacaacaggcaggcaggggcagcaagatggtgttgcagacccaggtcttcatttctctgttgctctggatctctggtgcctacggggacatcgtgatgacccagtctccagacttcctggccctgtctcgtgggcgaggagggccaccatcaactgcacgtcagccagagtcttttcacagctccagacaatacggaactacttactaggtaaccaacagaaaccgngggcacggccctccagactactntactttacgngggctacgtcccgtaacccgggtaattcccgggggtacccctaggacccgtatttccccgaaggttcgggaccgaacgggtccggggttaaccgttagggggaacctagggtaaacttttcccgaactcgtaccaccatcagcagcctgcgaggctagaacgtatcgtaggactttagtttaattacgtggtacaaactaagcgctattacctccttaccctagttttccgtttgggaaccctaagggggacctaaacggttcgttaaaggggacttaacgttacgaaaaccggtaagtcggttcgggcctaggacctaaccgttgtttaaccg

SEQ ID NO: 318487 - DNA, 602 bp, Homo sapiens
  misc_feature: GZ8MTXP01CZD7M.44.4.A04.1.454.CMB.2.raw
  modified_base (234)..(234): a, c, t, g, unknown or other
  misc_feature (234)..(234): n is a, c, g, or t
  modified_base (303)..(303): a, c, t, g, unknown or other
  misc_feature (303)..(303): n is a, c, g, or t
  modified_base (402)..(402): a, c, t, g, unknown or other
  misc_feature (402)..(402): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccagacttcctggccctgtctcgtgggcgagacggccaccatcaactgcacgtccagccagagtcttttcacngctccagcaataggaactacttactgtacaacaagaaaccaggcagcctacccagactactcatttacnggacatccgtacccgggaacgtccggggtcctgacccgtattcccgaggtcggcgacggcgggtcgtggggaactagtactttcactctccaacatcancacgcctgcagggctagaagatgtgggtctttagtttaacttacgttacgtacaaacgaagtgacctaattccttcccttccccttagttttcccgttttacgggcccgtaaacggggaccctaaaggcgttaagggaacgttaacttaccgaaaacgtaaccgtaggtaacggcctaggaccctaaccgaagtttcccg

SEQ ID NO: 318488 - DNA, 551 bp, Homo sapiens
  misc_feature: GZ8MTXP01B7XT4.44.4.A04.1.454.CMB.2.raw
  modified_base (263)..(263): a, c, t, g, unknown or other
  misc_feature (263)..(263): n is a, c, g, or t
  modified_base (296)..(296): a, c, t, g, unknown or other
  misc_feature (296)..(296): n is a, c, g, or t
  modified_base (383)..(383): a, c, t, g, unknown or other
  misc_feature (383)..(383): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccagacttcctggccctgtctctgggcgagaggccaccatcaactgcacgtccagccagagtctttcacagctccagcaataggaactacttactgaccaanagaaacaggcagcctccagactactcatttacnggctatccgtaacccgggaatcccgggggtccctggaccgattcccgaggtgcgaggcgggtcgtgggcagtactttcactctcacntcagcagctgcaggctagaagatgtgtcttagtttattactgtacaaacgaagacgctattccttcccttccttatttccgtttcgggaacccgtaaggggacccaaggttcgtagggaagttaacgttcgaaaacgtaacgtggtcggctgacctaacgttaactcg

SEQ ID NO: 318489 - DNA, 516 bp, Homo sapiens
  misc_feature: GZ8MTXP01DSALJ.44.4.A04.1.454.CMB.2.raw
  modified_base (297)..(297): a, c, t, g, unknown or other
  misc_feature (297)..(297): n is a, c, g, or t
  modified_base (331)..(331): a, c, t, g, unknown or other
  misc_feature (331)..(331): n is a, c, g, or t
  modified_base (392)..(392): a, c, t, g, unknown or other
  misc_feature (392)..(392): n is a, c, g, or t
  modified_base (423)..(423): a, c, t, g, unknown or other
  misc_feature (423)..(423): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccagacttcctggccctgtctctggcgagaggccaccatcaactgcacgtccagccagagtcttttcacagctccagcaataggaactacttactgacaacagaaaccaggcagcctcccagactactcatttacnggcatccgtacccggaatccggggtccctgaccnttccaggtgcagcggtctgggcagtatttcactctcaccatcagcagcctgcagctgaagntgtggcttgtttagttactgtacaaacagancattccttcctcccttattctttcggccgtaggggaccagcgtaggagttacttacaaaacgtaactagtcggctcgactaaccttaagttcc

SEQ ID NO: 318490 - DNA, 520 bp, Homo sapiens
  misc_feature: GZ8MTXP01CBUIE.44.4.A04.1.454.CMB.2.raw
  modified_base (304)..(304): a, c, t, g, unknown or other
  misc_feature (304)..(304): n is a, c, g, or t
  modified_base (436)..(436): a, c, t, g, unknown or other
  misc_feature (436)..(436): n is a, c, g, or t
  modified_base (485)..(485): a, c, t, g, unknown or other
  misc_feature (485)..(485): n is a, c, g, or t
  modified_base (516)..(516): a, c, t, g, unknown or other
  misc_feature (516)..(516): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccagacttcctggccctgtctctgggcgagaggccaccatcaactgcacgtccagccagagtcttttcacagctccagcaataggaactacttacttggtaaccaacagaaaccagggcagccctccagactactcatttacnggcatccgtacccgggatcccgggtcctgaccgattccgaggtggcaggcggtctgggcagtactttcactctcacatcagcagcctgcaggctagaagagtgtggtcttgtttattacgtgtacaacaagngcattccttcctcccttattccgtttggccgtagggacacgcgtagganagttcaaacgtaactgtcggctgactaaccnttcg

SEQ ID NO: 318491 - DNA, 738 bp, Homo sapiens
  misc_feature: GZ8MTXP01EZ270.44.4.A04.1.454.CMB.2.raw
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccagactccctggctgtgcctctgggcgagagggccaccatcaactgcaagtccagccagagttgtttttacagctaccaaacaataagaactacttagctggtaccagcagaagccgaggacacgcctaccgtaagttcgctttcttttaacgtcgggtcctttacccggtaacccgggtaacggttccccggggtaccctcggaccgtacttcccgaggtcggacgaggggtccgggtacgttcggggaactaggtactttaccaccttcctaccacctaatacccaaacgacgtcctagacgacgggtcctaaggaagtagttcggtacggtacctttaactttttacgttttcggtcggtttaccttggtaaaccttaaatttaacttaactttacccgttacccccttaggttaaccgtttacgggtttttcgggaacccgggtaaacgggggtaaacccttaaaggggggttagggaaacgtaaacgtaacccggttaaaaagggttaaccgttggggtcgggtaccttaacgggaccctaaccttaacggttcctttcggttttaacccc

SEQ ID NO: 318492 - DNA, 597 bp, Homo sapiens
  misc_feature: GZ8MTXP01BWZFM.44.4.A04.1.454.CMB.2.raw
  modified_base (273)..(273): a, c, t, g, unknown or other
  misc_feature (273)..(273): n is a, c, g, or t
  modified_base (299)..(299): a, c, t, g, unknown or other
  misc_feature (299)..(299): n is a, c, g, or t
  modified_base (349)..(349): a, c, t, g, unknown or other
  misc_feature (349)..(349): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccagacttcctggccctgtctctgggcgagaggccaccatcaactgcacgtccagccagagtcttttcacagctccagcaataggaactacttactggaccaacagaaaccnggcagcctccagactactcatttacnggcatccgtacccggatccgggtcctgaccgattccaggtgcagcggtcngggcagatttccactctacaccatcagcagcctgcgaggctaggaagtatagtggctttagtttaacttacttgttacaaacgtaagacgactaattccctttaccctccctttaagtttccgttttcgggaaccccgtaaacggggggttaacccaaacggttcccgtaggggaaacgttaacgtttaaccgaaaaacgtaacccgttgggtcgggtacttacggaccctaaccgttaacgtttccg

SEQ ID NO: 318493 - DNA, 582 bp, Homo sapiens
  misc_feature: GZ8MTXP01BD97K.44.4.A04.1.454.CMB.2.raw
  modified_base (303)..(303): a, c, t, g, unknown or other
  misc_feature (303)..(303): n is a, c, g, or t
  modified_base (403)..(403): a, c, t, g, unknown or other
  misc_feature (403)..(403): n is a, c, g, or t
  modified_base (438)..(438): a, c, t, g, unknown or other
  misc_feature (438)..(438): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccagacttcctggccctgtctctgggcgagagggccaccatcaactgcacgtccagccagtagtctttctacagctccagcaataggaactacttactgacaacagaaaccagggcagccctaccagactactctattacgnggcagtccgtacccgggaagtcccgggggtccctggaccgatttccgaggtggacacgggcgggtacgtaggggcctaggattttccactctaccacccntccagccagcctagcaggctagaagattgtcggtntttagtttattacgtgtactaaacgaagacgactattcccttcccttcccttatttcgtttcgaaccgtacggggaccaaggttcgtaggaacttacgttaacgaaaccgtaactggttaacggctcggaccaacccgttgtcg

SEQ ID NO: 318494 - DNA, 595 bp, Homo sapiens
  misc_feature: GZ8MTXP01DF7TX.44.4.A04.1.454.CMB.2.raw
  modified_base (312)..(312): a, c, t, g, unknown or other
  misc_feature (312)..(312): n is a, c, g, or t
  modified_base (426)..(426): a, c, t, g, unknown or other
  misc_feature (426)..(426): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccagacttcctggccctgtctcgtgggcgagacgggccaccatcaactgcacgtccagccagtagttcttttctacagctccagacaataggaactacttacttggtaaccaacagaaaccaggcacgcctcccagactactcatttacgnggcagtcccgtaaccgggaacgtcccgggtaccctgaccgtattccgaggtggcgacggcggtacgtgggcagtacttcgactctcacatcagcagcctgcgagctagagatgngtcttagtttattacgtgtacaacgagcgtactattcccttccttcctttagttcgttttcgggaaccgtacggggaaacctaacggttcgttaagggacgttaacgttaccgaaaaaccggttaaccttagggtccgggtactcggacctaaccgttaacgtttcccg

SEQ ID NO: 318495 - DNA, 630 bp, Homo sapiens
  misc_feature: GZ8MTXP01BTL4O.44.4.A04.1.454.CMB.2.raw
  modified_base (312)..(312): a, c, t, g, unknown or other
  misc_feature (312)..(312): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccagacttcctggccctgtctcgtgggcgagaggccaccatcaactgcacgtccagccagagttctttcacagctccagcaaatagaactacttactaggaccaacagaaaccgagggcacgccctacccaagtacctactctatttacgnggactacgtccgtaacccgggaacgtcccgggggtccctagaccgtattccgaggtggcaggcgggtacgtaggggaacctagtacgtttccaccttccgtacacctatacgacgtcacgcctcgacgaggtctagaagtagtggtcgtactttaggtttacttacgttacggtaacaacgaaagcgactacttaccctttccctacctttacgtttccgtttcggaacccggtaacgggttaaccgtaaacgttcggtaagggtacttaacgttaaccaaacggtaactgggtaacgcgtacgctaaccttcgttcg

SEQ ID NO: 318496 - DNA, 508 bp, Homo sapiens
  misc_feature: GZ8MTXP01AB919.44.4.A04.1.454.CMB.2.raw
  modified_base (273)..(273): a, c, t, g, unknown or other
  misc_feature (273)..(273): n is a, c, g, or t
  modified_base (301)..(301): a, c, t, g, unknown or other
  misc_feature (301)..(301): n is a, c, g, or t
  modified_base (400)..(400): a, c, t, g, unknown or other
  misc_feature (400)..(400): n is a, c, g, or t
  modified_base (427)..(427): a, c, t, g, unknown or other
  misc_feature (427)..(427): n is a, c, g, or t
  modified_base (505)..(505): a, c, t, g, unknown or other
  misc_feature (505)..(505): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccagacttcctggccctgtctctgggcgagaggccaccatcaactgcacgtccagccagagtctttcacagctccagcaataggaactacttactggaaccaacagaaaccngggcagccctccagactactcatttacngggcatcgtacccgggatccgggggtcctgaccgattccagtggcagcgggtctgggcagactttcactctacaccatcagcagcctgcaggctgaagntgtgcttgtttattactgtcaacaagngcatccttcctccttattccgtttggccgaggggttaccaggctgggaagattcgaaacgaactggtcgctgctccgngtc

SEQ ID NO: 318497 - DNA, 711 bp, Homo sapiens
  misc_feature: GZ8MTXP01BJ9VM.44.4.A04.1.454.CMB.2.raw
  modified_base (314)..(314): a, c, t, g, unknown or other
  misc_feature (314)..(314): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccagacttcctggccctgtctcgtgggcgagaggccaccatcaactgcacgtccagccagtagtcttttctacagctccagcaataggaactacttactcggaaccaacaagaaaccagggccacgccctacccaagactactctatttacgngggactacgtccgtaacccgggggactccccgggggtccctggacccggtatttcccgacggttcggcgacgggccggggttcgtacggggaactaggtacttttccaaccttcctaccaaacctactaccaaggccaacggcccttggaccgaaacggggtcctagggaaacgtagttcgggttagggttacttttaggttttaacgtttacgttacggttaacccaaaaccgaaaggtaacgtaccttacctttaccctttaccccttaccccttttagtttcccgtttttcgggaacccgtaacgggggttaccccaaaggttccgttaagggaagttaacgttacgaaaaccgtaacgtacggtcggactcggacctaaccgttaacgttccg

SEQ ID NO: 318498 - DNA, 680 bp, Homo sapiens
  misc_feature: GZ8MTXP01B998G.44.4.A04.1.454.CMB.2.raw
  modified_base (269)..(269): a, c, t, g, unknown or other
  misc_feature (269)..(269): n is a, c, g, or t
  modified_base (299)..(299): a, c, t, g, unknown or other
  misc_feature (299)..(299): n is a, c, g, or t
  modified_base (450)..(450): a, c, t, g, unknown or other
  misc_feature (450)..(450): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccagacttctggccctgtctctgggcgagaggccaccatcaactgcacgtcagccagtagttctttcacagctccagcaatagaactacttactgacaacagaaaccnggcacgccctaccagactactcatttacgnggctacgtccgtaacccgggtacgtccgggtacctaggaccgtattacccgaggtcggacgtagggtcggggtactacggggaactagggtacttttaccaacttcctaccaacctactaccgaagccacgcctgacgaggctaggaaagngttggtcggttactttaggttttaacttacgtacggtaacaaacgtaaagggtacgtaccttaagttccccttttaccccttccccttttaagttttcccgttttaccggggaaccccgggtaaacgggggttaccctaaacggttccggttaaaggggaacttaacgttaacccgaaaaacggttaacgtcggtaacgggtcctggttacccctaacccgttcgttccg

SEQ ID NO: 318499 - DNA, 678 bp, Homo sapiens
  misc_feature: GZ8MTXP01BPN5A.44.4.A04.1.454.CMB.2.raw
  modified_base (336)..(336): a, c, t, g, unknown or other
  misc_feature (336)..(336): n is a, c, g, or t
  modified_base (485)..(485): a, c, t, g, unknown or other
  misc_feature (485)..(485): n is a, c, g, or t
  modified_base (673)..(673): a, c, t, g, unknown or other
  misc_feature (673)..(673): n is a, c, g, or t
tcagacagtatatacacgaccggtgctcgatttagagtagtgatcaggggggagctacaacaggcaggcaggggcagcaagatggtgttgcagacccaggtcttcatttctctgttgctctggatctctggtgccgtacggggacatcgtgatgacccagtctccagacttcctcggccctgtctcgtgggcgaggacggccaccatacaactgcacgtccagccagtagttcttttacacacgcctaccagacaaagtaggtaacttactttacgttggaaaccaaacaagaaaccagggaccacgccctacccaagtacctactctatttacgnggactacgtaccgtacccgggaacgtcccggggtccctacgaccgtagtcccgaggtcggcgacggtcgggtacgtaggggaactagtactttaccacctcgtaccaccgtatccagaccacgaccgtgacgtacgggactaggaagtntcggtcggttactttaggttttactacgtacgtaaccaaacgtaaagcgtaccttactttcccctttaccttaccccgttttaagtttccggtttccggggaacccggttaacggggttaccctaaaggttccggtaagggaacttacttaacggaaacgtaacgtcgcggtactcgcctaaccgttnttccg

SEQ ID NO: 318500 - DNA, 731 bp, Homo sapiens
  misc_feature: GZ8MTXP01BSWAN.44.4.A04.1.454.CMB.2.raw
  modified_base (349)..(349): a, c, t, g, unknown or other
  misc_feature (349)..(349): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgccgtacggggacatcgtgatcgacccagtctccagacttccgtggccctgtctcgtgggcgagacggccaccatacaactgcacgtccagccagtagttcttttactacacgcctaccaagacaaagtaacggaaaccttacttacgttacggtaaacccaaacgaaacgaaaaccgagggaccaacgccctacccagtacctactcaactttacgnggactactaccgtaacccgggatccggacgtcccagaccgtactcaggtcgcgaggcgggtctgggactagtacttaccactctacaacccatcgaacgcacgtcccgtgaccgagggacttagggaatagttcggtagggttactttaggggtttaaactttaccgtaggtaaccctaaaacgtaaggacgttaccctaaactttcccctttaaaccccgttcccttttaaacgtttttccggttttaacccggggaacccgggaaacgggggtaaaccccttaaaggggtacccgtttaagggaaacgttaaaccgtttaaaccggaaaaccggtaccgttgggggttacgtaccacggtaacccttaaaccccggtttg

SEQ ID NO: 318501 - DNA, 616 bp, Homo sapiens
  misc_feature: GZ8MTXP01EK21R.44.4.A04.1.454.CMB.2.raw
  modified_base (310)..(310): a, c, t, g, unknown or other
  misc_feature (310)..(310): n is a, c, g, or t
  modified_base (450)..(450): a, c, t, g, unknown or other
  misc_feature (450)..(450): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccagacttcctggccctgtctcgtgggcgaggacggccaccatcaactgcacgtccagccagagttctttctacagctccagacaataggaactacttacttcggaaccaacagaaaccagggcacgcctaccagactactcatttacnggactacgtccgtaacccgggaacgtcccggggtcctaggaccgtattcccgaggtcggcgacgggtccgggtacgtggggaacagtactttccgacctcctacacctatacacgcacgccgtagcgagggtctagaagngttgtgtactttaggttttaacttacgtgttaaccaaacgaaagacgtcttaacttccctttccctaccctttatttcgtttcgggaaccgtacggggaccaaggttcgtagggtaacacgttacgaaacggtaactgggtcggctcgactaaccttaagtttccg

SEQ ID NO: 318502 - DNA, 661 bp, Homo sapiens
  misc_feature: GZ8MTXP01C3HUU.44.4.A04.1.454.CMB.2.raw
  modified_base (312)..(312): a, c, t, g, unknown or other
  misc_feature (312)..(312): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccagacttcctggccctgtctcgtgggcgagacgggccaccatcaactgcacgtccagccagtagttcttttcacagctccagacaatagaacttacttacttcggaaccaacagaaaccagggcacgcctaccagactactctatttacnggcatccgtacccgggaacgtcccgggtacctcgaccgtatccgagtcggcgacggcgggtacgtgggaactagtactttccacgtctacaccatcacgcacgcctaggcgaggtctagaagagttggtcggtactttaggttttaacgttacgtggttaaccaaaacgtaaggtacgtacttaactttcccgtttacccctttaccctttacgtttttccggttttaccgggaacccggtaacggggggttaaacccaaagggttccgttaaagggacgttaaacgttaccgaaaaccgtaacgttcgggtaacgggtaccttacggaccctaaaccgttcgtttccg

SEQ ID NO: 318503 - DNA, 518 bp, Homo sapiens
  misc_feature: GZ8MTXP01ATN8W.44.4.A04.1.454.CMB.2.raw
  modified_base (401)..(401): a, c, t, g, unknown or other
  misc_feature (401)..(401): n is a, c, g, or t
  modified_base (429)..(429): a, c, t, g, unknown or other
  misc_feature (429)..(429): n is a, c, g, or t
  modified_base (511)..(511): a, c, t, g, unknown or other
  misc_feature (511)..(511): n is a, c, g, or t
tcagacagtatatacacgaccggtgctcgatttagagtagtgatcaggggagctacaacaggcaggcaggggcagcaagatggtgttgcagacccaggtcttcatttctctgttgctctggatctctggtgcctacggggacatcgtgatgacccagtctccagacttcctggccctgtctctgggcgagaggccaccatcaactgcacgtccagccagagtcttttcacagctccagcaaataggaactacttacttggtaccaacagaaaccagggcagcctcccagactactcatttactgggcatctacccgggaatccgggggtcctgaccgattccaggtggcagcggtctggggcagatttcactctcaccatcagcagcctgcaggctgaagntgtggcttgtttatactgtacaacaagngcatcttaccctcctatttcgtttggcctaggggttaccaaagcgtagggattacttacaaacggtaactggtggctgaccncaagttc

SEQ ID NO: 318504 - DNA, 702 bp, Homo sapiens
  misc_feature: GZ8MTXP01CHUQW.44.4.A04.1.454.CMB.2.raw
  modified_base (330)..(330): a, c, t, g, unknown or other
  misc_feature (330)..(330): n is a, c, g, or t
tcagacagtatatacacgaccggtgctcgatttagagtagtgatcaggggggagctacaacaggcaggcaggggcagcaagatggtgttgcagacccaggtcttcatttctctgttgctctggatctctggtgcctacggggacatcgtgatcgacccagtctccagacttcctggccctgtctcgtggcgagacggccaccatacaactgcacgtccagccagtagttctttacacagctaccagacaatacggtaacttacttactacggaaccaaacgaacgaaaccgagggcaacgccctaccaagtactactactaagtttacgngggacctacgtacccgtaaccccggggtaacgttcccgggggtaccctaggtacccgtagttcccgaaggtcggacgacgggtcgggtacgtagggaactagtactttaccgacttacaccaaacatacgacggtacaaccgccgtacgacggaggttaccgaggtaaacgtgttaggtacggttagtttacggtttaatttaaccgtaggttaaacctaaacgaaaggtctacttaactttcccctttaccttacctttaacgttccgttttagggaacccggtaaacgggaccctaaagttcggtaaaggtaacgttaacttaacgttaaacgtaaccgtaggtcggtacctgacctaacttaacgttcc

SEQ ID NO: 318505 - DNA, 691 bp, Homo sapiens
  misc_feature: GZ8MTXP01ANW58.44.4.A04.1.454.CMB.2.raw
  modified_base (277)..(277): a, c, t, g, unknown or other
  misc_feature (277)..(277): n is a, c, g, or t
  modified_base (320)..(320): a, c, t, g, unknown or other
  misc_feature (320)..(320): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccagacttcctggccctgtctcgtgggcgagacgggccaccatcaactgcacgtccagccagtacgttcttttcacagcctaccagacaataggaacttactttactggaaccaanacgaaaccgagggcacgccctaccagtactactctatttacgnggcacgtccgtaacccgggacgttcccggggtcctggaccgtacttccgagggttggacgacgggtccgggtacgtaggggaacctaggtactttaccaccttctaccaaccactaccgacggccaacgtcccgtaggacgacgggtactaggaaaggtcgttgggtcggttacgttttagtttaacgtacgttacggttaacccaaagtaacggtacgtcttaaccgtttccctttccccttacccgttttagttttcccgttttacggggaaccccggttaacgggggttaacctaaacggttccgtaaaggggaacttaacttaaccggaaaacgtaagtcggtgacctcgttacctaacttgttccg

SEQ ID NO: 318506 - DNA, 528 bp, Homo sapiens
  misc_feature: GZ8MTXP01EHZC9.44.4.A04.1.454.CMB.2.raw
  modified_base (302)..(302): a, c, t, g, unknown or other
  misc_feature (302)..(302): n is a, c, g, or t
  modified_base (329)..(329): a, c, t, g, unknown or other
  misc_feature (329)..(329): n is a, c, g, or t
  modified_base (351)..(351): a, c, t, g, unknown or other
  misc_feature (351)..(351): n is a, c, g, or t
  modified_base (371)..(371): a, c, t, g, unknown or other
  misc_feature (371)..(371): n is a, c, g, or t
  modified_base (428)..(428): a, c, t, g, unknown or other
  misc_feature (428)..(428): n is a, c, g, or t
  modified_base (508)..(508): a, c, t, g, unknown or other
  misc_feature (508)..(508): n is a, c, g, or t
  modified_base (528)..(528): a, c, t, g, unknown or other
  misc_feature (528)..(528): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccagacttccctggcccctgtctcgtgggcgagacggccaccatcaactgcacgtccagccagtagttcttttcacagctccagcaatagaactacttactgaacaacagaaccagggcagcctccagactactcatttcnggcatccgtacccgggatccgggtccngccgatccagtgcagcggtacngggcagtacttcactctacncatcagcacgctgacgagctagaagagtgtaggtctagtttactctagtacaatagnctactcctttaccctcctaagttccgtttggaaccgtaacgggaccaaggttctagggaacacttacaaaacgttaacgngtcgctcacctaacttcgtn

SEQ ID NO: 318507 - DNA, 678 bp, Homo sapiens
  misc_feature: GZ8MTXP01DBK54.44.4.A04.1.454.CMB.2.raw
  modified_base (357)..(357): a, c, t, g, unknown or other
  misc_feature (357)..(357): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgccgtacggggacatcgtgatcgaccagtctccagtacttcctggccctgtctcgtgggcgaggacggccacatacaactgacacgtcagccagtagttctttacacacgcctccaagacaaagtaacggtaaaccttactttaacgttacggaaaccaaacgaacgaaaacccgagggaccaaccggcccctacccgaagtaacctaactactaagttttaccgnggggacctaacgttacccggtaaacccgggggtaacgttccccgggggtaccctaggaaccgtattacccgagggtcggcgacgggtcgggtactagggaactagtactttcactcacacatacagcacgcctagccgtaaggctagaagtgtcggtagttactttaagtttaactacgtacgtaacaaacgagtctaccttacttcccttaccttacctttagtttccggtacgggaaccggtaacgggacctaagttcggtaaaggaacttaacgttaaacggaaacgtcgtggtcgactacgacctaacgttcgttcg

SEQ ID NO: 318508 - DNA, 560 bp, Homo sapiens
  misc_feature: GZ8MTXP01ENU2D.44.4.A04.1.454.CMB.2.raw
  modified_base (296)..(296): a, c, t, g, unknown or other
  misc_feature (296)..(296): n is a, c, g, or t
  modified_base (302)..(302): a, c, t, g, unknown or other
  misc_feature (302)..(302): n is a, c, g, or t
  modified_base (395)..(395): a, c, t, g, unknown or other
  misc_feature (395)..(395): n is a, c, g, or t
  modified_base (430)..(430): a, c, t, g, unknown or other
  misc_feature (430)..(430): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccagacttcctggccctgtctctgggcgagagggccaccatcaactgcacgtccagccagagtcttttcacagctccagcaataggaactacttacttggtaaccaacagaaaccagggcagcctccagactacncattcnggcatcctaccgggatccgggtcctgaccgattccagtgacaggcggtactgggcagtacttcactctcacatcagcagctgcagctagaagntcgtggctgtttacgtacttggtacaacgaagacnctaacttccttcctccctttactttcgttttcggaacccgttaagggggaccctaagacgttgggtaacaacgttacgaaaacggtaaccgtggttaacgggcttacggaccaaccgttaacgtttcccg

SEQ ID NO: 318509 - DNA, 561 bp, Homo sapiens
  misc_feature: GZ8MTXP01A3R19.44.4.A04.1.454.CMB.2.raw
  modified_base (269)..(269): a, c, t, g, unknown or other
  misc_feature (269)..(269): n is a, c, g, or t
  modified_base (277)..(277): a, c, t, g, unknown or other
  misc_feature (277)..(277): n is a, c, g, or t
  modified_base (307)..(307): a, c, t, g, unknown or other
  misc_feature (307)..(307): n is a, c, g, or t
  modified_base (338)..(338): a, c, t, g, unknown or other
  misc_feature (338)..(338): n is a, c, g, or t
  modified_base (394)..(394): a, c, t, g, unknown or other
  misc_feature (394)..(394): n is a, c, g, or t
  modified_base (396)..(397): a, c, t, g, unknown or other
  misc_feature (396)..(397): n is a, c, g, or t
  modified_base (403)..(403): a, c, t, g, unknown or other
  misc_feature (403)..(403): n is a, c, g, or t
  modified_base (414)..(414): a, c, t, g, unknown or other
  misc_feature (414)..(414): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccagacttcctggccctgtctcgtgggcgagagggccaccatcaactgcacgtccagccagagttcttttcacagctccagcaataggaactacttacttggaccaanagaaaccngggcacgcctaccagactactcatttacgnggctatccgtacccgggaatcccggggtccngaccgtattcccgagtcggacaggcggtactgggctagactttcactctcactacncnncacgcngcgagcagagngtgtgtacttagttacgtactagtacaacgagcgtctacttcccgttcccttaccgttacgtttcgttccggaacggtaaccgggaacacggcgtaacgaacgacgttaacgaaacgtcgtggtcgctacgacctaaccgttcgtcg

SEQ ID NO: 318510 - DNA, 686 bp, Homo sapiens
  misc_feature: GZ8MTXP01AV4N1.44.4.A04.1.454.CMB.2.raw
  modified_base (272)..(272): a, c, t, g, unknown or other
  misc_feature (272)..(272): n is a, c, g, or t
  modified_base (282)..(282): a, c, t, g, unknown or other
  misc_feature (282)..(282): n is a, c, g, or t
  modified_base (420)..(420): a, c, t, g, unknown or other
  misc_feature (420)..(420): n is a, c, g, or t
  modified_base (632)..(632): a, c, t, g, unknown or other
  misc_feature (632)..(632): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgccgtacggggacatcgtgatgacccagtctccagacttcctggccctgtctcgtgggcgagacggccaccatcaactgcacgtccagccagtattcttttcacagctccagcaaataggaacttacttactggaaccaanaacgaaaccnggcaacgcctaccagactactctatttacgtggctagtcccgtaaccgggtacgtcccggggtacctaggaccgtacttcccgaggtcggacgacggtccgggttaacgtaggggaacctaggtctttaccacttccnccaaacctatacccgaggaccacggtccctaggacccgaagggtcttaaggaaacggtgttcggtgggttaccttttaggttttaacgtaacgttcggtaaaccaaacggttaaaggcgtacttaacctttcctttccccttaaccttttattttaccgggtttcgggaaccccggtaagggggttaaaccctaggttaccgtagggttaanaaccgttaaacgaaaacgtaacgtgggtaacgctaggacctaacgttaacttcg

SEQ ID NO: 318511 - DNA, 658 bp, Homo sapiens
  misc_feature: GZ8MTXP01A4IPJ.44.4.A04.1.454.CMB.2.raw
  modified_base (292)..(292): a, c, t, g, unknown or other
  misc_feature (292)..(292): n is a, c, g, or t
  modified_base (330)..(330): a, c, t, g, unknown or other
  misc_feature (330)..(330): n is a, c, g, or t
  modified_base (651)..(651): a, c, t, g, unknown or other
  misc_feature (651)..(651): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccagacttcctggcccctgtctcgtgggcgaggacgggccaccatcaactgcaccgtccagccagagttctttcacagctaccagacaagtacggtaactacttacgtacggtaaccaaacgagaaaccgngggacacgcctacccaagtacctacgtactatttacgngggtaccacgtcccgtaacccggggaacgtccccgggggtaccctaggtacccgtatttccccgaggtcgaaccggtacgggtccggggtaccgttaggggaacctaggtacctttccaccttctaccaccaatccgagccacgccctagcagggtctaggaagtagtcgtggtactttacgtttaattacgtagttaacaaacgaaagtccgactacttccctttaccctcccttagtttccgttcgggaaccgtacggggaccaaggttccgtaagggacttacgacgaaaacggtcgtaggtcgctacgacctaaccngtttccc

SEQ ID NO: 318512 - DNA, 706 bp, Homo sapiens
  misc_feature: GZ8MTXP01CQ3S7.44.4.A04.1.454.CMB.2.raw
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccagactccctggctgtgcctcgtgggcgaggacgggccaccatacaactgacaagtccagccagtagttgtttttacagtcctaccaaactaaataacgtaactacttagtcgtacggtacagacagaacgcgagacacgtcctactagtcgtcttactttacgtcggtccttacccggtaacccggtacggtcccggtacctacgtacgtcgtccgtaggtcggcgacggtcggtacggtacggaacgtagtacttctactcctacacactacaacgtacgccgtagaccgaggtacgtagaagtacgttcggtcgtactttacttttacgtttcgttacggttcgttaacgtaacttaaactttacttaacccgttacccctttacccggttacgttaacggtttacgggttttaccggacccggggtaaacggggtaaccggttaaggggttacggaaagttaaacggtaacggttaaaacggttcgttcgggttaacggacttaaccggacctaacgttcgtaaccgtttcgtttaaccc

SEQ ID NO: 318513 - DNA, 675 bp, Homo sapiens
  misc_feature: GZ8MTXP01DR86R.44.4.A04.1.454.CMB.2.raw
  modified_base (240)..(240): a, c, t, g, unknown or other
  misc_feature (240)..(240): n is a, c, g, or t
  modified_base (298)..(298): a, c, t, g, unknown or other
  misc_feature (298)..(298): n is a, c, g, or t
  modified_base (337)..(337): a, c, t, g, unknown or other
  misc_feature (337)..(337): n is a, c, g, or t
  modified_base (455)..(455): a, c, t, g, unknown or other
  misc_feature (455)..(455): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccagacttcctggccctgtctcgtgggcgaggacggccaccatcaactgacacgtccagaccagtagttcttttacacngcctaccaagacaaagtaacggtaacttaacttacttaggaaccaacacgaaaaccgngggacacgccctaccaagtactactactaacttttacgngggactacgtcccgtaacccggggaacgttcccggggtcccctagaccgtacttccgaggtcggcgacggtccggggtactaggggaactaaggtactttaccactcctacaacctanaccacgacgacgccgtagacgtaggtctaaggaagtagttggtacgttactttagtttaacgttacgtacgtaaaccgaaacgtaacgtactaccttactttaccctttacccttaccgtttacgtttccggttacgggaaccggtaacgggaccgtaacggttcgtaaggtacttaacgttaacgaaacgtgtggtcgctacgacctaacgttcgttcg

SEQ ID NO: 318514 - DNA, 540 bp, Homo sapiens
  misc_feature: GZ8MTXP01ESN6B.44.4.A04.1.454.CMB.2.raw
  modified_base (302)..(302): a, c, t, g, unknown or other
  misc_feature (302)..(302): n is a, c, g, or t
  modified_base (408)..(408): a, c, t, g, unknown or other
  misc_feature (408)..(408): n is a, c, g, or t
  modified_base (439)..(439): a, c, t, g, unknown or other
  misc_feature (439)..(439): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccagacttcctggccctgtctcgtgggcgagaggccaccatcaactgcacgtccagccagagtctttctacagctccagcaaatagaactacttacttgaccaacagaaaccagggcacgcctccagactactcatttacnggctatccgtaacccggaatccggggtcctgaccgtattccgagtgcagcgggtctgggaacagtactttcactctacacctatcagcagcctgcaggctagaagntgtggtcttgtttatactgtacaaacaagcnctactccttcctcccttatttccgtttggcccgtaaggggacctaaaggttccgtaggaacgaacttcgaaaacgtaactggtgctcgacctcgttaatcg

SEQ ID NO: 318515 - DNA, 645 bp, Homo sapiens
  misc_feature: GZ8MTXP01C3J4I.44.4.A04.1.454.CMB.2.raw
tcagacagtatatacacgaccggtgctcgatttagagtagtgatcagggggagctacaacaggcaggcaggggcagcaagatggtgttgcagacccaggtcttcatttctctgttgctctggatctctggtgccgtacggggacatcgtgatgacccagtctccagacttcctggccctgtctcgtgggcgagacggccaccatcaactgcacgtccacgccagtacgttcttttacacagcctccagacaagtacggtaacttacttacgttacggaaccaaacgaacgaaaacccgagggaccaccggcccctacccgaacgtacctaacctactaacttttacgtgggacctacgttacccggtaacccgggaacgttccccgggggtaccctacggtaccgtacttcccgaggtcggcgacgggtccgggtacgtaggggaactagtactttccactccacaccatacacgcacgcctagacgagtcgtagaacgtagtgtggtctttagtttacttactgtaacaacgagactctacttcccttccttccttagttcgttcggaacgtacgggacctagcgtaacgggattaacgttacgaaacgtcgtaggtcgtcgtcgacctaacgttctttaaccg

SEQ ID NO: 318516 - DNA, 644 bp, Homo sapiens
  misc_feature: GZ8MTXP01D45S0.44.4.A04.1.454.CMB.2.raw
  modified_base (237)..(237): a, c, t, g, unknown or other
  misc_feature (237)..(237): n is a, c, g, or t
  modified_base (278)..(278): a, c, t, g, unknown or other
  misc_feature (278)..(278): n is a, c, g, or t
  modified_base (309)..(309): a, c, t, g, unknown or other
  misc_feature (309)..(309): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccagacttcctggccctgtctcgtgggcgagacggccacatcaactgcacgtccagccagtacgttcttttacacngctccagcaataggaactacttactgaaccaacacgaaacnggcacgcctcccagactactctactttacgngggctagtcccgtaaccgggacgtcccgggggtcctgaccgtacttccgagtcggcgaggcgggtctgggaactagtactttaccactcctacactactcgagtcgacggcctgacgtacgtctaggaagtagtgggtcggttactttggtttaacttaacgttcggttaaacaaacgtaacggactcttaacttcccctttccgtacccttttagtttccggtttcggaaccgggtaacgggttaccaaggttccgtaaggggtaacttacgttaaccgaaaaaccggtaacgttaggtccgggttcacggttaccctaaccgttcgtttcccg

SEQ ID NO: 318517 - DNA, 735 bp, Homo sapiens
  misc_feature: GZ8MTXP01C4J2F.44.4.A04.1.454.CMB.2.raw
  modified_base (241)..(241): a, c, t, g, unknown or other
  misc_feature (241)..(241): n is a, c, g, or t
  modified_base (289)..(289): a, c, t, g, unknown or other
  misc_feature (289)..(289): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgccgtacggggacatcgtgatgacccagtctccagacttcctggccctgtctcgtgggcgaggacgggccaccatcaactgacaccgtccagccagtagttcttttcacngcctccagacaataggaacttacttacttcggaaccaacagaaaccgngggacacgcctccaagtacctactctatttacgtcggactacgtacccggtaacccgggacgttcccgggggtaccctggaccgtacttccgaggttacggcgtacggtcggggttaccgtaggggaactagtacgtttaccacctctaccaactactccaacgtcacggtcctcggaccgagggtacctaaggtaacgtagttcggtggttaccttttaggttttaacttaacgttcggttaaaccaaacgtaagtaaccgtctttaaccgtttccccgtttccctttaaccctttagttttacccggttttacggggaacccggttaacgggggaaacccctaaggttccggttaaacgggaattaaaccggttaaccgttaaaaaccggtcgttacgggtaacggtacccgtacgttacccgtaacccttaaggttttccccg

SEQ ID NO: 318518 - DNA, 617 bp, Homo sapiens
  misc_feature: GZ8MTXP01ASSES.44.4.A04.1.454.CMB.2.raw
  modified_base (277)..(277): a, c, t, g, unknown or other
  misc_feature (277)..(277): n is a, c, g, or t
  modified_base (306)..(306): a, c, t, g, unknown or other
  misc_feature (306)..(306): n is a, c, g, or t
  modified_base (614)..(614): a, c, t, g, unknown or other
  misc_feature (614)..(614): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccagacttcctggccctgtctcgtgggcgagaggccaccatcaactgcacgtccagccagagtcttttcacagctccagacaataggaactacttactaggaaccaacagaaaccnggcacgcctccagactactctatttacgnggctagtcccgtaacccgggaagtcccggggtcctagaccgtattcgacggtggcaggcgggtctgggcagtacttcactctcacatcagcagccctgcgaggctagaaagtcttggtcggtactttaggtttaacttacgtaggttaaccaaacggtaaagtacgtccctaattcccctttacccgttacccctttaagttttcccgtttcgggaacccgttaaacgggggaccctaaaggttccgtaaggggtaacttacgttaaccgaaaacggtaacgtggtcggtactcggactaacccgttntcg

SEQ ID NO: 318519 - DNA, 485 bp, Homo sapiens
  misc_feature: GZ8MTXP01EZEZG.44.4.A04.1.454.CMB.2.raw
  modified_base (231)..(231): a, c, t, g, unknown or other
  misc_feature (231)..(231): n is a, c, g, or t
  modified_base (275)..(275): a, c, t, g, unknown or other
  misc_feature (275)..(275): n is a, c, g, or t
  modified_base (294)..(294): a, c, t, g, unknown or other
  misc_feature (294)..(294): n is a, c, g, or t
  modified_base (379)..(379): a, c, t, g, unknown or other
  misc_feature (379)..(379): n is a, c, g, or t
  modified_base (381)..(382): a, c, t, g, unknown or other
  misc_feature (381)..(382): n is a, c, g, or t
  modified_base (384)..(384): a, c, t, g, unknown or other
  misc_feature (384)..(384): n is a, c, g, or t
  modified_base (387)..(387): a, c, t, g, unknown or other
  misc_feature (387)..(387): n is a, c, g, or t
  modified_base (393)..(393): a, c, t, g, unknown or other
  misc_feature (393)..(393): n is a, c, g, or t
  modified_base (417)..(417): a, c, t, g, unknown or other
  misc_feature (417)..(417): n is a, c, g, or t
  modified_base (424)..(424): a, c, t, g, unknown or other
  misc_feature (424)..(424): n is a, c, g, or t
  modified_base (426)..(426): a, c, t, g, unknown or other
  misc_feature (426)..(426): n is a, c, g, or t
  modified_base (455)..(455): a, c, t, g, unknown or other
  misc_feature (455)..(455): n is a, c, g, or t
  modified_base (477)..(477): a, c, t, g, unknown or other
  misc_feature (477)..(477): n is a, c, g, or t
  modified_base (479)..(479): a, c, t, g, unknown or other
  misc_feature (479)..(479): n is a, c, g, or t
  modified_base (483)..(483): a, c, t, g, unknown or other
  misc_feature (483)..(483): n is a, c, g, or t
  modified_base (485)..(485): a, c, t, g, unknown or other
  misc_feature (485)..(485): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccagacttcctggccctgtctctgggcgagagggccaccatcaactgcacgtcagccagagtcttttcanagctccagcaaataggaactacttattggaccaacagaaaaccngggcagcctccagactacncatttacgtggcatccgtacccgggaatccggggtcctgaccgattcccagtgcagcggtctgggcagtattcgactctcactancnncngcngcgagnagagagtgtgtgtgttagttactntacacananctactctctctcttcttgtcgcgacgagngtagagagacacgaagtgtgcncnctcntn

SEQ ID NO: 318520 - DNA, 582 bp, Homo sapiens
  misc_feature: GZ8MTXP01EBT3D.44.4.A04.1.454.CMB.2.raw
  modified_base (281)..(281): a, c, t, g, unknown or other
  misc_feature (281)..(281): n is a, c, g, or t
  modified_base (346)..(346): a, c, t, g, unknown or other
  misc_feature (346)..(346): n is a, c, g, or t
  modified_base (366)..(366): a, c, t, g, unknown or other
  misc_feature (366)..(366): n is a, c, g, or t
  modified_base (374)..(374): a, c, t, g, unknown or other
  misc_feature (374)..(374): n is a, c, g, or t
  modified_base (529)..(529): a, c, t, g, unknown or other
  misc_feature (529)..(529): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccagacttcctggccctgtctctgggcgagagggccaccatcaactgcacgtccagccagagttctttcacagcctccagcaataggaacttacttacgttggtaaccaacagaaaaccngggcaagcctcccagactactcatttactgggcatcctaacccgggatccggggtcctgaccgtnttccgagtgcaggcggtacngggcagtnttcactctcactatcagtcacgcctgcgacggctagaagtagtgtagtcttgtttattacgttgtacgaaacaaagacgctaacttcctttcccttcccttagtttccttttcgggaacccgtaagggggaaccctaaaggttccgtagggtaanaacgttacaaaacggtaaccgtggtcgggtctacggacctaaccttaagttcc

SEQ ID NO: 318521 - DNA, 708 bp, Homo sapiens
  misc_feature: GZ8MTXP01CM7PG.44.4.A04.1.454.CMB.2.raw
  modified_base (418)..(418): a, c, t, g, unknown or other
  misc_feature (418)..(418): n is a, c, g, or t
  modified_base (459)..(459): a, c, t, g, unknown or other
  misc_feature (459)..(459): n is a, c, g, or t
  modified_base (702)..(702): a, c, t, g, unknown or other
  misc_feature (702)..(702): n is a, c, g, or t
tcagacagtatatacacgaccggtgctcgatttagagtagtgatcaggggggagctacaacaggcaggcaggggcagcaagatggtgttgcagacccaggtcttcatttctctgttgctctggatctctggtgccgtacggggacatcgtgatgacccagtctccagacttcctggccctgtctcgtgggcgaggacgggccaccatcaactgcacgtccagccagtacgttcctttctacagtcctaccagactaaagtacggtaaccttactttacgtacggaaccaacaagaaaccgagggacacgtccctacccagacctactactatttaacgcggacacgtcccggtaacccgggaacgttcccgggggtccctaggaccgtattaccgaggtcggcgagggccggggttcngggaacagttactttaccaccgtccacctaaccataccganccgtaacgtccgacgacgtacggtacttaaggaaacgtagttcgggtacggttacgtttaggttttaacttacgtacggttaaacaaacggtaaacgtacgtacccttactttaccccgtttcccttacccggtttatttaccgggtttccggaaacccggtacgggggttaaccctaaaggccgtaaacgggtacaacgttaccgaaaagtaaccgtgttaacggcctacgacctaacgttntttccg

SEQ ID NO: 318522 - DNA, 597 bp, Homo sapiens
  misc_feature: GZ8MTXP01CJ1D3.44.4.A04.1.454.CMB.2.raw
  modified_base (291)..(291): a, c, t, g, unknown or other
  misc_feature (291)..(291): n is a, c, g, or t
  modified_base (307)..(307): a, c, t, g, unknown or other
  misc_feature (307)..(307): n is a, c, g, or t
  modified_base (344)..(344): a, c, t, g, unknown or other
  misc_feature (344)..(344): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccagacttcctggccctgtctctggcgagagggccaccatcaactgcacgtccagccaagagttcttttctacagctccagctaatagaactacttactaggaccaacagaaaccaggcacgcctccaanacctactctatttacnggcactcgtacccggagtccgggcctgacgattcccngtagcagcggtactgggcagtatttacacttcacaacctagtcagcacgcctgcaggctagaagtagtcgttggtacttggttttaacttacgttagtaccaaataaagacgacttaattcccttcccttacccgttatttccgtttgggtaaccccgtaagggggttaaccccaaggttacccgtaggggtaattacgttccaaaaacgggttaactaggtaacggtctacggactaaaccccgttgttccg

SEQ ID NO: 318523 - DNA, 517 bp, Homo sapiens
  misc_feature: GZ8MTXP02JXM09.44.4.A04.1.454.CMB.2.raw
  modified_base (431)..(431): a, c, t, g, unknown or other
  misc_feature (431)..(431): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccagacttcctggccctgtctctgggcgagagggccaccatcaactgcacgtccagccagagtctttcacagctccagcaataggaactacttacttggtaccaacagaaaccaggcagcctcccagactactcatttactgggcatctacccgggaatccggggtccctgaccgattcccagtggcaggcgggtctgggcagatttcactctcaccatcagcagcctgcagctagaagatgtggcttgtttattactgtacaacaagancattccttcctacccttatttccgtttacggcccgtaagggggaccaaggctaggagactacaaacgaacgtgtcgctgcaccatc

SEQ ID NO: 318524 - DNA, 564 bp, Homo sapiens
  misc_feature: GZ8MTXP02JT1CI.44.4.A04.1.454.CMB.2.raw
  modified_base (340)..(340): a, c, t, g, unknown or other
  misc_feature (340)..(340): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggagcctacggggacatcgtgctgacccagtccccagacctccctggctgtgtctcgtgggcgagacgggccaccatcacctgcaagtccagccacaaccttggatacaggtccaagttgagtaattacttggttgtatcaacagaaggcaggacagcctctaggttcctcatttacggacatccgaggcgggcagtccgggtcctgaccgntccagcgcagcgggtctgggcagctcgcactcacatcaacgcctgcgagggtagaaagtctcgttgactaacttatacctgtcagctagttatttagaaacgtccctacgtacgtttcggggcgggggtacaggggtacgtaacgtcgaacggaacgtaacgtggtacggtcttcggacctaaccgtgttcgtcgttacctttccgtaacgttcccttcccccg

SEQ ID NO: 318525 - DNA, 485 bp, Homo sapiens
  misc_feature: GZ8MTXP02FWRYH.44.4.A04.1.454.CMB.2.raw
  modified_base (303)..(303): a, c, t, g, unknown or other
  misc_feature (303)..(303): n is a, c, g, or t
  modified_base (396)..(396): a, c, t, g, unknown or other
  misc_feature (396)..(396): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccagacttcctggccctgtctctgggcgagagggccaccatcaactgcacgtccagccagagtctttctacagctccagcaataggaactacttacttggtaccaacagaaaccaggcagcctcccagactactcatttacnggcatctaccggatccggggtcctgaccgattccagtgcagcggtctgggcagatttcactctcaccatcagcagcctgcaggctgaagatgngctgtttatactgtcaacaagagcatcttcctcctattctttggccagggtaccaagcgtgagatcaaacgaactgtaggctgcacatc

SEQ ID NO: 318526 - DNA, 595 bp, Homo sapiens
  misc_feature: GZ8MTXP02GCXV1.44.4.A04.1.454.CMB.2.raw
  modified_base (268)..(268): a, c, t, g, unknown or other
  misc_feature (268)..(268): n is a, c, g, or t
  modified_base (310)..(310): a, c, t, g, unknown or other
  misc_feature (310)..(310): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccagacttcctggccctgtctctgggcgaggaggccaccatcaactgcacgtccagccagagtctttcacagctccagcaataggaactacttacttggtaaccaanaagaaaccgagggcacgccctcccagactactctatttacgnggcatccgtacccgggagtcccggggtccctgaccgtattccgaggtgcaggcggtctggggcagtattcactctcacctatcagcagcctgaccgtaggctagaagtagtggtggtctttggtttaacttacgtagtacaaacgaagacgtacttaacttccctttcccttaccctttagttttccgttttacgggaccggtaacgggggtaaccaacggtacgtagggaactaacgttaaccgaaaacggtaacgtggtcggactacggaccacctacgttcg

SEQ ID NO: 318527 - DNA, 535 bp, Homo sapiens
  misc_feature: GZ8MTXP02JQN60.44.4.A04.1.454.CMB.2.raw
  modified_base (301)..(301): a, c, t, g, unknown or other
  misc_feature (301)..(301): n is a, c, g, or t
  modified_base (399)..(399): a, c, t, g, unknown or other
  misc_feature (399)..(399): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccagacttcctggccctgtctctgggcgagaggccaccatcaactgcacgtccagccagagtcttttcacagctccagcaataggaactacttacttggtaccaacagaaaccagggcagcctccagactactcattacnggcatccgtacccgggaatccggggtcctgaccgattccagtgcagcgggtctgggacagtatttcactctcaccatcagcacgcctgcagctgaagntgtgctgtttatactgtacaacagagcattcttcctccttatttcgtttcggtaccgacggggtacccaaggtcctaggacgtactaaccgaaaacgtaacgttaggtacggtactacgacctaaccgtacttccg

SEQ ID NO: 318528 - DNA, 526 bp, Homo sapiens
  misc_feature: GZ8MTXP02JWDNA.44.4.A04.1.454.CMB.2.raw
  modified_base (294)..(294): a, c, t, g, unknown or other
  misc_feature (294)..(294): n is a, c, g, or t
  modified_base (398)..(398): a, c, t, g, unknown or other
  misc_feature (398)..(398): n is a, c, g, or t
  modified_base (518)..(518): a, c, t, g, unknown or other
  misc_feature (518)..(518): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggagcctacggggacatcgtgctgacccagtccccagacctccctggctgtgtctctgggcgaggaggccaccatcacctgcaagtccagccacaaccttggatacaggtccaagttgagaattacttggttgatcaacagaaggcaggacagcctctaggtcctnatttacggacatccgaggcgggcagtcccggggtcctgaccgattccgagcgccaggcgggtctgggacagacttcgcactcaccatcaacggcctgcagggtnaagatcttagctaacttattactgtcagctagtatttagaaacgtccctatacgtttcgggcgggggtaccaggggtcgaactcgagacgaacgtggtcgctgcaaccgatcgtgtctcnctctcccg

SEQ ID NO: 318529 - DNA, 574 bp, Homo sapiens
  misc_feature: GZ8MTXP02I9JDH.44.4.A04.1.454.CMB.2.raw
  modified_base (298)..(298): a, c, t, g, unknown or other
  misc_feature (298)..(298): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccagacttcctggccctgtctctgggcgagagggccacatcaactgcacgtccagccagagtctttcacagctccagcaataggaactactacttggtaccaacagaaaccaggcagcctccagactactcattacnggcatctaccggatccgggtcctgaccgatccgagtgcaggcgggtctcgggacagtatttcactctacaccatcagcagcctgcagctagaagtatgtggtcttgtttatacgtgtacaaacgtaagagcaacttccttcccttaccctttaatttccgttttacgggacccgtaacgggggaaccctaaaacggtccgtaagggtaacgaaacgttaccgaaaaaccggtaaacgtcggttacgggaccttggaccctaacccgtaatttcccg

SEQ ID NO: 318530 - DNA, 545 bp, Homo sapiens
  misc_feature: GZ8MTXP02GQWFZ.44.4.A04.1.454.CMB.2.raw
  modified_base (302)..(302): a, c, t, g, unknown or other
  misc_feature (302)..(302): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccagacttcctggccctgtctctgggcgagagggccaccatcaactgcacgtccagccagagtcttttcacagctccagcaataggaactacttacttggaccaacagaaaccaggcagcctcccagactactcatttacnggcatccgtacccgggaatcccggggtcctgaccgtattccagtgcagcggtctgggcagactttcactctcaccatcagcagcctgcagctagaacgatgtggtcttaggtttacttactgttacaacgtaagacgctaatccttcctcccttatttccgtttcggaccgtacggggacctaacggtcgtacggagacgtaccgaaaacgtaacgtggtacgtctacggaccacctattccg

SEQ ID NO: 318531 - DNA, 564 bp, Homo sapiens
  misc_feature: GZ8MTXP02F1T5V.44.4.A04.1.454.CMB.2.raw
  modified_base (302)..(302): a, c, t, g, unknown or other
  misc_feature (302)..(302): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccagacttcctggccctgtctctgggcgagagggccaccatcaactgcacgtccagccagagttctttcacagctccagcaataggaactacttacttggtaccaacagaaaccaggcagcctccagactactcatttacnggcatccgtaccgggaatcccggggtcctgaccgattccagtgcaggcggtctgggcagatttcactctcaccatcagcagcctgcaggctagaagatgtgtcttgtttattactgtacaaacgaagagctattccttcctaccccttaatttccgttttcgggaccgtaacgggggtaacccaaaggtccgttaggggaacgtaaacttacgaaaaaccggtaaacgttggttacggactacggacctaaccctatttccg

SEQ ID NO: 318532 - DNA, 733 bp, Homo sapiens
  misc_feature: GZ8MTXP02J1A66.44.4.A04.1.454.CMB.2.raw
  modified_base (211)..(211): a, c, t, g, unknown or other
  misc_feature (211)..(211): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccagacttcctggccctgtctctgggcgagagggccaccatcaactgacnccacgcacgagtctttcttacacgcgtcctacgacaataacgtaacgtaactttacttacgttacgaaccaacgaaaccgaacggcgacgaccgtccccacgactactactactttactggtcgactacgtacccgggtaacggtccgggttcccggtcgtaccggtactcgtacgaggtcgacgtacggggtcggtcggacggacgtagtttacctacgtctacctaccaacttaccgacgacgaccgtaccgttaccgccggacgtccggtagtaaacggtaagtcgttgggtccgttagttttaacggtttacttacggtacgttaaaccaaacgggtaagcctaactttaccctttaccccttcccctttacgttttaccgtttttccggggacccgtaaccgggggttacccggaaacgacgggtttccggaaggttaaccgtaaccggtaaaacccgtaaaacggttcggttacgggtaccgttacggacccgtactaaccggtttactttaccgg

SEQ ID NO: 318533 - DNA, 551 bp, Homo sapiens
  misc_feature: GZ8MTXP02J08NJ.44.4.A04.1.454.CMB.2.raw
  modified_base (446)..(446): a, c, t, g, unknown or other
  misc_feature (446)..(446): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccagacttcctggccctgtctctgggcgagagggccaccatcaactgcacgtccagccagagttcttttcacagctccagcaataggaactacttacttggtaccaacagaaaccagggcagcctacccagacctactcatttacgtggcatccgtacccgggaatcccggggtccctgaccgattcccgagtggcaggcgggtctgggcagtactttcactctcacatcagcagcctgcaggctaggaagagtgtggtcttagtttattactgtacaacaaganctatccttcctccttatttcgtttcggaccgtacggggaccaacggtcgtaggacgtaacgtaaccaaaacgtaacgtggtacgtctacgacctaacctattccg

SEQ ID NO: 318534 - DNA, 521 bp, Homo sapiens
  misc_feature: GZ8MTXP02HW42V.44.4.A04.1.454.CMB.2.raw
  modified_base (374)..(374): a, c, t, g, unknown or other
  misc_feature (374)..(374): n is a, c, g, or t
  modified_base (432)..(432): a, c, t, g, unknown or other
  misc_feature (432)..(432): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccagacttcctggccctgtctctgggcgagagggccaccatcaactgcacgtccagccagagtcttttctacagctccagcaataggaactacttacttggtaccaacagaaaccagggcagcctcccagactactcattactggcatctaccgggaatcccggggtcctgaccgattccagtggcaggcgggtctgggcagatttcacttcncaccatcagcagcctgcaggctgaagatggtggtcttgtttattactgtacaacaagngcattcttccctccttattctttcggcctacggggaccaagcgtaggacgtactacaaaacgtaacgtgtacggctagcctactactcg

SEQ ID NO: 318535 - DNA, 488 bp, Homo sapiens
  misc_feature: GZ8MTXP02FVCZZ.44.4.A04.1.454.CMB.2.raw
  modified_base (397)..(397): a, c, t, g, unknown or other
  misc_feature (397)..(397): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccagacttcctggccctgtctctgggcgagagggccaccatcaactgcacgtccagccagagtctttctacagctccagcaataggaactacttacttggtaccaacagaaaccagggcagcctcccagactactcatttactggcatctacccggaatccgggtcctgaccgattccagtgcagcggtctgggcagatttcactctcaccatcagcagcctgcagctgaagatgngctgtttatactgtcaacagagcatcttctccctattctttggcctaggggaccaagctggacgatcaaacgaacgtgtcgactgcacatc

SEQ ID NO: 318536 - DNA, 498 bp, Homo sapiens
  misc_feature: GZ8MTXP02GJ842.44.4.A04.1.454.CMB.2.raw
  modified_base (301)..(301): a, c, t, g, unknown or other
  misc_feature (301)..(301): n is a, c, g, or t
  modified_base (397)..(397): a, c, t, g, unknown or other
  misc_feature (397)..(397): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccagacttcctggccctgtctctgggcgagagggccaccatcaactgcacgtccagccagagtcttttcacagctccagcaataggaactacttacttggtaccaacagaaaccaggcagcctccagactactcattacnggcatctaccgggaatccggggtcctgaccgattccagtgcagcggtctgggcagatttcactctcaccatcagcagcctgcaggctagaagatgnggcttgtttacttactgtacaacaagagcatcttcctccctatttctttgccgaggggtaccaagctggagactacaaacgaactgtaggctgcaccatcg

SEQ ID NO: 318537 - DNA, 526 bp, Homo sapiens
  misc_feature: GZ8MTXP02JFKAH.44.4.A04.1.454.CMB.2.raw
  modified_base (305)..(305): a, c, t, g, unknown or other
  misc_feature (305)..(305): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccagacttcctggccctgtctctgggcgagagggccaccatcaactgcacgtccagccagagtcttttctacagctccagcaataggaactacttacttggtaccaacagaaaccagggcagcctcccagactactcatttacngggcatctacccgggaatccggggtccctgaccgattcccagtggcaggcggtctgggcagatttcactctcaccatcagcagcctgcaggctgaagatgtggcttgtttattactgtacaactaagagcaatcttctacccttattctttcggcctacgggggtaccaaacggtctacggagaacttacaaaacgaacgtagtcggctcgacacctatcc

SEQ ID NO: 318538 - DNA, 499 bp, Homo sapiens
  misc_feature: GZ8MTXP02JY4VT.44.4.A04.1.454.CMB.2.raw
  modified_base (303)..(303): a, c, t, g, unknown or other
  misc_feature (303)..(303): n is a, c, g, or t
  modified_base (420)..(420): a, c, t, g, unknown or other
  misc_feature (420)..(420): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccagacttcctggccctgtctctgggcgagagggccaccatcaactgcacgtccagccagagtcttttcacagctccagcaataggaactacttacttggtaccaacagaaaccagggcagcctccagactactcatttacnggcatctacccggaatccgggtcctgaccgattccagtgcagcggtctgggcagatttcactctcaccatcagcagcctgcaggctgaagatgtgctgtttatactgtacaacaagngacatcttacctccctatttcttcgccgtaggggaccacgtctaggagactacaaacgaacgtgtggctgacaccatcg

SEQ ID NO: 318539 - DNA, 587 bp, Homo sapiens
  misc_feature: GZ8MTXP02GHR97.44.4.A04.1.454.CMB.2.raw
  modified_base (301)..(301): a, c, t, g, unknown or other
  misc_feature (301)..(301): n is a, c, g, or t
  modified_base (375)..(375): a, c, t, g, unknown or other
  misc_feature (375)..(375): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccagacttcctggccctgtctctgggcgagaggccaccatcaactgcacgtccagccagagtctttcacagctccagcaataggaactacttacttggtaccaacagaaaccaggcagcctcccagactactcatttacnggcatcgtacccgggaatcccggggtcctgaccgattcccagtgacagcggtctgggcagatttcactctcacntcagcagcctgcaggctgaagagtgtggcttgtttacttacttagtacaaacgtaaagacgactaacttcccttacccttccccttaattttccgtttttacgggacccgtacgggggtaaaccctaaaaggtccgttaggggaaacgtaacttaaccgaaaaaccggtaaaccgttcggtagggtacctacgaccgaacctaacgtttccg

SEQ ID NO: 318540 - DNA, 602 bp, Homo sapiens
  misc_feature: GZ8MTXP02HQOEX.44.4.A04.1.454.CMB.2.raw
  modified_base (264)..(264): a, c, t, g, unknown or other
  misc_feature (264)..(264): n is a, c, g, or t
  modified_base (297)..(297): a, c, t, g, unknown or other
  misc_feature (297)..(297): n is a, c, g, or t
  modified_base (393)..(393): a, c, t, g, unknown or other
  misc_feature (393)..(393): n is a, c, g, or t
  modified_base (402)..(402): a, c, t, g, unknown or other
  misc_feature (402)..(402): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccagacttcctggccctgtctctgggcgagaggccacatcaactgcacgtcagccagagtcttttcacagctccagcaatagaactacttacttgaccaacanaaccaggcagccctccagactactcaattacgnggacatccgtaacccgggaatcccggggtcctgacccgtattcccgagttcggcacggcggttcgagggacagtctttacaccttctaccacctancagcacgcngacgaggctagaagtgtgtagtacgtttagtttaattacgtagtaacaaacgaagacgtacttactttcccttaccctttacctttagtttaccgtttaccggacccggtaaacggggtacctaaacgtcggtaacgggtaaacgtaacctaaaccgaaaacgtaacgtaggtaccggactacgaccctaacctactccg

SEQ ID NO: 318541 - DNA, 577 bp, Homo sapiens
  misc_feature: GZ8MTXP02G4X1S.44.4.A04.1.454.CMB.2.raw
  modified_base (274)..(274): a, c, t, g, unknown or other
  misc_feature (274)..(274): n is a, c, g, or t
  modified_base (293)..(293): a, c, t, g, unknown or other
  misc_feature (293)..(293): n is a, c, g, or t
  modified_base (301)..(301): a, c, t, g, unknown or other
  misc_feature (301)..(301): n is a, c, g, or t
  modified_base (447)..(447): a, c, t, g, unknown or other
  misc_feature (447)..(447): n is a, c, g, or t
  modified_base (455)..(455): a, c, t, g, unknown or other
  misc_feature (455)..(455): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccagacttcctggccctgtctctgggcgagaggccacatcaactgcacgtcagccagagtcttttcacagctccagcaataggaactacttacttggtaccaacacgaaaccnggcagcctccagactactnatttacgnggcatccgtaccgggaatcccggggtacctgaccgtatccgagcggcaggcgggtctgggcagtcttcactctcacatcagtcagcctgccgaggcttaggaaagtgtggtggtactttaggttttaacttacgtgttaaccaaanaaggtacnctacttcccttaccttccctttatttcgtttacggaccggtaaggggtacccaaaggtccgtagggactaacgttaacgaaaacggtaacgtggtacggtctacgacctaaccgtactttcg

SEQ ID NO: 318542 - DNA, 560 bp, Homo sapiens
  misc_feature: GZ8MTXP02GU7CO.44.4.A04.1.454.CMB.2.raw
  modified_base (305)..(305): a, c, t, g, unknown or other
  misc_feature (305)..(305): n is a, c, g, or t
  modified_base (410)..(410): a, c, t, g, unknown or other
  misc_feature (410)..(410): n is a, c, g, or t
  modified_base (413)..(413): a, c, t, g, unknown or other
  misc_feature (413)..(413): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccagacttcctggccctgtctctgggcgagaggccaccatcaactgcacgtccagccagagttctttctacagctccagcaataggaactacttacttggtaccaacaagaaaccagggcagcctaccagactactcatttacnggacactccgtacccgggaatcccggggtcctggaccgattcccgagtcgcaggcggtcgtgggcagtacttcactctcaccatcagcagcctgcgagctgaagntgnggtctgtttattacgtgtactaaacaagtagactattccttaccctccttacttcgtttcggacccgtagggggaccctaaagtcgtagggaacgtactaaccaaaacggtaaccgttggtaacggtctcggaccaccctagttccg

SEQ ID NO: 318543 - DNA, 533 bp, Homo sapiens
  misc_feature: GZ8MTXP02GRZJZ.44.4.A04.1.454.CMB.2.raw
  modified_base (306)..(306): a, c, t, g, unknown or other
  misc_feature (306)..(306): n is a, c, g, or t
  modified_base (325)..(325): a, c, t, g, unknown or other
  misc_feature (325)..(325): n is a, c, g, or t
  modified_base (331)..(331): a, c, t, g, unknown or other
  misc_feature (331)..(331): n is a, c, g, or t
  modified_base (337)..(337): a, c, t, g, unknown or other
  misc_feature (337)..(337): n is a, c, g, or t
  modified_base (339)..(339): a, c, t, g, unknown or other
  misc_feature (339)..(339): n is a, c, g, or t
  modified_base (347)..(347): a, c, t, g, unknown or other
  misc_feature (347)..(347): n is a, c, g, or t
  modified_base (368)..(368): a, c, t, g, unknown or other
  misc_feature (368)..(368): n is a, c, g, or t
  modified_base (377)..(377): a, c, t, g, unknown or other
  misc_feature (377)..(377): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccagacttcctggccctgtctcgtgggcagaggccaccatcaactgcacgtccagccagagtctttcacagctccagcaaataggaactacttacttggtaccaaacagaaaccagggcaagcctcccagactactcatttacgngcatcgaccggatccggcngacgtntcgagngnagcggtcnggcagtacttcactcacacancagcacgcngacgagctagaagagtgtgtgttagttattactagtactagagtaagtaataagtacgtacgtacgtaccgtacccgtaccggaccgaacggaacgacgacgtacggaacgtaaacgtaaacgtaacgtaagtacgacgtacgacactactactcg

SEQ ID NO: 318544 - DNA, 599 bp, Homo sapiens
  misc_feature: GZ8MTXP02GSP8M.44.4.A04.1.454.CMB.2.raw
  modified_base (266)..(266): a, c, t, g, unknown or other
  misc_feature (266)..(266): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggagcctacggggacatcgtgctgacccagtccccagactccctggctgtgtctctgggcgagaggccaccatcacctgcaagtccagccacaaccttggatacaggtccaagttgagaattacttggttgtatcaanagaaggcaggacagcctcctaggttcctcatttacggacatccgaggcgggcacgtcccggggtcctgaccgtattcccagccgccaggccgggtctggggcagacttcgccactcaccatacaacggcctgcgagggtagaagatcgttgactaacttattactgtacagtactagttagtttagaaacggtccccttacgtaccggtttacggggaccggggggtaaccgtagggggtacggtaaacgtcgaacggaaccggtaaacgtaggtcggaccgtacggaccgaaccgtacttccgtcgttaccttctactttccgtttcccccg

SEQ ID NO: 318545 - DNA, 637 bp, Homo sapiens
  misc_feature: GZ8MTXP02IXHER.44.4.A04.1.454.CMB.2.raw
  modified_base (394)..(394): a, c, t, g, unknown or other
  misc_feature (394)..(394): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccagactccctggctgtgcctctgggcgagagggccaccatcaactgcaagtccagccagagtgtttttacagctccaacaataagaactactagcttggtaccagcagaagccgaggacagcctactaagtgcttctttacgtggtcttccgtacccggagtcccgggtcctcgaccgattccagtgcaggcggtcgtgggacagtactttcactctacacctataccaaanacgtccctggaccgaagcgttagaaagagttggtcggtaccttacgtttttaatttccgttggttctacggtactaaaatttaactttacttaaccctccccgtttaagtacgtttacggttttcgggaccccggttaagggggaacccgtaaaggggtgggtaaacgtaagttaacgaaaaaacgggtaccgttggtaacgggtaccttcggaccctacgtaactttccgtacgttttcccc

SEQ ID NO: 318546 - DNA, 509 bp, Homo sapiens
  misc_feature: GZ8MTXP02IN2IU.44.4.A04.1.454.CMB.2.raw
  modified_base (233)..(233): a, c, t, g, unknown or other
  misc_feature (233)..(233): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgcctgcggggacatcgcgatgagccagtctccagactccctggctgtgtctctgggcgagagggccaccgtcaactgcaactccagccaaagtgtcttttangtccccaatagtaagaactattagcctggtaccaacagaaaccggacagtctcctaaattactcttttatggcatctatcggagtccggggtcctgaccgattcagtggcggcggtctgggacacgattcgactctcaccatcagtagcctgcagctgagacgtgcagttatatgtacaactatatttagacttctatctactttcggcgaggaccagagtagagatacaaacgtaactgtggctgccaacactactcgtcttcacttcttccccg

SEQ ID NO: 318547 - DNA, 501 bp, Homo sapiens
  misc_feature: GZ8MTXP02FIIHG.44.4.A04.1.454.CMB.2.raw
  modified_base (303)..(303): a, c, t, g, unknown or other
  misc_feature (303)..(303): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccagacttcctggccctgtctctgggcgagaggccaccatcaactgcacgtccagccagagtctttctacagctccagcaataggaactacttacttggtaccaacagaaaccagggcagcctcccagactactcatttacngggcatctacccgggaatccggggtccctgaccgattcccagtggcagcgggtctggggcagatttcactctcaccatcagcagcctgcaggctgaagatgtggctgtttattactgtcaaacaagagcatcttcctccctattctttggcctaggggaccaaagctggagatcaaacgaactgtaggctgcaccatc

SEQ ID NO: 318548 - DNA, 513 bp, Homo sapiens
  misc_feature: GZ8MTXP02FPTRJ.44.4.A04.1.454.CMB.2.raw
  modified_base (426)..(426): a, c, t, g, unknown or other
  misc_feature (426)..(426): n is a, c, g, or t
tcagacagtatatacacgaccggtgctcgatttagagtagtgatcaggggagctacaacaggcaggcaggggcagcaagatggtgttgcagacccaggtcttcatttctctgttgctctggatctctggtgcctacggggacatcgtgatgacccagtctccagacttcctggccctgtctctgggcagagggccaccatcaactgcacgtccagccagagtcttttctacagctccagcaataggaactacttacttggtaccaacagaaaccagggcagcctcccagactactcatttactggcatctacccgggaatcccggggtcctgaccgtattccagtgacagcgggtctggggcagatttcactctcacatcagcagctgcaggctgaagatgtggcttgttatactgtacaacagancatcttcctcctatttctttggccaggggtaccaaagtctaggacgataccgaaaacgtaactagttacggcttgaccaccagtttc

SEQ ID NO: 318549 - DNA, 552 bp, Homo sapiens
  misc_feature: GZ8MTXP02IDY3P.44.4.A04.1.454.CMB.2.raw
  modified_base (263)..(263): a, c, t, g, unknown or other
  misc_feature (263)..(263): n is a, c, g, or t
  modified_base (271)..(271): a, c, t, g, unknown or other
  misc_feature (271)..(271): n is a, c, g, or t
  modified_base (297)..(297): a, c, t, g, unknown or other
  misc_feature (297)..(297): n is a, c, g, or t
  modified_base (324)..(324): a, c, t, g, unknown or other
  misc_feature (324)..(324): n is a, c, g, or t
  modified_base (330)..(330): a, c, t, g, unknown or other
  misc_feature (330)..(330): n is a, c, g, or t
  modified_base (347)..(347): a, c, t, g, unknown or other
  misc_feature (347)..(347): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccagacttcctggccctgtctctgggcgagagggccaccatcaactgcacgtcagccagagttcttttcacagctccagcaatagactactacttgaccaanagaaaccnggcagcctccagactactcatttacnggcatccgtaccgggatccgggtcccngaccgntccagtgcaggcggtcngggacagtatttcgactctacactatccagcagcctgccaggctagaagtagtggtggtctttaggttttacttacttgtacaaacgaaagtgactacttcctttcccttaccttctttccgttttcggaccgtaacggggacctaagtcgtaggtacgaacttaccgaaacgtaaccgtgtcggactacgacctactacttccg

SEQ ID NO: 318550 - DNA, 547 bp, Homo sapiens
  misc_feature: GZ8MTXP02GUHR7.44.4.A04.1.454.CMB.2.raw
  modified_base (299)..(299): a, c, t, g, unknown or other
  misc_feature (299)..(299): n is a, c, g, or t
  modified_base (392)..(392): a, c, t, g, unknown or other
  misc_feature (392)..(392): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccagacttcctggccctgtctctggcgagaggccacatcaactgcacgtccagccagagtctttcacagctccagcaataggaactacttacttggtaccaacagaaaccagggcagcctccagactactcatttacnggcatcctacccgggatcccgggtcctgaccgattccagtgcagcggtctgggcagatttcactctcacatcagcagcctgcaggctagaagntgtggtcttgtttattctgtacaacaagagacattccttccctcctttatttcgtttacggaccgtaacgggggtaccctaaaggtccgtagggtaacgtaacttacgaaaacgtaaccgttggtacggtcttacggacctaaccgtactttccg

SEQ ID NO: 318551 - DNA, 670 bp, Homo sapiens
  misc_feature: GZ8MTXP02FUPAK.44.4.A04.1.454.CMB.2.raw
  modified_base (418)..(418): a, c, t, g, unknown or other
  misc_feature (418)..(418): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccagactccctggctgtgcctctgggcgagagggccaccatcaactgcaagtccagccagagtgtttttacagctccaacaataagaactactagctggtaccagcagaagccgagacacgcctaccgtaagttcgtcttctttacgtcggtcttaccgtaacccgggtaacgtcccgggtccctacgaccgtattcccgagtcggcgacggcggtcgtagggcgagtacttcactctacaccatacaacagtcccngaccaggtctaaggaaagtgtggtacggtacctttaacttttacgtttcgttcggttactacggtaaccttaaattaactttaaccttacccctttccccgtttaagttaccgtttacgggttttaccgggaacccggttaacgggggaaacccgttaaagggggtggtaaacggtaagttaaaacccggaaaaagggtaaccgttgggtaacggtcgtacggaccctaacctacgtttcgtcgtttaaccc

SEQ ID NO: 318552 - DNA, 525 bp, Homo sapiens
  misc_feature: GZ8MTXP02GX1GO.44.4.A04.1.454.CMB.2.raw
  modified_base (297)..(297): a, c, t, g, unknown or other
  misc_feature (297)..(297): n is a, c, g, or t
  modified_base (305)..(305): a, c, t, g, unknown or other
  misc_feature (305)..(305): n is a, c, g, or t
  modified_base (309)..(309): a, c, t, g, unknown or other
  misc_feature (309)..(309): n is a, c, g, or t
  modified_base (312)..(312): a, c, t, g, unknown or other
  misc_feature (312)..(312): n is a, c, g, or t
  modified_base (317)..(317): a, c, t, g, unknown or other
  misc_feature (317)..(317): n is a, c, g, or t
  modified_base (327)..(327): a, c, t, g, unknown or other
  misc_feature (327)..(327): n is a, c, g, or t
  modified_base (332)..(332): a, c, t, g, unknown or other
  misc_feature (332)..(332): n is a, c, g, or t
  modified_base (336)..(336): a, c, t, g, unknown or other
  misc_feature (336)..(336): n is a, c, g, or t
  modified_base (341)..(341): a, c, t, g, unknown or other
  misc_feature (341)..(341): n is a, c, g, or t
  modified_base (350)..(350): a, c, t, g, unknown or other
  misc_feature (350)..(350): n is a, c, g, or t
  modified_base (363)..(363): a, c, t, g, unknown or other
  misc_feature (363)..(363): n is a, c, g, or t
  modified_base (367)..(367): a, c, t, g, unknown or other
  misc_feature (367)..(367): n is a, c, g, or t
  modified_base (374)..(374): a, c, t, g, unknown or other
  misc_feature (374)..(374): n is a, c, g, or t
  modified_base (376)..(376): a, c, t, g, unknown or other
  misc_feature (376)..(376): n is a, c, g, or t
  modified_base (381)..(381): a, c, t, g, unknown or other
  misc_feature (381)..(381): n is a, c, g, or t
  modified_base (384)..(384): a, c, t, g, unknown or other
  misc_feature (384)..(384): n is a, c, g, or t
  modified_base (389)..(389): a, c, t, g, unknown or other
  misc_feature (389)..(389): n is a, c, g, or t
  modified_base (395)..(395): a, c, t, g, unknown or other
  misc_feature (395)..(395): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggagcctacggggacatcgtgctgacccagtccccagactccctggctgtgtctcgtgggcgaggacggccgaccaagtccacctgacaagtccagccacaaccttggatacaggtccaagttgagaattattggttgatcaacagaagcaggacagcctctaggtccnattacggntacncgnggcgncgtccggccngacgntccngcgcnggcggtcgnggcagctcgcacncacnacacgcngngaggnagntctanactatntactgacagtctagttagttacgaaccgtcctacgtacggtcggggacggggacgagggtacgaacgtacgacggacgtaacgtgtcgtcgtacgtacgtaacgtactcgtcgttactctactccgtccg

SEQ ID NO: 318553 - DNA, 560 bp, Homo sapiens
  misc_feature: GZ8MTXP02HKTEG.44.4.A04.1.454.CMB.2.raw
  modified_base (304)..(304): a, c, t, g, unknown or other
  misc_feature (304)..(304): n is a, c, g, or t
  modified_base (338)..(338): a, c, t, g, unknown or other
  misc_feature (338)..(338): n is a, c, g, or t
  modified_base (384)..(384): a, c, t, g, unknown or other
  misc_feature (384)..(384): n is a, c, g, or t
  modified_base (402)..(402): a, c, t, g, unknown or other
  misc_feature (402)..(402): n is a, c, g, or t
  modified_base (405)..(405): a, c, t, g, unknown or other
  misc_feature (405)..(405): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccagacttcctggccctgtctctgggcgagaggccaccatcaactgcacgtccagccagagtcttttcacagctccagcaataggaactacttacttggtaccaacaagaaaccagggcagccctccagactactcatttacnggcatccgtacccggaagtccgggtcctgaccgnttccagtgcaggcggtctgggacagtatttcactctacaccatcancagcctgcaggctgaagntgngtcttagtttacttactagtacaaacgtaagacgactacttccttaccctcctttactttcgtttcggaccgtacgggggtaacccaaacgtcgtacggtaagtactaaccgaaaacgtaacgtcggtacggtccaggtacccacgtactttccg

SEQ ID NO: 318554 - DNA, 633 bp, Homo sapiens
  misc_feature: GZ8MTXP02F5DAD.44.4.A04.1.454.CMB.2.raw
  modified_base (334)..(334): a, c, t, g, unknown or other
  misc_feature (334)..(334): n is a, c, g, or t
  modified_base (438)..(438): a, c, t, g, unknown or other
  misc_feature (438)..(438): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccagacttcctggccctgtctctgggcgagaggccaccatcaactgcacgtccagccagatctttcacagctccagcaataggaactacttacttggtaccaacagaaaccagggcagcctacccagactactacatttactggcatccgtacccgggaatcccggggtcccngacccgtattcccagtcgcgaggtcgggtacgtggggaccaggtactttccgaccttcctacaacctataccgagccaacgccctggacccagggctagaaagnttgtaggtctttaggtttattaacgttgtacaaacgtaaagacgtactattccctttacccttacccttagttttccgttttacgggacccgttaaacgggggtaacccctaagggtaccttaggggaacgtaaacgtaccgtaaaaacggaaccgttaggtacggtacccgtagtaccctaacctaactttccg

SEQ ID NO: 318555 - DNA, 629 bp, Homo sapiens
  misc_feature: GZ8MTXP02FMO4M.44.4.A04.1.454.CMB.2.raw
  modified_base (308)..(308): a, c, t, g, unknown or other
  misc_feature (308)..(308): n is a, c, g, or t
  modified_base (428)..(428): a, c, t, g, unknown or other
  misc_feature (428)..(428): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccagacttcctggccctgtctctgggcgagaggccaccatcaactgcacgtccagccagagttctttcacagctccagcaaagtaggaactactttacttggtaaccaacagaaaccagggccagccctccagactactcatttacnggcatccgtaacccgggaattccccggggtccctggacccgtattcccgaggtcggcaggtcgggtctggggacagtactttcacgttctcacctatcagcagcctgcgagctagaaagntgtcggtacttgtttaacttacgtgttaccaaacgaagacgtactaacttcctttacccttacccttaatttccgttttacgggacccgtaacgggggtaaccctaaacggtccgtaaaggtaacggtaaacttaaccgtaaaaacggtaaccggttaggtacggggtaccttacggacccgtaaaaccctagtttacccg

SEQ ID NO: 318556 - DNA, 540 bp, Homo sapiens
  misc_feature: GZ8MTXP02FS2VD.44.4.A04.1.454.CMB.2.raw
  modified_base (303)..(303): a, c, t, g, unknown or other
  misc_feature (303)..(303): n is a, c, g, or t
  modified_base (331)..(331): a, c, t, g, unknown or other
  misc_feature (331)..(331): n is a, c, g, or t
  modified_base (359)..(359): a, c, t, g, unknown or other
  misc_feature (359)..(359): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccagacttcctggccctgtctctgggcgagagggccaccatcaactgcacgtccagccagagttctttctacagctccagcaataggaactacttacttggaccaacagaaaccagggcagcctccagactactcatttacnggcatcctacccgggaatccggggtccngaccgattccagtgcagcggtctgggcngatttcactctcaccatcagcagcctgcgaggctgaagagtagtgtcttgtttattacgtgtactaaacaagacgctacttcttcccttccttactttcgtttcggaccgtacggggtaccaacggtccgttaggacgtaactacaaaacgtaacgtaggtacggactcgacaccagttcg

SEQ ID NO: 318557 - DNA, 627 bp, Homo sapiens
  misc_feature: GZ8MTXP02G4R3O.44.4.A04.1.454.CMB.2.raw
  modified_base (301)..(301): a, c, t, g, unknown or other
  misc_feature (301)..(301): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccagacttcctggccctgtctctgggcgagagggccaccatcaactgcacgtccagccagagtctttcacagctccagcaataggaactacttacttggtaccaacagaaaccaggcagcctccagactactcatttacnggcatccgtacccgggaatcccggggtccctgacccgtattccagtcgcaggcggtctgggcagtactttcactctcacatcagcagcctgcgaggctagaaagtagtgtcggtacttaggttttaacttacgttacgtacgtaaaacgtaaacgtaacgtaccgttaactttccctttacccctttaccctttaaccgtttttaccgtttccggtaccggtaaaccggggttaaaccaacggtaccgtaagggtaacgtaacgtaaaccgtaaaaccggtaagttacggtacggtacgttacggacccgtaaccgtacgtttccg

SEQ ID NO: 318558 - DNA, 634 bp, Homo sapiens
  misc_feature: GZ8MTXP02HQLEY.44.4.A04.1.454.CMB.2.raw
tcagacagtatatacacgaccggtgctcgatttagagtagtgatcagggggagctacaacaggcaggcaggggcagcaagatggtgttgcagacccaggtcttcatttctctgttgctctggatctctggtgccgtacggggacatcgtgatgacccagtctccagacttcctggccctgtctctgggcgagagggccaccatcaactgccacgtccagccagtagttcttttcacagcctcagacaatacggtaacttacttacgtttacggaaccaaacaacgaaaccgagggaccacgcccctaccgaagaccttactactaatttacgcggacacgttacccgtaacccggggtaagtccccggggtcctacggaccgtattcccgagtcggcaggtcgggtcgagggacctagttactttcaccttccctaccacctacgtcacgaccaggccctgccgaggcctagaaagtgtggtacgttctttagtttaacttacgtgtaacgaaacgagtaacgtctaacttccctttcccttacctttagtttccgtttacgggaccgtacgggtacacgtcgtaggactaacgtaaccgaaaataacgttgcggtcacgtaccacttacgtcc

SEQ ID NO: 318559 - DNA, 573 bp, Homo sapiens
  misc_feature: GZ8MTXP02G1CKC.44.4.A04.1.454.CMB.2.raw
  modified_base (302)..(302): a, c, t, g, unknown or other
  misc_feature (302)..(302): n is a, c, g, or t
  modified_base (337)..(337): a, c, t, g, unknown or other
  misc_feature (337)..(337): n is a, c, g, or t
  modified_base (401)..(401): a, c, t, g, unknown or other
  misc_feature (401)..(401): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccagacttcctggccctgtctctgggcgagaggccaccatcaactgcacgtccagccagagttctttcacagctccagcaataggaactacttacttggtaccaacagaaaccaggcacgcctccagactactcatttacnggcatcctacccgggatcccggggtcctgaccgtnttccgagtgcaggcggtctgggcagtacttcactctcacatcagcagcctgcgaggctagaagntgtggtcttgtttaatctgtacaaacgaagacactacttccttacccttcccttagtttccgtttcggacccgtaagggggtaccctaaaggtccgttaaggggactaaacgttaccgaaaacggtaaccgttggtaacgggtccttacggacctaaacccgttacgttccg

SEQ ID NO: 318560 - DNA, 597 bp, Homo sapiens
  misc_feature: GZ8MTXP02H9QEC.44.4.A04.1.454.CMB.2.raw
  modified_base (280)..(280): a, c, t, g, unknown or other
  misc_feature (280)..(280): n is a, c, g, or t
  modified_base (301)..(301): a, c, t, g, unknown or other
  misc_feature (301)..(301): n is a, c, g, or t
  modified_base (308)..(308): a, c, t, g, unknown or other
  misc_feature (308)..(308): n is a, c, g, or t
  modified_base (374)..(374): a, c, t, g, unknown or other
  misc_feature (374)..(374): n is a, c, g, or t
  modified_base (398)..(398): a, c, t, g, unknown or other
  misc_feature (398)..(398): n is a, c, g, or t
  modified_base (424)..(424): a, c, t, g, unknown or other
  misc_feature (424)..(424): n is a, c, g, or t
  modified_base (469)..(469): a, c, t, g, unknown or other
  misc_feature (469)..(469): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccagacttcctggccctgtctctgggcgagagggccaccatcaactgcacgtcagccagagtcttttcacagcctccagcaatacggaactacttactttggaacccaacaagaaaccngggcagccctccagactactnatttacncggactatccgtaacccgggtaatcccgggtccctagacccgtattcccgagtggcaggcggttcngggacagtattccactctcaactntcagcacgcctgccaggctagaaagngttcgtggacttagttttactacgttagtactaaacgaaggtacnctaacttcccttcctttcccttaacgtttccgttttacgggacccgtaacggggtaccctaaagtccgttaaggggaactacgttaaaccgaaacgtaacgttgacggctaggacctacgtacttccg

SEQ ID NO: 318561 - DNA, 574 bp, Homo sapiens
  misc_feature: GZ8MTXP02GQMWZ.44.4.A04.1.454.CMB.2.raw
  modified_base (316)..(316): a, c, t, g, unknown or other
  misc_feature (316)..(316): n is a, c, g, or t
  modified_base (448)..(448): a, c, t, g, unknown or other
  misc_feature (448)..(448): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccagacttcctggccctgtctcgtgggcgaggacgggccaccatcaactgcaccgtccagccagtagttcttttctacagctccagacaataggaactacttacttgaaccaacaacgaaccagggcacgccctaccagactactctatttacgnggctagtcccgtaccgggaacgttcccggggtcctcggaccgtattaccgaggtcggacgagggtccgggtcgtaggggacctagttactttcacctcctacacctactcacgcacgctgcgagctagaagngtgtgtcttagttatcgttgacaacgagctactacttccttcctacttattcggttacgaccggtagggtaccagtcgtaggactaactacgaaacgtaacgtcgcggtactcgactacgtacttc

SEQ ID NO: 318562 - DNA, 555 bp, Homo sapiens
  misc_feature: GZ8MTXP02HWUAZ.44.4.A04.1.454.CMB.2.raw
  modified_base (292)..(292): a, c, t, g, unknown or other
  misc_feature (292)..(292): n is a, c, g, or t
  modified_base (299)..(299): a, c, t, g, unknown or other
  misc_feature (299)..(299): n is a, c, g, or t
  modified_base (309)..(309): a, c, t, g, unknown or other
  misc_feature (309)..(309): n is a, c, g, or t
  modified_base (404)..(404): a, c, t, g, unknown or other
  misc_feature (404)..(404): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccagacttcctggccctgtctctgggcgagagggccaccatcaactgcacgtccagccagagtcttttctacagctccagacaataggaactacttactttgaaccaacagaaaccaggacagccctccanacctacncaatttacgnggcatccgtacccgggaatcccggggtcctagaccgattccgagtcgacaggtcgggtctgggacagtactttcacctctcacatcagcagcctncgagctagagagtgtgtagttagtttattacttagtacaacaagaagactacttacttccttaccttactttacgttacgtacgacggtacgtaacgtacgtacgacgtacgtaacaaacgtaacgtagtacgtacgtacgacactactcg

SEQ ID NO: 318563 - DNA, 588 bp, Homo sapiens
  misc_feature: GZ8MTXP02F1BVU.44.4.A04.1.454.CMB.2.raw
  modified_base (304)..(304): a, c, t, g, unknown or other
  misc_feature (304)..(304): n is a, c, g, or t
  modified_base (415)..(415): a, c, t, g, unknown or other
  misc_feature (415)..(415): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccagacttcctggccctgtctctgggcgagaggccaccatcaactgcacgtccagccagagtcttttctacagctccagcaataggaactacttacttggtaaccaacagaaaccagggcagcctccagactactcatttacnggcatcctacccgggaatcccggggtcctgaccgattcccagtggcacggcgggtctgggcagtactttcgacttctcaccatcagcacgcctgcaggctagaagtatggngtcttgtttacttactgtacaaacgtaagacgctacttccttcccttccctttaatttcgttttacgggacccgtaacgggggtaaccctaaaggtccgttagggaacgtaactaaccgtaaaaaccgtaacgttcggtacggtccgttacggacctaaccgtaacgtttccg

SEQ ID NO: 318564 - DNA, 590 bp, Homo sapiens
  misc_feature: GZ8MTXP02F5D0Z.44.4.A04.1.454.CMB.2.raw
  modified_base (269)..(269): a, c, t, g, unknown or other
  misc_feature (269)..(269): n is a, c, g, or t
  modified_base (306)..(306): a, c, t, g, unknown or other
  misc_feature (306)..(306): n is a, c, g, or t
  modified_base (331)..(331): a, c, t, g, unknown or other
  misc_feature (331)..(331): n is a, c, g, or t
  modified_base (358)..(358): a, c, t, g, unknown or other
  misc_feature (358)..(358): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccagacttcctggccctgtctctgggcgagagggccaccatcaactgcacgtccagccagagttctttctacagctccagcaataggaactacttacttaggaccaanagaaaccagggcacgcctccagactactcatttacgnggcatccgaccgggatccgggtccngaccgtattccagtgcacggcgggtcnggggcagtactttccactctcacctatccagcacgcctgcgaggctaggaacgtagtggtgtcttagtttaagttaccttggttaaccaaacgtaagacgactacttcctttcctccctttagtttccgtttcggaccgtacggggtaccctaaaggtccgttagggaactaacgttaccgaaaacgtaacgttcgggtacggtaccttcggacctaaacccgttacttccg

SEQ ID NO: 318565 - DNA, 632 bp, Homo sapiens
  misc_feature: GZ8MTXP02IA6RK.44.4.A04.1.454.CMB.2.raw
  modified_base (425)..(425): a, c, t, g, unknown or other
  misc_feature (425)..(425): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccagacttcctggccctgtctcgtgggcgaggacgggccaccatcaactgcacgtccagccagtagtcttttcacagcctaccagacaagtacggaacttacttactttacggaaccaaacagaaaaccgagggcacgcccctacccagaacctactctaatttacgtggactacgtacccgtacccggggaacgtccccggggtccctcggaaccgtattccgaggtcggcgagggcggtcgtgggcagtattccgacttccnccacatccagaccacgtcctggaccgaggtcctaggaaagtcgttggtcggtactttagttttaactacgttagtacctaaaacgagacgtactacttcccttcctttccttagtttcccgtttacgggacccggaacggggttaaccaggtccgttaggacgtactaaccgaaaacgaacgttggtacgctacgaccactacttcg

SEQ ID NO: 318566 - DNA, 588 bp, Homo sapiens
  misc_feature: GZ8MTXP02J1IUT.44.4.A04.1.454.CMB.2.raw
  modified_base (277)..(277): a, c, t, g, unknown or other
  misc_feature (277)..(277): n is a, c, g, or t
  modified_base (306)..(306): a, c, t, g, unknown or other
  misc_feature (306)..(306): n is a, c, g, or t
  modified_base (383)..(383): a, c, t, g, unknown or other
  misc_feature (383)..(383): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccagacttcctggccctgtctctgggcgagagggccaccatcaactgcacgtccagccagagttcttttcacagctccagcaataggaacttacttacttgaaccaacagaaaccnggcacgcctcccagactactctattacgnggcatccgtaaccgggagtccgggtccctgaccgattcgagtgcaggcggtctgggcagtactttcactctcaaccntcagcacgcctggccgaaggtctagtaaagtagttggtgggtactttaggttttactacgttcgtacaaacgaagtagtacctaacttccctttccctaccctttattttaccgtttacggacccggtaagggggtacccctaaggtcgtacgggacaacgttaacgaaaacgtcgtaggtacggcttacgcctaacctactccg

SEQ ID NO: 318567 - DNA, 714 bp, Homo sapiens
  misc_feature: GZ8MTXP02IAS12.44.4.A04.1.454.CMB.2.raw
  modified_base (290)..(290): a, c, t, g, unknown or other
  misc_feature (290)..(290): n is a, c, g, or t
  modified_base (326)..(326): a, c, t, g, unknown or other
  misc_feature (326)..(326): n is a, c, g, or t
  modified_base (369)..(369): a, c, t, g, unknown or other
  misc_feature (369)..(369): n is a, c, g, or t
  modified_base (433)..(433): a, c, t, g, unknown or other
  misc_feature (433)..(433): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccagacttcctggcctgtctctgggcgagacgggccaccatcaactgccacgtcagccagtagttcttttcacagtcctcagacaagtaggtaactacttacgttacggaaccaaacacgaaaacccgngggacacgccctaccacgactactactactttacgnggactacgtccgtaaccgggacgtcccgggtcctacggacctnttccgaggtcggcacggggtcgggtcctaggggacaggttactttccgaccttccaccacctanaccgacacgacgtcccgtaggaccgtacggactaaggtaaacgtcgttagggtcggtacctttttaggttttaaacttaccgttagtaaccgtaaaacgtaaacggtcgtaacccttacgtttcccctttaccccgtttaccctttaacgtttttccggttttaaccgggaacccgggtaaacggggttaaacccccgaaggtttacggaacgggttaaacgacctttaaccgaaaaacggtaacgtcggtaacggcttaccggacctaacgttcttaccg

SEQ ID NO: 318568 - DNA, 568 bp, Homo sapiens
  misc_feature: GZ8MTXP02GTTQX.44.4.A04.1.454.CMB.2.raw
  modified_base (234)..(234): a, c, t, g, unknown or other
  misc_feature (234)..(234): n is a, c, g, or t
  modified_base (263)..(263): a, c, t, g, unknown or other
  misc_feature (263)..(263): n is a, c, g, or t
  modified_base (311)..(311): a, c, t, g, unknown or other
  misc_feature (311)..(311): n is a, c, g, or t
  modified_base (344)..(344): a, c, t, g, unknown or other
  misc_feature (344)..(344): n is a, c, g, or t
  modified_base (365)..(365): a, c, t, g, unknown or other
  misc_feature (365)..(365): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccaaagtccctggctgtgtctcgtgggcgagacgggccaccatcaactgcaagtccagccagtagttatttanaccacctaccaacaatcacctactactancatgtatcaacacacgaccaggcacgcctactagtcgctctattacgngggcacgtccggaacccggtagtcccgggtccngacgcgtatcgaggtcggcgnggtccgggtgtagggactagtactttccgactctaccacactcagcacgcctagaccaacgtagaactgtcggtggtactttagtttaccgttgtacgtacagtaactatttaaagtatacggtactcctacgccaccgttcggaacgaaacggtcaccggtagacggaataaacgtaaacgacgtggtacgactacgtaacc

SEQ ID NO: 318569 - DNA, 593 bp, Homo sapiens
  misc_feature: GZ8MTXP02H4VRS.44.4.A04.1.454.CMB.2.raw
  modified_base (303)..(303): a, c, t, g, unknown or other
  misc_feature (303)..(303): n is a, c, g, or t
  modified_base (377)..(377): a, c, t, g, unknown or other
  misc_feature (377)..(377): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccagacttcctggccctgtctctgggcgagagggccacatcaactgcacgtccagccagagttcttttctacagctccagcaataggaactacttacttgtaccaacagaaaccaggcagccctccagactactcatttacnggcatcctaccggatcccggggtacctgaccgattccgagtcgcaggcggtctgggcagtattcgactctcacntcagcagcctgcgagctagaaagtcgtgtgtactttagttttaactacgttgtaaccgtaaacgtaagaccgtctaactttcccttacccttccctttaactttccgttttacggacccggtaacgggggtaccctaaagggtctacggggaacctaacgttaaccgaaaacgtaacgttacggtacggtaccttacggacctaaccctatttccg

SEQ ID NO: 318570 - DNA, 648 bp, Homo sapiens
  misc_feature: GZ8MTXP02IUUKO.44.4.A04.1.454.CMB.2.raw
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccagacttcctggccctgtctctgggcgagaggccacatcaactgcacgtccagccagagttcttttcacagctccagcaataggaactacttacttggtaaccaacaagaaaccgagggcacgcccctacccgagactaactcaactttacgtgggacagtcccgtaacccggggtaactccccgggggtcctcggaaccggtatttcccgaggtcggcagggtcgggttcgtaggggactagtactttccgaccttcgacctaaccactacgagccgaagcccgtagccgaggtccgtaggaaagtagtagtggtcgtttagttttattacgttcgtaacgtaaaccgaagtacgacttacttaccttacccttacctttaatttcgttttacggaccggtacggggtaacctaacggtccgttagggacgtaactaccgaaaacgtaacgtacggtacgtcgttacgacctactaacgtttccg

SEQ ID NO: 318571 - DNA, 652 bp, Homo sapiens
  misc_feature: GZ8MTXP02GKWH1.44.4.A04.1.454.CMB.2.raw
  modified_base (237)..(237): a, c, t, g, unknown or other
  misc_feature (237)..(237): n is a, c, g, or t
  modified_base (336)..(336): a, c, t, g, unknown or other
  misc_feature (336)..(336): n is a, c, g, or t
  modified_base (503)..(503): a, c, t, g, unknown or other
  misc_feature (503)..(503): n is a, c, g, or t
  modified_base (529)..(529): a, c, t, g, unknown or other
  misc_feature (529)..(529): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccagacttcctggccctgtctcgtgggcgagaggccaccatcaactgcacgtccagccagtagttcttttctaacncgcctaccagacaaagtaaggaacttacttactttacggaaccaaactaacgaaaccgagggacacgcccctaccaagaccttactactaattttacgngggactaagttacccggtaaacccggggtaacgttccccggggtaccctaggaaccgtattcccgaggtcggactacggggccgggttcgcgggactacggtactttaccaacttcctaccaacctaactcgaagccgagccctagccgtaggacctaaggaaagtntgggtcggtctttagtttaattacgngtaaaccaaagagactctaatttcccttccttaccttagttttccgttacggaccggacgggtaaccaagttcgagtaacgacttacgaaaacgtcgtggtacgcttacgacctacttattcc

SEQ ID NO: 318572 - DNA, 568 bp, Homo sapiens
  misc_feature: GZ8MTXP02JL5Y2.44.4.A04.1.454.CMB.2.raw
  modified_base (295)..(295): a, c, t, g, unknown or other
  misc_feature (295)..(295): n is a, c, g, or t
  modified_base (303)..(303): a, c, t, g, unknown or other
  misc_feature (303)..(303): n is a, c, g, or t
  modified_base (338)..(338): a, c, t, g, unknown or other
  misc_feature (338)..(338): n is a, c, g, or t
  modified_base (356)..(356): a, c, t, g, unknown or other
  misc_feature (356)..(356): n is a, c, g, or t
  modified_base (375)..(375): a, c, t, g, unknown or other
  misc_feature (375)..(375): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccagacttcctggccctgtctctgggcgagaggccacatcaactgcacgtccagccagagttctttcacagctccagcaataggaactacttactttggtaaccaacagaaaccagggcagcctccagactacncatttacnggcatccgtacccgggaatccgggtcctgaccgtnttcccagtgcaggcggtntgggcagatttcgacttcnctaccatcagcagcctgcagctagaacgatgtggtcttagtttatacgtgtacaaactaagagtcatccttcctcccttagtttccgtttcgggtaccgtacgggggtacctaaacggtccgttagggacgtaactaaccgtaaaaaccggaacgttcggtacgggtacctggacccaaacccgtttactccg

SEQ ID NO: 318573 - DNA, 551 bp, Homo sapiens
  misc_feature: GZ8MTXP02H625K.44.4.A04.1.454.CMB.2.raw
  modified_base (277)..(277): a, c, t, g, unknown or other
  misc_feature (277)..(277): n is a, c, g, or t
  modified_base (364)..(364): a, c, t, g, unknown or other
  misc_feature (364)..(364): n is a, c, g, or t
  modified_base (386)..(386): a, c, t, g, unknown or other
  misc_feature (386)..(386): n is a, c, g, or t
  modified_base (410)..(410): a, c, t, g, unknown or other
  misc_feature (410)..(410): n is a, c, g, or t
  modified_base (538)..(538): a, c, t, g, unknown or other
  misc_feature (538)..(538): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccagacttcctggccctgtctctgggcgagagggccaccatcaactgcacgtccagccagagttcttttcacagctcagcaatacggaactactactttggaaccaacagaaaccnggcagccctaccagactactcattactggcactcgtaacccgggaatccggggtcctggaccgtattcccgagtcggcaggcggtcngggcagtattcgactctcacancagcacgcctgcaggctagaaagngtgtagcgtttacgtttatacgttagtacaacgaagtgactactctttaccgtacccttatttacgtttcgccgacgggaccaagtcgttagggaacacgttaacgaaaccgaacgttggacgacgtnaccaacctactcg

SEQ ID NO: 318574 - DNA, 644 bp, Homo sapiens
  misc_feature: GZ8MTXP02I32WZ.44.4.A04.1.454.CMB.2.raw
  modified_base (235)..(235): a, c, t, g, unknown or other
  misc_feature (235)..(235): n is a, c, g, or t
  modified_base (329)..(329): a, c, t, g, unknown or other
  misc_feature (329)..(329): n is a, c, g, or t
  modified_base (446)..(446): a, c, t, g, unknown or other
  misc_feature (446)..(446): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgccgtacggggacatcgtgatgacccagtctccagacttccgtggccctgtctcgtgggcgagaggccacatcaactgcacgtccagccagtattcttttcacngctcagacaatacggtaacttacttactttaggaaccaacaacgaaaaccgagggccaacgccccgtaccacgactacctactaactttaccgngggtcctacgtacccggtacccgggtaacgttccccggggtccctacgtaccggtacttccgaggtcgaccgaggcggggttcaggggacctagtactttccgactcgtacacctanacgacgcgacgtccgtgcgaggtctagaagtcgtggtgttactttagtttaacttacgtagtaacctaaagaacgtctaccttacttccttacccttccgtttactttcggttaccggaccggtaacgggaactacggtacgtacggtaactaacgtaaccgaaagtcgtggtcgtacgtaccgacctacttacttcg

SEQ ID NO: 318575 - DNA, 666 bp, Homo sapiens
  misc_feature: GZ8MTXP02I646M.44.4.A04.1.454.CMB.2.raw
  modified_base (277)..(277): a, c, t, g, unknown or other
  misc_feature (277)..(277): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgacccagtctccagacttcctggccctgtctctgggcgagagggccacatcaactgcacgtccagccagagtctttcacagctccagcaataggaactacttactttaggtaaccaacagaaaccngggcacgccctccagactactctactttacgtggcatacccgtacccgggattccccggggtccctacggaccgtacttcccgaggtcggactacgggtcggggtactacggggacctaggtaacttttccaaccgttcctacgaaccctactacacggaccacggtccctaggccgaggtcctagaacgtagttcggtggtactttacgttttaataccgttagtacctaaacgtaagacgtctaactttcccgttaccttcccgtttaactttcggttttacgggacccgtacggggtaacccctaaggtccgttagggacgtaaacgtaccgtaaaaccggtaacgttacgggacggtaccgttacgaccgtacctaacgtttccg

SEQ ID NO: 318576 - DNA, 719 bp, Homo sapiens
  misc_feature: GZ8MTXP02IKN7W.44.4.A04.1.454.CMB.2.raw
  modified_base (286)..(286): a, c, t, g, unknown or other
  misc_feature (286)..(286): n is a, c, g, or t
tcagacagtatatacacgaccggtgctcgatttagagtagtgatcagggggagctacaacaggcaggcaggggcagcaagatggtgttgcagacccaggtcttcatttctctgttgctctggatctctggtgcctacggggacatcgtgatgaccccagtctccagacttcctggccctgtctcgtgggcgaggagggccaccatcaactgcacgtccagccagattcttttcacagcctccagacaaataggaactactttacgttggaaccaacaagaaaaccngggcagtcccctaccagactactactatttactgggacaacgtacccgtacccggggtaacgtccccggggtccctaggaaccgtattccccgaggtcggacacgggcgggtcgtaggggacctaggtactttaccaccgttcctacgtaacccattacccgaagacccgacgtccctcggacgacgggtaccttaggtaaaacgtgttacgggtgtaccgttttaaggtttttaaaccttaaccgttgttaaacccgaaaaaggaaaccggtagtaacccttaactttccccgtttaccccttaacccggtttaactttttcccgggtttaccggggaaccgtaaacgggggtaacccctaaggtaccggttagggaaactaacgttaccgaaaaacggtaactgtacggtctacgaccaacctagttaccg

SEQ ID NO: 318577 - DNA, 408 bp, Homo sapiens
  misc_feature: GZ8MTXP01ECM36.2.86.H09.1.454.CMB.2.raw
  modified_base (398)..(398): a, c, t, g, unknown or other
  misc_feature (398)..(398): n is a, c, g, or t
  modified_base (401)..(401): a, c, t, g, unknown or other
  misc_feature (401)..(401): n is a, c, g, or t
  modified_base (404)..(408): a, c, t, g, unknown or other
  misc_feature (404)..(408): n is a, c, g, or t
tcagacgctcgacacacgaccggtgctcgatttagtgctatagacttggggtttgggatggatcaacgctaagagtggtggcacaaactatgcacagaaatttcagggcagggtcaccatgaccagggacacgtccacagacacagcctacatggagctgaggagactgagatctgacgacacggccgtgtattattgttcactcgacagtgtacacaaggtcccattgactcctggggccagggaaccctggtcaccgtctcctcagcctccaccaaggcccatcggtcttccccctggccgccctgctccaggagcacctcccgagacgcacagcggccctgggctgcctggtcaaaggctctcctgtcgagcgtctgagcgggctggcaaggcgntanagnnnnn

SEQ ID NO: 318578 - DNA, 408 bp, Homo sapiens
  misc_feature: GZ8MTXP01CXWBE.2.86.H09.1.454.CMB.2.raw
  modified_base (265)..(265): a, c, t, g, unknown or other
  misc_feature (265)..(265): n is a, c, g, or t
  modified_base (297)..(297): a, c, t, g, unknown or other
  misc_feature (297)..(297): n is a, c, g, or t
  modified_base (300)..(300): a, c, t, g, unknown or other
  misc_feature (300)..(300): n is a, c, g, or t
  modified_base (314)..(314): a, c, t, g, unknown or other
  misc_feature (314)..(314): n is a, c, g, or t
  modified_base (330)..(330): a, c, t, g, unknown or other
  misc_feature (330)..(330): n is a, c, g, or t
  modified_base (393)..(393): a, c, t, g, unknown or other
  misc_feature (393)..(393): n is a, c, g, or t
  modified_base (398)..(408): a, c, t, g, unknown or other
  misc_feature (398)..(408): n is a, c, g, or t
tcagacgctcgacacacgaccggtgctcgatttagtgctatagacttggggtttgggatggatcaacgctaagagtggtggcacaaactatgcacagaaatttcagggcagggtcaccatgaccagggacacgtccacagacacagcctacatggagctgaggagactgagatctgacgacacggccgtgtattattgttcactcgaccagtggttacacaaggtcccgattgactcgtggggccagggaccctggtcaccgtcncctcacgcctccacacggccatcgtctccccngcncctgctccaggacncacctcgagacgcacngccggcctggctgctgtcaaagctcttcctgtcgagcgtctgacgcggctggcgaaggccganagtgnnnnnnnnnnn

SEQ ID NO: 318579 - DNA, 303 bp, Homo sapiens
  misc_feature: GZ8MTXP01DOQD2.2.86.H09.1.454.CMB.2.raw
  modified_base (298)..(303): a, c, t, g, unknown or other
  misc_feature (298)..(303): n is a, c, g, or t
tcagacgctcgacacacgaccggtgctcgatttagtgctatagacttgggtttggtggtccctgaccgattctctgcctccaagtctggcacctcagcctccctggccatcagtgggctccggtccgaggatgaggctgattattactgtgcagcatgggatgacagcctgactggctcttatgtcttcggaactgggaccaaggtcaccgtcctaggtcagcccaaggccaacccatgtcactctcgttccccacctctctgtcgagcgtctgagcgggctggcaaggcgacatagnnnnnn

SEQ ID NO: 318580 - DNA, 460 bp, Homo sapiens
  misc_feature: GZ8MTXP02G0A6F.2.86.H09.1.454.CMB.2.raw
  modified_base (313)..(313): a, c, t, g, unknown or other
  misc_feature (313)..(313): n is a, c, g, or t
  modified_base (328)..(328): a, c, t, g, unknown or other
  misc_feature (328)..(328): n is a, c, g, or t
  modified_base (450)..(460): a, c, t, g, unknown or other
  misc_feature (450)..(460): n is a, c, g, or t
tcagacgctcgacacacgaccggtgctcgatttagtgctatagacttgggtttgggatggatcaacgctaagagtggtggcacaaactatgcacagaaatttcagggcagggtcaccatgaccagggacacgtccacagacacagcctacatggagctgaggagactgagatctgacgacacggccgtgtattattgtttcactcgaccagtggttacacaaggtcccatttgactccgtgggccagggaccctggtcaccgtctcctcacgcctccaccgaacggcccagtccggtcctcccccgtggcccnccctgcctccaggcnccacctccgagacgcacaggcccggcccgtggggcctaggcccgttagggtacaaacggccttacgttcctaggtcgacgtccgtcgtggacggcggggctggaccgaagggcgacagtagnnnnnnnnnnn

SEQ ID NO: 318581 - DNA, 414 bp, Homo sapiens
  misc_feature: GZ8MTXP02H9CD7.2.86.H09.1.454.CMB.2.raw
  modified_base (398)..(398): a, c, t, g, unknown or other
  misc_feature (398)..(398): n is a, c, g, or t
  modified_base (405)..(414): a, c, t, g, unknown or other
  misc_feature (405)..(414): n is a, c, g, or t
tcagacgctcgacacacgaccggtgctcgatttagtgctatagacttggggtttgggatggatcaacgctaagagtggtggcacaaactatgcacagaaatttcagggcagggtcaccatgaccagggacacgtccacagacacagcctacatggagctgaggagactgagatctgacgacacggccgtgtattattgtttcactcgaccagtggttacacaaggtcccgatttgactcctgggccagggaccctggtcaccgtctctcagcctccaccaaggcccatcggtcttccccctggccgccctgctccaggagcacctccgagagcacagcggccctgggctcgcctggtcaaggctcttcctgcgagcgtctgagcgggctggcaaggcncgatagnnnnnnnnnn

SEQ ID NO: 318582 - DNA, 382 bp, Homo sapiens
  misc_feature: GZ8MTXP02F9UEZ.2.86.H09.1.454.CMB.2.raw
  modified_base (180)..(180): a, c, t, g, unknown or other
  misc_feature (180)..(180): n is a, c, g, or t
  modified_base (371)..(371): a, c, t, g, unknown or other
  misc_feature (371)..(371): n is a, c, g, or t
  modified_base (376)..(382): a, c, t, g, unknown or other
  misc_feature (376)..(382): n is a, c, g, or t
tcagacgctcgacacacgaccggtgctcgatttagtgctatagacttgggtttggggtacgatttgatgttacctgatgcttagaggcttttcctggaagcagggcatttgttgcttcagcaccgtagtgcctcgtcatcacgcctcagccttgattttccggatttgcctggaaaaccngcctacacgcttaaaccgggacaaccgtcgcccggcaacatacgccttctccgtcccccttgcagtaacacaagtacagaatattaacctgttcccatcgactacgcctttcggcctcgccttaggggtcgactcgaccctgccccgattaacgtggacaggacctggtctcggcgagcggctggcagcgnatagnnnnnnn

SEQ ID NO: 318583 - DNA, 569 bp, Homo sapiens
  misc_feature: GZ8MTXP01DVYXA.41.27.C05.1.454.CMB.2.raw
tcagtctatactatcacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccagtagggggtccctgagactctcctgtgcagcctctggattcaccttcgataattggaatatgcagtgggtccgccaggctccaggcgagggggctgggagtgggtggcgaggtgtgtcatttccatggagaaatcaaaagtctaacgggtgtaagttcccggttagacgggggtcccgtatttccacccatctccagagaacaaattaccgagaacacagtgtactcttacaaatgaacagcctgacgacctacaggaccacggcccgtggttaattttgttgcgagtactaattcttgtttacctaaaatcgttctattcgacgtccgttggggaacccg

SEQ ID NO: 318584 - DNA, 607 bp, Homo sapiens
  misc_feature: GZ8MTXP01CU2C4.41.27.C05.1.454.CMB.2.raw
tcagtctatactatcacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtagggggtccctgagactctcctgtgcagcctctggattcaccttgataattggaatatgcaggtcggtccgccaggcctccgagggccggagggggctgggagtgggtggcagggtgtgtctatttcagtggaagaaatcgaaagtcgtacgggtgtacgtttccggtggacgggtccgtattcaccactctaccaagacgaacaacttaccgaacgaacacagtgtactacgttacaaagtgaacgacgccgtagacgacctcgaacggacgaccggtccgttgttagttttggtcgcgtacgtacttacgttcttacgtttaacctaaaagttcgttactacgttaccgtaaccgttccggtaaccgggg

SEQ ID NO: 318585 - DNA, 543 bp, Homo sapiens
  misc_feature: GZ8MTXP02I1ZLY.41.27.C05.1.454.CMB.2.raw
  modified_base (189)..(189): a, c, t, g, unknown or other
  misc_feature (189)..(189): n is a, c, g, or t
  modified_base (223)..(223): a, c, t, g, unknown or other
  misc_feature (223)..(223): n is a, c, g, or t
  modified_base (281)..(281): a, c, t, g, unknown or other
  misc_feature (281)..(281): n is a, c, g, or t
  modified_base (363)..(363): a, c, t, g, unknown or other
  misc_feature (363)..(363): n is a, c, g, or t
  modified_base (437)..(437): a, c, t, g, unknown or other
  misc_feature (437)..(437): n is a, c, g, or t
  modified_base (444)..(444): a, c, t, g, unknown or other
  misc_feature (444)..(444): n is a, c, g, or t
  modified_base (455)..(455): a, c, t, g, unknown or other
  misc_feature (455)..(455): n is a, c, g, or t
tcagtctatactatcacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcggtaatattcttagtcttaacttgtctctgtatcaacatcatccaggtaaacnccccaaatcatcatctatgagacctaataagacggccctgtagggtttctaatcgcttcacctgcctcaacgtccgacaacnccggcctcctagaccaatctacgtcgggctccaggctggaggacgaggctagtatttatattgttgctcagttntgttcgnctatactattntgttacgtaggaggtacggacgtaggtcctacgtacgtacgacacgacccgaacgaccccaaccctacgtacgtacctacttcctccg

SEQ ID NO: 318586 - DNA, 563 bp, Homo sapiens
  misc_feature: GZ8MTXP02FRUU5.41.27.C05.1.454.CMB.2.raw
  modified_base (382)..(382): a, c, t, g, unknown or other
  misc_feature (382)..(382): n is a, c, g, or t
tcagtctatactatcacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtagggggtccctgagactctcctgtgcagcctctggattcaccttcgataattggaatatgcagtgggtccgccaggctccaggcgaggggctgggagtggggtggcgaggtgtgtcatttccagtggaggaaatcaaagttctacgggtnacgtttccggtgaggggccgattccaccatctccagagacaatccgagaacacagtgtctacttacaaatagaacagcctagacgacctacgacggaccgacggccgttagttacgttttgtgcgagactatctgtttaccaaaagttcggttactacgttcgacgccgtacgggtacccg

SEQ ID NO: 318587 - DNA, 619 bp, Homo sapiens
  misc_feature: GZ8MTXP02JQOTX.41.27.C05.1.454.CMB.2.raw
  modified_base (387)..(387): a, c, t, g, unknown or other
  misc_feature (387)..(387): n is a, c, g, or t
  modified_base (455)..(455): a, c, t, g, unknown or other
  misc_feature (455)..(455): n is a, c, g, or t
tcagtctatactatcacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtaggggggtccctgagactctcctgtgcagcctctggattcaccttcgataattggaatatgcagtgggtcccgccaggctccgaggccgaggggctgggagtggggtggcaggtgtgtctatttccagtggacggaaatcgaaagtctacgggtnagttccggtgaggggcctatccaccatcctccagagacaattaccgaagaacacagtcgtactcttanaaatagaacacgacctagacgacctacgacggaccgacgggtaccgtaggtttaacgttttggtaggtacggtaacggtacttaacgtacctttacgtttaaccctaaaagtttcggttaactacgtttaccggaaccgtcccgggttacggggtaaccccggg

SEQ ID NO: 318588 - DNA, 518 bp, Homo sapiens
  misc_feature: GZ8MTXP01CBTBP.19.15.B04.1.454.CMB.2.raw
  modified_base (259)..(261): a, c, t, g, unknown or other
  misc_feature (259)..(261): n is a, c, g, or t
  modified_base (264)..(264): a, c, t, g, unknown or other
  misc_feature (264)..(264): n is a, c, g, or t
  modified_base (268)..(269): a, c, t, g, unknown or other
  misc_feature (268)..(269): n is a, c, g, or t
  modified_base (277)..(277): a, c, t, g, unknown or other
  misc_feature (277)..(277): n is a, c, g, or t
  modified_base (287)..(287): a, c, t, g, unknown or other
  misc_feature (287)..(287): n is a, c, g, or t
  modified_base (290)..(290): a, c, t, g, unknown or other
  misc_feature (290)..(290): n is a, c, g, or t
  modified_base (300)..(300): a, c, t, g, unknown or other
  misc_feature (300)..(300): n is a, c, g, or t
  modified_base (302)..(302): a, c, t, g, unknown or other
  misc_feature (302)..(302): n is a, c, g, or t
  modified_base (305)..(305): a, c, t, g, unknown or other
  misc_feature (305)..(305): n is a, c, g, or t
  modified_base (338)..(338): a, c, t, g, unknown or other
  misc_feature (338)..(338): n is a, c, g, or t
  modified_base (340)..(341): a, c, t, g, unknown or other
  misc_feature (340)..(341): n is a, c, g, or t
  modified_base (376)..(376): a, c, t, g, unknown or other
  misc_feature (376)..(376): n is a, c, g, or t
tcagtactctcgtgcacgaccggtgctcgatttagacagtatatatccgcgggagctctgagagcggagccccagccccagaattcccaggtgttttcatttggtgatcagcactgaacacagaggactcaccatggagtttgggctgagcgtggtttcgtgtagtatttacaagtgtcagtgtgaggtgcagctggtggagtctgggggagacttggtccagcctggagggtccctgagactctcctgtgcagctctnnntcnctcnnacacacangcgtgcgcgngcncgaggagggngnggnggtggtcggcgtatacgaagaagacacagtaanannagagacgcgcgtcgtgtagaagagtacacatctanaagagatagatacaaagaactactacgtagtatactagacaataagaacgaacgacgtaacgaaacgaacgaacgaacggacgttagtagttagttagtaggttagaagaaagaagtaggtaagtggtggttaggtgttgtg

SEQ ID NO: 318589 - DNA, 549 bp, Homo sapiens
  misc_feature: GZ8MTXP01A7QO9.19.15.B04.1.454.CMB.2.raw
  modified_base (218)..(218): a, c, t, g, unknown or other
  misc_feature (218)..(218): n is a, c, g, or t
  modified_base (303)..(303): a, c, t, g, unknown or other
  misc_feature (303)..(303): n is a, c, g, or t
  modified_base (376)..(376): a, c, t, g, unknown or other
  misc_feature (376)..(376): n is a, c, g, or t
  modified_base (453)..(453): a, c, t, g, unknown or other
  misc_feature (453)..(453): n is a, c, g, or t
  modified_base (471)..(471): a, c, t, g, unknown or other
  misc_feature (471)..(471): n is a, c, g, or t
  modified_base (518)..(518): a, c, t, g, unknown or other
  misc_feature (518)..(518): n is a, c, g, or t
  modified_base (532)..(532): a, c, t, g, unknown or other
  misc_feature (532)..(532): n is a, c, g, or t
tcagtactctcgtgcacgaccggtgctcgatttagacagtatatatccgcggggagctctgagagcggagccccagccacagaattcccaggtgttttcatttggtgatcagcactgaacacagaggactcaccatggagtttgggctgagctgggttttccttgttgttatttacaaggtgtccagtgtgaggtgcagctggtggagtctggggganacttggtccagcctggagggtccctgagactctcctgtgcagcctctgcattcaccttcagtcgaccacaacatggactgggccncaggctcgagggagggctggagtgggcgccgtatacgaaggaagctaacaagttacaagtacagaatacggcncgtctgtagaaaggaggtcaccatctacaagagatgattacaaagtaactcgaactgtaatctagacaaatgaaacngtaccctaggaaaaccgnggaacaacggccgtagttagttatggttaggttaagaactaaaaggnggtaaggagttggngggtaaggttaagtcgg

SEQ ID NO: 318590 - DNA, 541 bp, Homo sapiens
  misc_feature: GZ8MTXP01CZEXI.19.15.B04.1.454.CMB.2.raw
  modified_base (304)..(304): a, c, t, g, unknown or other
  misc_feature (304)..(304): n is a, c, g, or t
  modified_base (351)..(351): a, c, t, g, unknown or other
  misc_feature (351)..(351): n is a, c, g, or t
  modified_base (383)..(383): a, c, t, g, unknown or other
  misc_feature (383)..(383): n is a, c, g, or t
  modified_base (477)..(477): a, c, t, g, unknown or other
  misc_feature (477)..(477): n is a, c, g, or t
  modified_base (513)..(513): a, c, t, g, unknown or other
  misc_feature (513)..(513): n is a, c, g, or t
  modified_base (537)..(537): a, c, t, g, unknown or other
  misc_feature (537)..(537): n is a, c, g, or t
tcagtactctcgtgcacgaccggtgctcgatttagacagtatatatccgcggggagctctgagagcggagccccagccccagaattcccaggtgtttcattggtgatcagcactgaacacagaggactcaccatggagtttgggctgagctgggttttccttgttgttattttacaaggtgtccagtgtgaggtgcagctggtggagtcgtgggggagacttggtccagcctggagggtccctgagactctcctgtgcagcctctgcattcaccttcagtgaccacaacatggactgggtcccncaggctccgaggggagggctgggagtgggtcgcgtataccaaggaanctaaacagttaacagtaacagaaatacgggcncgtctagaggaaaggaggttcaaccgatactacaaaggagatgaattacaaaagacttcactgtatctgacaaatgaaacagcctagaaaccgngacaacggcttgtattagtgtggttaagacaaaagngtaggaagtgtggttaggtaacgngtgg

SEQ ID NO: 318591 - DNA, 609 bp, Homo sapiens
  misc_feature: GZ8MTXP01BKE8O.19.15.B04.1.454.CMB.2.raw
  modified_base (452)..(452): a, c, t, g, unknown or other
  misc_feature (452)..(452): n is a, c, g, or t
  modified_base (502)..(502): a, c, t, g, unknown or other
  misc_feature (502)..(502): n is a, c, g, or t
  modified_base (527)..(527): a, c, t, g, unknown or other
  misc_feature (527)..(527): n is a, c, g, or t
  modified_base (601)..(601): a, c, t, g, unknown or other
  misc_feature (601)..(601): n is a, c, g, or t
tcagtactctcgtgcacgaccggtgctcgatttagacagtatatatccgcggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagccgtggagggtccctgagactctcctgtgcagcctctgcattcaccttcagtcgaccacaacagtggacgtcgggtccgccgaggctccgagggggaacgggcgtgggaggtggggtcggaccgtagttaaccgaaagggaaacgctaaacaggttaaacagtaacaagaaagtacggcgcgtcgtaggtagaaagggtacgttcaacctatctacaaagngtaatagaacttacgaaaagactacgaacttagtaatcctagaactaaangaaacaacgtcctaaagaaaaccgnggacccgaacggccgttagtaatttagtgtaaggttaacgagaaaagtggtaggaagttggtggttacggtaancggttaag

SEQ ID NO: 318592 - DNA, 621 bp, Homo sapiens
  misc_feature: GZ8MTXP01B9P7T.19.15.B04.1.454.CMB.2.raw
  modified_base (367)..(367): a, c, t, g, unknown or other
  misc_feature (367)..(367): n is a, c, g, or t
  modified_base (396)..(396): a, c, t, g, unknown or other
  misc_feature (396)..(396): n is a, c, g, or t
  modified_base (514)..(514): a, c, t, g, unknown or other
  misc_feature (514)..(514): n is a, c, g, or t
tcagtactctcgtgcacgaccggtgctcgatttagacagtatatatccgcggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcagctggtggagtcgtgggggagacttggtccagccgtggagggtccctgagactctcctgtgcagcctctgcattcaccttcagtcgaccacaacagtcggactcgggtcccgcaggctccgagggggagggctgggaggtcgggtcggccgtattaaccgaaggaanctaacagttaacagtcagaaatacgggcncgtctgtagaaaggtagttcaacatcctagaaagagtatagaattacaaaagtacctacgactttgtaatcctagaaactaaaagtcgaaactacgacccgtaaaggaaaaccccggngggaaacccaaccggggtcgtttagttaaactttagtttaggggtagttaaaggaaacttaaaaagggtggtaggtgttagggtcggggttaggtaacgcgttaagg

SEQ ID NO: 318593 - DNA, 651 bp, Homo sapiens
  misc_feature: GZ8MTXP01ARKPH.19.15.B04.1.454.CMB.2.raw
  modified_base (269)..(269): a, c, t, g, unknown or other
  misc_feature (269)..(269): n is a, c, g, or t
tcagtactctcgtgcacgaccggtgctcgatttagacagtatatatccgcgggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcagctggtggagtcgtgggggagacttggtccagccgtgggacgggtccctgagactctcctgtgcagcctntgcattccaccttgagtcgacccacaacatcggactcgggtccgcccgaggcctaccggagggggaaggggctaggggaggttcggggtccggtaccgttaattaacccgaaagggaaagcctaaacgacgtttaaaacagttaacaagaaagtaccgggcgtcggtctaggtaggaaaacgggtaagttccaacctatccgaagtaaagagaattagaaacttacaaaagtacctacgacgttagtaactcgtaagaccaaaagtcgaaaacgaccgaccgtaaacgaaaacccggtggaaccgtaacggcgttagttaattagttgtaaaggttagaaacgaaaaggtggtgtaagtgggtagggttgtaacgttcgtgg

SEQ ID NO: 318594 - DNA, 593 bp, Homo sapiens
  misc_feature: GZ8MTXP01E1BYU.19.15.B04.1.454.CMB.2.raw
  modified_base (264)..(264): a, c, t, g, unknown or other
  misc_feature (264)..(264): n is a, c, g, or t
  modified_base (286)..(286): a, c, t, g, unknown or other
  misc_feature (286)..(286): n is a, c, g, or t
  modified_base (308)..(308): a, c, t, g, unknown or other
  misc_feature (308)..(308): n is a, c, g, or t
  modified_base (462)..(462): a, c, t, g, unknown or other
  misc_feature (462)..(462): n is a, c, g, or t
  modified_base (488)..(488): a, c, t, g, unknown or other
  misc_feature (488)..(488): n is a, c, g, or t
  modified_base (493)..(493): a, c, t, g, unknown or other
  misc_feature (493)..(493): n is a, c, g, or t
  modified_base (499)..(499): a, c, t, g, unknown or other
  misc_feature (499)..(499): n is a, c, g, or t
tcagtactctcgtgcacgaccggtgctcgatttagacagtatatatccgcggggagctctgagagcggagccccagccccagaattcccaggtgttttcatttggtgatcagcactgaacacagaggactcaccatggagtttgggctgagctgggttttccttgttgttattttacaggtgtccagtgtgaggtgcagctggtggagtcgtgggggagacttggtccagcctggaggtccctgagactctcctgtgcagcctngcattcaccttcagtcgaccanaacagtcggacgtcgggtcccncgaggcctccgagggggaacggggcgtgggaggttcgggtacggaccgttaattaaccccgaaagggaaagtctaaaccaggtttaaaccagtaacgaaggtaactacgggcgacgtctaggtacgaaaggtagttcaactagtctacgaaagngatagattacaaagactcagtgttancgtanacaaanagaacgacgacgtaacgaaacgaacgacgaacgtacgttagtagttagttagtagttagaagaaagaagtagtaagtggtaggttggtgttgtg

SEQ ID NO: 318595 - DNA, 855 bp, Homo sapiens
  misc_feature: GZ8MTXP01BSB5R.19.15.B04.1.454.CMB.2.raw
  modified_base (222)..(222): a, c, t, g, unknown or other
  misc_feature (222)..(222): n is a, c, g, or t
  modified_base (309)..(309): a, c, t, g, unknown or other
  misc_feature (309)..(309): n is a, c, g, or t
  modified_base (324)..(324): a, c, t, g, unknown or other
  misc_feature (324)..(324): n is a, c, g, or t
tcagtactctcgtgcacgaccggtgctcgatttagacagtatatatccgcggggagctctgagagcggagccccagccccagaattcccaggtgttttcatttggtgatcagcactgaacacagaggactcaccatggagtttgggctgagcgtgggttttccttgttgttattttacaaggtgtccagtgtgaggtgcagctggtggagtcgtgggggganacgtttgggtcccaggccgtgggacgggtccctggacgaccttctcctgtcgcagcctctgcattcaccttcagtcgaaccacaacntggactcgggtcccncgaggctaccggagggggaacggggcttagggaggttggggtccgaccggttagttaaccgaaaggtaaagtccgtaaacagttaaaaccaagttaaccgaaggtaaacgtaccgggcgtacccgttacgtagggtaaacgggtaaaagggtaacgggtttaccaaaccgtaacgtttaccttaaacgaaaacgggtaaggtaaacgttacggtaaaatttaaaccggaaaaaaacgttaaaccgttaaccccgtaaacgtttagggtttaaaccgttacccttaaagggaaaccctaaaaagttacgggtaaaaccaaaccgggttaacccgtaaaaccgggaaaaaaccccgggtaacggggaaaccccggtaaaccggggttaccccgggtttagggtttaaaacttttaacggtttaaggggttaaacggggttaaacggttaaaacgttaaaaaaaggggtgggttaagggtaaggtttaggggttacccgggggttaacgggtaacggttaacggtttaacgggg

SEQ ID NO: 318596 - DNA, 883 bp, Homo sapiens
  misc_feature: GZ8MTXP01EKCDV.19.15.B04.1.454.CMB.2.raw
  modified_base (221)..(221): a, c, t, g, unknown or other
  misc_feature (221)..(221): n is a, c, g, or t
  modified_base (275)..(275): a, c, t, g, unknown or other
  misc_feature (275)..(275): n is a, c, g, or t
tcagtactctcgtgcacgaccggtgctcgatttagacagtatatatccgcggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagcgtggtggagtcgtggggganacgttggtccagtcctgggacgggtccctggagtactctcctgtcgcaggcctntgcattcaccttcagtcgaccacaacagtggacgtcgggtcccacgacggccgtacccggaagggggaacgggggtcgttagggggacgggttacgggggtaccggggtacccggtttaaagtttaaaccccggaaagggggtaaaacgaccgttaaaaccggtaacgtttaaaaccgaacgggttaacgaaacgggtaaacggtttaaacccggggcccgtaaccgggttaccggttaagggttaaacgggtaaaaaccgggggttaaacggttttaacccgaaacccgggtaactttaaccccgtaacgtaaaaacgggtaacggttaaagttagggtaaacttttaaacccgaaaacggttaaaacctttacctaaaccggtttacggtttaacttaaccggtttaacgaaacgttaaaaccgtaacggtaaaaccctaaaggaccccgttaaacgggaaaaaccccgggacgggtaaacccggaaccgggttacccggtttaagttaaacgttttaagttacgggttaaggttaaacgttaaaccgaaaagggtaacggttagggtaattgggggtagggttagggtaagttaaccgttaaggg

SEQ ID NO: 318597 - DNA, 544 bp, Homo sapiens
  misc_feature: GZ8MTXP02HN3KS.19.15.B04.1.454.CMB.2.raw
  modified_base (353)..(353): a, c, t, g, unknown or other
  misc_feature (353)..(353): n is a, c, g, or t
  modified_base (358)..(358): a, c, t, g, unknown or other
  misc_feature (358)..(358): n is a, c, g, or t
tcagtactctcgtgcacgaccggtgctcgatttagacagtatatatccgcggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctgggggagacttggtccagcctgggagggtccctgagactctcctgtgcagcctctgcattcaccttcagtgaccacaacatggactgggtccgccaggctccgagggaggggctggagtgggtcgcgtataccgaaggaanctaanagttacagtacagaatacggcgcgtctagtagaaagggtagttcaccatctacaaagagatgaattacaaaagactcactgtaatctagacaaatgaaacagacctagaaaaccgaggaacacgggccgtagtattagttgtagtagaacaaaaggtaaggtggaattggtaggtacggtagctag

SEQ ID NO: 318598 - DNA, 615 bp, Homo sapiens
  misc_feature: GZ8MTXP02G2X2D.19.15.B04.1.454.CMB.2.raw
tcagtactctcgtgcacgaccggtgctcgatttagacagtatatatccgcggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctgggacgggtccctgagactctcctgtgcagcctctgcattccaccttcagtcgacccacaacatcggacgtcgggtcccgccgaggctccgaggggaaggggctggaggtggggtcggcgtataccgaaggaagctaacagttacagtacagaatacggcgtcgtactggtaggaaaagggtacggttaccaacccgtatcctacgaaaggagatagtaacttacaaaagtaactctaactagttactctagaacctaaagtacgaacgtaacgacctaacggaaaaccgagggaaccgacgggtaccgttagttaactttaagttggtaggtaacgaataaaaaggtggtaggtaagtggttaggtacggtagcgttagg

SEQ ID NO: 318599 - DNA, 597 bp, Homo sapiens
  misc_feature: GZ8MTXP02G2MFR.19.15.B04.1.454.CMB.2.raw
  modified_base (268)..(268): a, c, t, g, unknown or other
  misc_feature (268)..(268): n is a, c, g, or t
  modified_base (477)..(477): a, c, t, g, unknown or other
  misc_feature (477)..(477): n is a, c, g, or t
  modified_base (553)..(553): a, c, t, g, unknown or other
  misc_feature (553)..(553): n is a, c, g, or t
tcagtactctcgtgcacgaccggtgctcgatttagacagtatatatccgcggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacgttggtccagcctgggagggtccctgagactctcctgtgcagcctntgcattccaccttcagtcgaccacaacatcggacgtgggtcccgccacggctaccgaggggaagggcgtagggaggtcggggtcggccggtattaaccgaaagggaaagactaaacagttaacaagtacaagaaatacgggcgcgtactggagaaaagaggttccaaccgatctacaagagatacgaattacaaaagactacatagtanctagtacaaaatgaaacagacctaagaaaacccgagaaccgaaccggcgtaagtacgttagtacggtacggtaaanaaacgaaaaggaaggtaggagttaggtcggtaggtacgcgtagg

SEQ ID NO: 318600 - DNA, 576 bp, Homo sapiens
  misc_feature: GZ8MTXP02JZ6LS.19.15.B04.1.454.CMB.2.raw
  modified_base (306)..(306): a, c, t, g, unknown or other
  misc_feature (306)..(306): n is a, c, g, or t
  modified_base (546)..(546): a, c, t, g, unknown or other
  misc_feature (546)..(546): n is a, c, g, or t
tcagtactctcgtgcacgaccggtgctcgatttagacagtatatatccgcggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctgggagggtccctgagactctcctgtgcagcctctgcattcaccttcagtgaccacaacatggactgggtccnccaggctccgaggggagggctggagtgggtcgccgtataccgaaggaagctaaacagttacagtacagaaagtacggcgcgtcgtagtaggaaaagggtaggttaccaaccgtatctacaagagatagaattacgaaaagactcaactgtatcgtagacaaagtgaaacacgacctaaggaaaaccgaggaacgtaccggtacgtagtaattagttcggtaggtaacgaaagtaaaaggnggtaggaagtcggtgggtacgtagcgtagg

SEQ ID NO: 318601 - DNA, 581 bp, Homo sapiens
  misc_feature: GZ8MTXP02G2OF7.19.15.B04.1.454.CMB.2.raw
  modified_base (311)..(311): a, c, t, g, unknown or other
  misc_feature (311)..(311): n is a, c, g, or t
  modified_base (502)..(502): a, c, t, g, unknown or other
  misc_feature (502)..(502): n is a, c, g, or t
  modified_base (553)..(553): a, c, t, g, unknown or other
  misc_feature (553)..(553): n is a, c, g, or t
tcagtactctcgtgcacgaccggtgctcgatttagacagtatatatccgcggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagccgtggagggtccctgagactctcctgtgcagcctctgcattccacctttcagtcgaccacaacagtggactgggtcccnccgaggcctccgaggggaaggggctgggaggtggggtcggcgtataccgaaggaagctaaacagttacagtacagaagtacggcgcgtctgtagaaaagggtagttaccacctagtacctacaaaggagatagaattacaaaagacttcgactgtatctagacaaagtgaaacagacctaagaaaaccggngaaccgacgggtccgttagttacttagtggtaggtaacaaacgtaaaaggngtaggagttggtaggtacgtagcgtacg

SEQ ID NO: 318602 - DNA, 600 bp, Homo sapiens
  misc_feature: GZ8MTXP02JKM4C.19.15.B04.1.454.CMB.2.raw
  modified_base (220)..(220): a, c, t, g, unknown or other
  misc_feature (220)..(220): n is a, c, g, or t
  modified_base (283)..(283): a, c, t, g, unknown or other
  misc_feature (283)..(283): n is a, c, g, or t
  modified_base (294)..(294): a, c, t, g, unknown or other
  misc_feature (294)..(294): n is a, c, g, or t
  modified_base (410)..(410): a, c, t, g, unknown or other
  misc_feature (410)..(410): n is a, c, g, or t
  modified_base (530)..(530): a, c, t, g, unknown or other
  misc_feature (530)..(530): n is a, c, g, or t
tcagtactctcgtgcacgaccggtgctcgatttagacagtatatatccgcggggagctctgagagcggagccccagccccagaattcccaggtgttttcatttggtgatcagcactgaacacagaggactcaccatggagtttgggctgagcgtgggttttcctgttgttattttacaaggtgtccagtgtgaggtgcagctggtggagtcgtggggganacgttgggtccagcctgggagggtccctgagactctcctgtgcagcctctgcattccaccttnagtcgacccanaacagtggacgtcgggtccgcgacggctccgaggggacggggctgggaggtcggggtcgaccgtaagtaccgaaaggaacgactaaacgtagttacagtacaagaagtacggacgngtacgtgtaggaaaacgggtcgttaccaccgtatcctaagaaagagatagaattaacgaaaagtaacctcaaagttcgtaatcctagaactaaagtcgaacagacctaacggaaaacggngacgacggcgttagtattagtggtagaacgaacgaaaaggtgtggtaactgggtacggtaggtagctagg

SEQ ID NO: 318603 - DNA, 634 bp, Homo sapiens
  misc_feature: GZ8MTXP02FU3HQ.19.15.B04.1.454.CMB.2.raw
  modified_base (553)..(553): a, c, t, g, unknown or other
  misc_feature (553)..(553): n is a, c, g, or t
tcagtactctcgtgcacgaccggtgctcgatttagacagtatatatccgcggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctggagggtccctgagactctcctgtgcagcctctgcattcaccttcagtcgaaccacaacatggacgtcggggtcccgccgaggcctccggaaggggaacggggctggggacggtcggggtccggaccggttaattaacccgaaaggggtaaacgactaaacgtaggtttaacaggttacgaagaaacgtacgggccgacgttcgtaggtaggaaaagggtaggttaccaccgaatctacgaaagagatagagttaacaaagtaaactacactagttataccgtagaacaaaatacgaaacacgacctaaggaaaaccgngaacgaccggacgtagttaacttaagttgtacggtaagaacgaaaaggaagtaggagttaggtaggtacgggtagcgtagg

SEQ ID NO: 318604 - DNA, 678 bp, Homo sapiens
  misc_feature: GZ8MTXP02H32P4.19.15.B04.1.454.CMB.2.raw
  modified_base (637)..(637): a, c, t, g, unknown or other
  misc_feature (637)..(637): n is a, c, g, or t
tcagtactctcgtgcacgaccggtgctcgatttagacagtatatatccgcggggagctctgagagcggagccccagccccagaattcccaggtgttttcatttggtgatcagcactgaacacagaggactcaccatggagtttggctgagctgggttttccttgttgttattttacaaggtgtccagtgtgaggtgcagctggtggagtcgtgggggagacgttggtccagccgtggacggtccctgacgactctcctgtcgcagcctctgctattccaccttcagtcgaccacaacagtacggaccgtgggtcccgaccgaggcctaccggaggggaaggggcgtggggaggttcggggtccgggaccgttaagttaaccgaaacgggaaaagtaccgtaaacgtagtttaaccgagttacgaagtaaacgtaccgggcgtacgtacgtaggtaaggaaaagggtaagttccaacctaatacccgtagaaaagtacgatagaaacttacgaaaagtaacctctaaacttgttactacgagaactaaaagtcgaaacacgtactaaacggaaaacggaggaacccgtacgggtaccgttaagtttaatagtttaggtaaggtaaacaaagaaaaggnggttagggatttacggggtagggtagttacggacgtttagg

SEQ ID NO: 318605 - DNA, 662 bp, Homo sapiens
  misc_feature: GZ8MTXP02JXGGF.19.15.B04.1.454.CMB.2.raw
  modified_base (221)..(221): a, c, t, g, unknown or other
  misc_feature (221)..(221): n is a, c, g, or t
  modified_base (294)..(294): a, c, t, g, unknown or other
  misc_feature (294)..(294): n is a, c, g, or t
  modified_base (298)..(298): a, c, t, g, unknown or other
  misc_feature (298)..(298): n is a, c, g, or t
  modified_base (313)..(313): a, c, t, g, unknown or other
  misc_feature (313)..(313): n is a, c, g, or t
  modified_base (532)..(532): a, c, t, g, unknown or other
  misc_feature (532)..(532): n is a, c, g, or t
  modified_base (574)..(574): a, c, t, g, unknown or other
  misc_feature (574)..(574): n is a, c, g, or t
tcagtactctcgtgcacgaccggtgctcgatttagacagtatatatccgcggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcagctggtggagtcgtggggganacgttggtccagcctgggacgggtccctgacgactctcctgtgcagcctctgctattccacttcagtcaccanaacngtggactgggtcccncgaggcctaccggaggggacgggcgtgggaggtcggggtcggaccgttaagtaacccgaaggaaagctaaacgagttaaccagtacaagtaaacgtacggcgacgtcgtagggtaaggaaaacgggtacgtttccaaacccgtagttacccaacgaaaaggtacgaacttaggtaaacttaacgaaaacgtaccttcaaacgttgtaattccgagaaanaaaagttcgaaaacgaccgtaccgtaaaacgaaaacccgggngaaaccgtaccggtacgttagttacgtttaggtacggaaggtaaacaaagtaaaggtggtaggtagttggtacggtggtacgtcgtag

SEQ ID NO: 318606 - DNA, 518 bp, Homo sapiens
  misc_feature: GZ8MTXP01C6KP0.15.20.B09.1.454.CMB.2.raw
  modified_base (452)..(452): a, c, t, g, unknown or other
  misc_feature (452)..(452): n is a, c, g, or t
tcagtctacgtagccacgaccggtgctcgatttagtgtagtgtgaaggggacccaaaaaccacaccctccttgggagaataccctagatcacagctcctcaccatggacgggacctggagcatccttttcttggtggcagcagcaacaggtgcccactcccaggttcacctggtgcagtctggagctgagctgcagaagcctggggcctcagtgatggtctctgcagtgcttctggttacatctttccacctacggtatgaattggttgagacaggcccccggagaggggcttgagtggatgggatggatcagcccttaggactaaaacagagtatgcagagaacgttccagggcagagtcatcatcacgcggacacatccacgagtacagcctacatgggaactgaggagcctcagatcgtagacgacacggccacttatactgcgcgagngattaattggcacgttgtccgtgcgttgttaaccaagcttgtggggcttacgtggggcctaacggg

SEQ ID NO: 318607 - DNA, 629 bp, Homo sapiens
  misc_feature: GZ8MTXP01AHS5T.15.20.B09.1.454.CMB.2.raw
  modified_base (270)..(270): a, c, t, g, unknown or other
  misc_feature (270)..(270): n is a, c, g, or t
  modified_base (298)..(298): a, c, t, g, unknown or other
  misc_feature (298)..(298): n is a, c, g, or t
tcagtctacgtagccacgaccggtgctcgatttagtgtagtgtgaaggggacccaaaaccacaccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcttttccacctacggtatgaattggtnagacacggccccggacgagggcgtgagnggagtggagtgagtcagacccgttaccggaactaaaacaagagtatagcgagagaacgttacgagggacgagaggtacactctatacgaccgacgggacacactaccaccgagtaaccagcctaacagtaggaactagagggagcctccgagaacgtcgtacggaacggaccaaccgggcctaactttacttaacgtcggcggtaccgaaggtaggtaatttaagtttcggacgtaaccttggggttcccgtcggttacggttacgttaaccccgtaacggtcgtttcggttcgggggccgttaccggtgggggccccgtaaacccggggg

SEQ ID NO: 318608 - DNA, 565 bp, Homo sapiens
  misc_feature: GZ8MTXP01BZJJM.15.20.B09.1.454.CMB.2.raw
tcagtctacgtagccacgaccggtgctcgatttagtgtagtgtgaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattctttccaccttacggtatgaattggttgagacaggcccccggagaggggcttggagtggatgggatggatcgacgcccttaacggaactaaaacagagtatgcagagaacgttccgagggcagagtacatcatcaccgcggacacatccacgagtacagctacataggactgagacgctcagactcgtgacgacacggcctagttactactgcgtcgagtagtattaattcgactacgttgggttaccctgggacccttggttaacccgtaacgtcgttgggtcgggcgttacggttcgggggaaccgttaacccggggg

SEQ ID NO: 318609 - DNA, 585 bp, Homo sapiens
  misc_feature: GZ8MTXP01DZ19S.15.20.B09.1.454.CMB.2.raw
  modified_base (401)..(401): a, c, t, g, unknown or other
  misc_feature (401)..(401): n is a, c, g, or t
  modified_base (422)..(422): a, c, t, g, unknown or other
  misc_feature (422)..(422): n is a, c, g, or t
tcagtctacgtagccacgaccggtgctcgatttagtgtagtgtgaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattctttccacctacggtatgaattggttgagacaggcccccggagaggggctgagtggatgggatggatcagacccttacggaactaaacagagtatgcagagaagtccagggcagagtacatcatcaccgcggacacataccagagtacagacctanataggaactgacggagacctnaagactcggtacgacgacgaccgggtacctaacgtttacttacgtcggcgacggtaagtaggtatttaattgctaacgtttcgggtccgtggttcgttcggttaacccgtaacggtcgttgggttcgggccgaacggttcgggggaacccgttaacccggggg

SEQ ID NO: 318610 - DNA, 603 bp, Homo sapiens
  misc_feature: GZ8MTXP01AYO0T.15.20.B09.1.454.CMB.2.raw
  modified_base (235)..(235): a, c, t, g, unknown or other
  misc_feature (235)..(235): n is a, c, g, or t
tcagtctacgtagccacgaccggtgctcgatttagtgtagtgtgaaggggacccaaaaaccacaccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcagtgatggtctcctgcagtgcttntggttacattctttccacttacggtatgaattggtgagacacggccccggagagggcttggagtggagtgggatggatcagtccctaacggaactaaacgagagtatgacgagagtaacgttccgagggacagtacgtaacgatcatccgaccggacggacacactacccaacgagtaacacgacctacagtacggaactaggagacgcctagagtacgtcggtacgaaccgaacgaccggacccttaacgttactacgtcggtacgacggtaagagtaattaacgttcgctacgttcggtccgtggccgttacgttaacccgtcgtcgttcgggcggccttaggggtccgggcccggttaacccggg

SEQ ID NO: 318611 - DNA, 617 bp, Homo sapiens
  misc_feature: GZ8MTXP01DNBRB.15.20.B09.1.454.CMB.2.raw
tcagtctacgtagccacgaccggtgctcgatttagtgtagtgtgaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctctgcagtgcttctggttactattcttttccaccttacggtatgaattggtgagacaggcccccggaggaggggcttgaggtggagtgggatggatcgagcccttaacggaactaaaacagagtatgacagagaacgttccgagggcagagacagtcatcgaaccgcgacacatcccaagagtacagacctacaagtacggaactaggaaggacgactacagacgtcgtacgaccgtacgaccgggcctaaacctttagttacgtacgcggtacgaaggagtaatttaagttcgacgtacgttcgggttcccgtagggttccttacggttaaacccgtaaccggttcgtttcgggtcggggccgttaacggttcgggggaacccgttaaccggggg

SEQ ID NO: 318612 - DNA, 584 bp, Homo sapiens
  misc_feature: GZ8MTXP01CUFN0.15.20.B09.1.454.CMB.2.raw
  modified_base (235)..(235): a, c, t, g, unknown or other
  misc_feature (235)..(235): n is a, c, g, or t
  modified_base (479)..(479): a, c, t, g, unknown or other
  misc_feature (479)..(479): n is a, c, g, or t
tcagtctacgtagccacgaccggtgctcgatttagtgtagtgtgaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttntggttacatcttttccacctacgtatgaattggttgagacgaggcccccggagaggggcttggagtggagtgggatggatcgagcccttaacggaactaaaacgagagtatgacagagaacgttccgagggcagagtaacatcataccaccgcggacacatccacgagtacagctacaagtgactgacggagctcagatcgtacggacgaccgaccggacacttatttacgcgtcgcgaagtanattaagttcgcgtacttcgggttacctggttaccgttcgttaacccgaacggtccgtttgggtcggggaccttccgggtaacgggggttcccgtaaacccggggg

SEQ ID NO: 318613 - DNA, 537 bp, Homo sapiens
  misc_feature: GZ8MTXP01E3CLI.15.20.B09.1.454.CMB.2.raw
  modified_base (506)..(506): a, c, t, g, unknown or other
  misc_feature (506)..(506): n is a, c, g, or t
tcagtctacgtagccacgaccggtgctcgatttagtgtagtgtgaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctctgcagtgcttctggttacattctttccaccttacggtatgaattggttgagacaggcccccggagaggggcttgagtggatgggatggatcagcccttacggaactaaaacagagtatgcagagaacgttccgagggcagagtacatcatcaccgcggacacatccagagtacagctaacataggaactgaggagcctcagactcgtagacgacaccggccaacttacttacgtgcgtcgagagtagttaattgcgacttggtacctgggcttacgttaaccngtcttggtgggcacgtcgggttcgaaccggg

SEQ ID NO: 318614 - DNA, 563 bp, Homo sapiens
  misc_feature: GZ8MTXP01BUE9A.15.20.B09.1.454.CMB.2.raw
  modified_base (386)..(386): a, c, t, g, unknown or other
  misc_feature (386)..(386): n is a, c, g, or t
  modified_base (424)..(424): a, c, t, g, unknown or other
  misc_feature (424)..(424): n is a, c, g, or t
  modified_base (446)..(446): a, c, t, g, unknown or other
  misc_feature (446)..(446): n is a, c, g, or t
  modified_base (540)..(540): a, c, t, g, unknown or other
  misc_feature (540)..(540): n is a, c, g, or t
tcagtctacgtagccacgaccggtgctcgatttagtgtagtgtgaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattctttccaccttacggtatgtaattggttgagacgacggcccccggaggaggggcttgaggtggatggggatggatcgacgtacccgttaacggaaactaaaacgagagtatgacagagaacgttccagtgacagaacgtcntcatccgaccgcggacacactccacgagtacagcctanagtcggaactgaggacacctanagactcgtgaacgacgacggcctacgttaattacctgccgacgaagcgtaattattgcttacgtcggtcttggcttacgtaaccagtcgttggnggctaacggttcgggtaacccgg

SEQ ID NO: 318615 - DNA, 611 bp, Homo sapiens
  misc_feature: GZ8MTXP01BEYLK.15.20.B09.1.454.CMB.2.raw
  modified_base (427)..(427): a, c, t, g, unknown or other
  misc_feature (427)..(427): n is a, c, g, or t
tcagtctacgtagccacgaccggtgctcgatttagtgtagtgtgaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattctttccactacggtatgaattggtgagacaggccccggagagggcttgaggtggatgggatggatcgacgacccttacggaaactaaacgagtagtatgacagagaacgttccgaggcagagtacatcatcgaccgcgacacactaccacgagtacacgcctacagtacggaactgacggancctgagtactcggacgtaacggaccaccggacctaacgtttacgttacgtcggacgtacgagtaagtacgtttaagttcgacgtaccgttacggtcccgtgggttccgttacggttaacccgtaacggtccggtttgggtccgggggaccttaccgggttcgggggaacccgttaacccggggg

SEQ ID NO: 318616 - DNA, 595 bp, Homo sapiens
  misc_feature: GZ8MTXP01AUUJP.15.20.B09.1.454.CMB.2.raw
  modified_base (208)..(208): a, c, t, g, unknown or other
  misc_feature (208)..(208): n is a, c, g, or t
  modified_base (232)..(232): a, c, t, g, unknown or other
  misc_feature (232)..(232): n is a, c, g, or t
  modified_base (266)..(266): a, c, t, g, unknown or other
  misc_feature (266)..(266): n is a, c, g, or t
  modified_base (329)..(329): a, c, t, g, unknown or other
  misc_feature (329)..(329): n is a, c, g, or t
  modified_base (431)..(431): a, c, t, g, unknown or other
  misc_feature (431)..(431): n is a, c, g, or t
  modified_base (451)..(451): a, c, t, g, unknown or other
  misc_feature (451)..(451): n is a, c, g, or t
tcagtctacgtagccacgaccggtgctcgatttagtgtagtgtgaaggggacccaaaaccacaccctccttgggagaatccctagatcacagctcctcaccatggacgggacctggagcatccttttcttggtggcagcagcaacaggtgcccactcccaggttcacctggtgcagtctggagctgagctgcagaagcctggggcctnagtgatggtctcctgcagtgcttntggttacattctttcactacgtatgtaattggtnagacacggccccggagagggcttgagtggagtgggatggatcagcccttaaggaactaaacgngagtatgacagacgaacgttccagggcaagagtcatcatccgaccggcgacacgactaccacgagtacacggcctaacgatacggaaacgtggaacgggacnccctaagaggtacttacggnggaaccgaccgaccgggacctacgttaactacctggcgtacgagagtaagttaatggactacgttcgggtaccttgggacttcgttaaacccgtaacgtccgttcgggtcgggcgttacgggcggggttaaccgtaacccgggg

SEQ ID NO: 318617 - DNA, 550 bp, Homo sapiens
  misc_feature: GZ8MTXP01EONFT.15.20.B09.1.454.CMB.2.raw
  modified_base (437)..(437): a, c, t, g, unknown or other
  misc_feature (437)..(437): n is a, c, g, or t
  modified_base (481)..(481): a, c, t, g, unknown or other
  misc_feature (481)..(481): n is a, c, g, or t
tcagtctacgtagccacgaccggtgctcgatttagtgtagtgtgaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattctttccaccttaggtatgtaattggttgagacgaggcccccggagaaggggcttggagtggagtgggagtggatcgagacccgttaggaactaaaacagagtatgcagagtaacgttcaggctagagtcatcatcaccgcggacacgactccacgagtacacgctacgatggaactgagagctacagatcgngacgacacggctacgttatactgcgcgagagtattaacgtgacncgttgtcccgtggcgttcgttaccgaacgtcttcggtcgggacgttacgtggggaacccgtaaccgggg

SEQ ID NO: 318618 - DNA, 606 bp, Homo sapiens
  misc_feature: GZ8MTXP01AQ7C2.15.20.B09.1.454.CMB.2.raw
tcagtctacgtagccacgaccggtgctcgatttagtgtagtgtgaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgtcttctggttacattcttttccaccttacggtatgtaattggttgagacgacgggccccccggtaggaggggtcttggaggtggagtgggatggatcgacgcccgttaacggaactaaaacgagagtatagcagaggaacgtcgaggcagatacgatcagtccaccgacgacacactccaacgagtacagacctaacagtaggaacgtggaacggacgcctacagtactcggtacgaccgacgaccggtacctactttactacgtacgacggcgtaggtatgttaattcgacgtacgttggtcctggaccttcggttaacccgcggttcgtcgggttcgggaccgttacggtaacgggggcccgttaacccgggg

SEQ ID NO: 318619 - DNA, 665 bp, Homo sapiens
  misc_feature: GZ8MTXP01AHD0G.15.20.B09.1.454.CMB.2.raw
tcagtctacgtagccacgaccggtgctcgatttagtgtagtgtgaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtgggcctgagtgatggtctcctgctagtgtcttctggttactattcctttccacgttacggtatgtaattggttgacgacgacgggccccggaggagggtcttggagtggagtgggagtggatcgacgtacccgttaacggaaacttaaacgagtacgtagtgacgtagagtacgtccgaggcagagtacagcacgtaccgacgacggacacactaccgaacgtagtaaccacggtacctaacgagtacggaacgtacgggagtaaccggcttaacgagtacgtaccggtaggaaccgaccgtacccggaccttaacgtttacgttacggtacgaccggtaaggtaagtaaccgttaattaacgtcgcttaaccggttggtccgtgggttccttacggttaaccgtcggttccgttaagggtcggaccgttaacgggttccggggaacccgttaacccgggg

SEQ ID NO: 318620 - DNA, 762 bp, Homo sapiens
  misc_feature: GZ8MTXP01A5D9Q.15.20.B09.1.454.CMB.2.raw
  modified_base (225)..(225): a, c, t, g, unknown or other
  misc_feature (225)..(225): n is a, c, g, or t
tcagtctacgtagccacgaccggtgctcgatttagtgtagtgtgaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctccnggcagtgcttctggttactattctttccacgttacggtatgtaagttggtagagacgacgggcccccggaggagggcgtgagtggagtgggatggatcgacggtacccgttaacggaaacctaaaacgaggtaacgtagtcgacgaaggaacgtaaccggttaccggaagggacgtaacggacggttaacaactccgtaaacgtcccggaaaccccgggaccggggtaaacccaaccgtacgttaaccccgaaaccggtaacgtaaccgaaccgggtacctaaacgtaacggtaacgggaaacgttacgggaacgggtaccggaccttaacgaagttaccgtacgggttaacggacgaaaccgacccgggtacctaaacgttacgtttaacgcggtacggtaaccgaggttaacgtaagtttaacgtggttaccgtacgttcggttacccggttcggaccgtttaccggaacccgtaacggttcggttcggggccgggaccggttaccgggcgggggttaacccttaaacccggggg

SEQ ID NO: 318621 - DNA, 798 bp, Homo sapiens
  misc_feature: GZ8MTXP01BO6I0.15.20.B09.1.454.CMB.2.raw
  modified_base (236)..(236): a, c, t, g, unknown or other
  misc_feature (236)..(236): n is a, c, g, or t
tcagtctacgtagccacgaccggtgctcgatttagtgtagtgtgaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcagtgatggtctcctgcagtgcttntggttactattcctttccacttagtatgattggttgagacgacggccccggaggaggggtcttggaggtggagtgggatggatcgacggtacccgttaacggaaactaaacgaggtagtagtagacgaggacgtaaaccggttaccggagggtacgaaggtacggtaacaacgttccgaaacttaccccggaacccgggacccgggaaccaaaccgtaacgtacccgaaacggaaacgttaaccgaaccgtaccccgttaaagaccgttaaacggggaaacccttaggggaaacggggttaacgcccccgttaaggaaacgggtaactttacccgggggtaacggtaaaccgggaaaccgtaccccggggtaaaccctttaaacccggttttaaacctttaccgggttaccgggacccggtacgggtaaacggtaacggtttaaatttaacggttttaccgacgttaaaccggtttcggtacccgttgttaccggttacgttaacccgtcgttccgttgggtaccgggtcggaccggttcgggggcccgttaaacccggggg

SEQ ID NO: 318622 - DNA, 608 bp, Homo sapiens
  misc_feature: GZ8MTXP01CMIQS.15.20.B09.1.454.CMB.2.raw
  modified_base (477)..(477): a, c, t, g, unknown or other
  misc_feature (477)..(477): n is a, c, g, or t
tcagtctacgtagccacgaccggtgctcgatttagtgtagtgtgaaggggacccaaaaaccacacccctccttgggagaatcccctagatcacagctcctcaccatggacgggacctggagcattccttttcttggtggcagcagcaacaggtgcccactccaggttcacctggtgcagtctggagctgagctgcagacgccgtgggcctcgagtgagtggtcctcgtgctagtgtcttgtgttactactttcctttaccgaccgttacggtatagtaagttggtacgacgacgacgggccccggaggtacgggtcgtagaggtggagtggagtgatcgacgtaccgtaagaaactaaacgagagtagtgacgagaagtaccgtcgaggtgagacgtacatcgactaccgacgacgactacacgaccagacgtacacgtactagagtaacggacgtaggacgacgacctagagtacngggtaacgacgaccgacgtactaacgttgtacgcgtacgagaggtatacttgtcgacgtcgttcgtaccgtgttccgttacgacgtcgtagttccgggaggaccgttcgggtccggttaacggtaacccgg

SEQ ID NO: 318623 - DNA, 717 bp, Homo sapiens
  misc_feature: GZ8MTXP01CKXCN.15.20.B09.1.454.CMB.2.raw
  modified_base (213)..(213): a, c, t, g, unknown or other
  misc_feature (213)..(213): n is a, c, g, or t
  modified_base (509)..(509): a, c, t, g, unknown or other
  misc_feature (509)..(509): n is a, c, g, or t
tcagtctacgtagccacgaccggtgctcgatttagtgtagtgtgaaggggacccaaaaaccacacccctccttgggagaatcccctagatcacagctcctcaccatggacgggacctggagcattcctttttcttggtggcagcagcaacaggtgcccactcccaggttcacctggtgcagtctggagctgagctgcagacgccgtgggcctnagtgagttcggtctctgctagtcgtcttcgtgttactacttcctttaccacgttacggtatagtaagttggtagacgacgaccgggcccggaggagggtcttggaggtaggtaggtggtagtcggtataccgtaaccgtacccgttaaacggtaaaactaaaacgaggtagtacgtcgaacgtaggtaacggtaaccggttccggaggacgtagtacgtaacaactcgaacgtaccgaaccggacgaacactacgaccgacgtacgtaccacgtacctaagtaggaacggtaacgnggaaccggttctacccgaagtacgtaccgttacggaaaccgggtaacccgtaaccgaccggttaaccttaacttaacgtacgtaccggacgtacgagtaagttatttaacgtacgacgttccggttcggttacctcgggttaccgttacgacccggttaagtcggtttgggccgggtcacggggttcccgggaaccgtttaacccggg

SEQ ID NO: 318624 - DNA, 665 bp, Homo sapiens
  misc_feature: GZ8MTXP01DJVB4.15.20.B09.1.454.CMB.2.raw
  modified_base (542)..(542): a, c, t, g, unknown or other
  misc_feature (542)..(542): n is a, c, g, or t
tcagtctacgtagccacgaccggtgctcgatttagtgtagtgtgaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggagcctcagtgatggtctcctgcagtgtcttctggttacattccttttccacctacggtatgtaattggttagagacacggccccggaggaggggcttggagtggagtggggatggatcagtaccccgttaaaggaaacttaaaacgagtaagtatagacgaagtaacggaacggttacgagggcaagtaacgtacaagtcaacgtaccgacccggaccggaacaacactacccgaacgaactacgacgtaccttaacacgttaacggaacgtggaaggacgtcctagacggtactacgtacggaaccgaccgaccggtaccttaacttacgttaacngtacgacgaagtacggtaatttacgttcgtacgttacggttcggtccgttcgggttccttacggtaacccgtacgttcggtttacgggcggggttccttaacgggttccgggggtaaccccgg

SEQ ID NO: 318625 - DNA, 633 bp, Homo sapiens
  misc_feature: GZ8MTXP01DKH13.15.20.B09.1.454.CMB.2.raw
  modified_base (209)..(209): a, c, t, g, unknown or other
  misc_feature (209)..(209): n is a, c, g, or t
  modified_base (465)..(465): a, c, t, g, unknown or other
  misc_feature (465)..(465): n is a, c, g, or t
tcagtctacgtagccacgaccggtgctcgatttagtgtagtgtgaaggggacccaaaaaccacaccctccttgggagaatccctagatcacagctcctcaccatggacgggacctggagcatccttttcttggtggcagcagcaacaggtgcccactcccaggttcacctggtgcagtctggagctgagctgcagagccgtggggcctnagtgatggtctctgctagtgtcttctggttactattctttaccacttacggtatgtaagttggtagaggacgacgggccccggaggagggctgaggtggagtgggatggatcgaacgtaccgttaaggaaactaaacgaggagtactgacaggtaagacgttccggaggacagacgtacagtcagtaccgacgggtacacataccgaagactacgagtaccctaagagtacggaacgtaggacggacgccctaganacgttacgacgggacgtaacgaccggtacctaacgtttacctacggtcgtacggaccggtaagtacgttagttcgtaacggcgttacggtacggttcgtcgggtacttacgttcgttacgttgtacgggcggtacgcggttccggggtaaccgttaacgggtaacccg

SEQ ID NO: 318626 - DNA, 621 bp, Homo sapiens
  misc_feature: GZ8MTXP01ALO6W.15.20.B09.1.454.CMB.2.raw
  modified_base (153)..(153): a, c, t, g, unknown or other
  misc_feature (153)..(153): n is a, c, g, or t
  modified_base (189)..(189): a, c, t, g, unknown or other
  misc_feature (189)..(189): n is a, c, g, or t
  modified_base (224)..(224): a, c, t, g, unknown or other
  misc_feature (224)..(224): n is a, c, g, or t
  modified_base (236)..(236): a, c, t, g, unknown or other
  misc_feature (236)..(236): n is a, c, g, or t
  modified_base (306)..(306): a, c, t, g, unknown or other
  misc_feature (306)..(306): n is a, c, g, or t
  modified_base (453)..(453): a, c, t, g, unknown or other
  misc_feature (453)..(453): n is a, c, g, or t
  modified_base (467)..(467): a, c, t, g, unknown or other
  misc_feature (467)..(467): n is a, c, g, or t
  modified_base (492)..(492): a, c, t, g, unknown or other
  misc_feature (492)..(492): n is a, c, g, or t
  modified_base (531)..(531): a, c, t, g, unknown or other
  misc_feature (531)..(531): n is a, c, g, or t
  modified_base (538)..(538): a, c, t, g, unknown or other
  misc_feature (538)..(538): n is a, c, g, or t
  modified_base (584)..(584): a, c, t, g, unknown or other
  misc_feature (584)..(584): n is a, c, g, or t
tcagtctacgtagccacgaccggtgctcgatttagtgtagtgtgaaggggacccaaaaaccacacccctccttgggagaatcccctagatcacagctcctcaccatggacgggacctggagcatccttttcttggtggcagcagcaacaggtncccatcccaggttcacctggtgcagtctggagctgngctgcagacgccgtggggcctcagtgatggtctcngcagttgctttntggtactattcctttaccacttacggtatgtaattggtgagacgaggccccgaggaggtcttggagtggntagggtatggatcgacgtacctacggaaactaaacgagtaggtatacggacaaggtaacgtaaacgttccggaagggaccgaaaggtacgtaacaacgttcgacgtaacccgaacgtccgggaacacgttacacccgtagacggtanaccggtattaaccngttaacggacgagaccgagccctanaagactggacgacggtaccacgactacgtacttacgcgnacggganagttagtaatacgcgtagttccgtcgtcgttacgttcttaacccgngtgtcggtcggcttacgggccgggaacgtaaccgggg

SEQ ID NO: 318627 - DNA, 517 bp, Homo sapiens
  misc_feature: GZ8MTXP02JBH5Z.15.20.B09.1.454.CMB.2.raw
  modified_base (416)..(416): a, c, t, g, unknown or other
  misc_feature (416)..(416): n is a, c, g, or t
  modified_base (483)..(483): a, c, t, g, unknown or other
  misc_feature (483)..(483): n is a, c, g, or t
tcagtctacgtagccacgaccggtgctcgatttagtgtagtgtgaaggggacccaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatctttccacctacggtatgaattggttgagacaggcccccggagaggggcttgagtggatgggatggatcagcccttaggaactaaaacagagtatgcagagaagttccagggcagagtcatcatcaccgcgacacatccacgagtacagcctacatggaactgaggagcctanagatctgacgacacggcacttatactgcgcgagagtattattgcacgtcggtcctggctgtaaaccncgtcgttgtcgggcacgtcggggacctaacgggg

SEQ ID NO: 318628 - DNA, 564 bp, Homo sapiens
  misc_feature: GZ8MTXP02HKT9U.15.20.B09.1.454.CMB.2.raw
  modified_base (374)..(374): a, c, t, g, unknown or other
  misc_feature (374)..(374): n is a, c, g, or t
  modified_base (409)..(409): a, c, t, g, unknown or other
  misc_feature (409)..(409): n is a, c, g, or t
  modified_base (429)..(429): a, c, t, g, unknown or other
  misc_feature (429)..(429): n is a, c, g, or t
  modified_base (464)..(464): a, c, t, g, unknown or other
  misc_feature (464)..(464): n is a, c, g, or t
tcagtctacgtagccacgaccggtgctcgatttagtgtagtgtgaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcttttccacctacggtatgaattggttgagacacggcccccggagaggggcttgagtggagtgggatgggatcgagcccgttaacggaactaaaacgagagtatgacagagaacgtccgaggcagagtnatcatcacgcgacacactaccagatacagcctaanataggaactggagacgactnagactcgagacgacacggacctaacttacgttacncgacggacgagtagtatttagtcgactaacgttcggtcccgtggtacctcgtaaaccgcgtcgttacggtcggcgtaccggtcggggtaccgtaaccggg

SEQ ID NO: 318629 - DNA, 652 bp, Homo sapiens
  misc_feature: GZ8MTXP02JM0K1.15.20.B09.1.454.CMB.2.raw
  modified_base (405)..(405): a, c, t, g, unknown or other
  misc_feature (405)..(405): n is a, c, g, or t
tcagtctacgtagccacgaccggtgctcgatttagtgtagtgtgaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctgggcctcagtgatggtctcctgcagtgcttctggttacattcttttccacctacggtatgaattggttgagacaggcccccggagaggggcttgagtggagtgggatggatcagcccttacggaaactaaaacagagtatgacagagaacgtcgaggcagagtcatcgatcaccgcgacacactacaacaagtacagcctanatagaactgagacgcctacgagactacgtacgaaccgacgaccgggaccctaacgtttaacttaccgttacggcgaaccggaaggtaaggtaactttaagttcggtaaaaacccgtacggttaccgggttaccccggttgggtacccgtttaaccgggtaaaccccgtaaccggttacccggtttacggggttccgggggtaccgaccggggtttaccggggggaccccgtttaaaaccccgggggg

SEQ ID NO: 318630 - DNA, 655 bp, Homo sapiens
  misc_feature: GZ8MTXP02G4JR2.15.20.B09.1.454.CMB.2.raw
tcagtctacgtagccacgaccggtgctcgatttagtgtagtgtgaaggggacccaaaaaccacaccctccttgggagaatccctagatcacagctcctcaccatggacgggacctggagcatccttttcttggtggcagcagcaacaggtgccctactcccaggttcacctggtgcagtctggagctgagctgcagagccgtgggcctcagtgatggtctcctgcagtgtctttcgtggttacattccttttccaccttacggtatcgtaattggttgagacaggcccccggagacggggcttggagtggatgggatggatcgagccttaaggaactaaaacgagagtatgcaaggagaacgttccgaggtcagagtcatcatcaccgcgacacactccaacgagtaacagacctaacagtacggaacctaggaacgaacgaccctgaaggtacttacgacggaacgaaccgaccgggtacctaaaccgtttaacgtacgttacggaccggaccggtaacggtaaacgtaagttttaacgttacggaccgtaaccggttacgggtaaccgttcggggtaccttaacggtaaacccgtaacgtcccgtttgggttacgggcgtaaccgggttcgggggacccgttaaacccggggg

SEQ ID NO: 318631 - DNA, 546 bp, Homo sapiens
  misc_feature: GZ8MTXP02IG0DX.15.20.B09.1.454.CMB.2.raw
  modified_base (373)..(374): a, c, t, g, unknown or other
  misc_feature (373)..(374): n is a, c, g, or t
  modified_base (424)..(424): a, c, t, g, unknown or other
  misc_feature (424)..(424): n is a, c, g, or t
  modified_base (508)..(508): a, c, t, g, unknown or other
  misc_feature (508)..(508): n is a, c, g, or t
tcagtctacgtagccacgaccggtgctcgatttagtgtagtgtgaaggggacccaaaaaccacacccctccttgggagaatcccctagatcacagctcctcaccatggacgggacccggagcatcctttcttggtggcagcagcaacaggtgcccactcccaggttcacctggtgcagtctggagctgagctgcagaagcctgggcctcagtgatggtctcctgcagtgcttctggttacatcttttccacctacggtatgtaattggttgagacacggccccggagagggcttgagtggatgggatgggatcagacccttaaggaaactaaaacagagtatgacagagaagttccccgaggcagagtcattnntcacgcgacacataccacgagtacagctacatgaaactgaaggagcctanagatcgagacgacgacgacctattactacgtcgacgacgaagtagtattacgtcgacgtcgtcgtcgtcgtacgtacgtaaccncgtgttcggacggctacggtcgggaccgtacggtaccc

SEQ ID NO: 318632 - DNA, 668 bp, Homo sapiens
  misc_feature: GZ8MTXP02H33X0.15.20.B09.1.454.CMB.2.raw
  modified_base (210)..(210): a, c, t, g, unknown or other
  misc_feature (210)..(210): n is a, c, g, or t
  modified_base (438)..(438): a, c, t, g, unknown or other
  misc_feature (438)..(438): n is a, c, g, or t
tcagtctacgtagccacgaccggtgctcgatttagtgtagtgtgaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagccgtgggcctnagtgatggtctcctgcagtgcttcgtggttacattccttttccactacggttatgaattggttgagacacggcccccggagaggggcttggagtggagtgggatgggatcgagtccccgtttaacgggaaactaaaacaggtaagtatagacaaggaagtaaccgttccgagggcaggatcatcagtcaccgcgacacataccacgagacacgccaacagtaggaacnggaacggacgtccctagaaaggacttacgcggaaacgacgtaccgggacccttaaacggtttaactttaacgtcggacccggtacggaaggtacggtaaattttaaggtttacggacctacgtttcgggggtaccctttcggggacctacggttaaaacccgtaaccggttcccggtttagggttacggggcctaaccggggtttcgggggtaccccgtaaacccggggg

SEQ ID NO: 318633 - DNA, 525 bp, Homo sapiens
  misc_feature: GZ8MTXP02JQCF0.15.20.B09.1.454.CMB.2.raw
  modified_base (274)..(274): a, c, t, g, unknown or other
  misc_feature (274)..(274): n is a, c, g, or t
  modified_base (405)..(405): a, c, t, g, unknown or other
  misc_feature (405)..(405): n is a, c, g, or t
  modified_base (421)..(421): a, c, t, g, unknown or other
  misc_feature (421)..(421): n is a, c, g, or t
  modified_base (424)..(424): a, c, t, g, unknown or other
  misc_feature (424)..(424): n is a, c, g, or t
  modified_base (426)..(426): a, c, t, g, unknown or other
  misc_feature (426)..(426): n is a, c, g, or t
  modified_base (450)..(450): a, c, t, g, unknown or other
  misc_feature (450)..(450): n is a, c, g, or t
  modified_base (490)..(490): a, c, t, g, unknown or other
  misc_feature (490)..(490): n is a, c, g, or t
  modified_base (503)..(503): a, c, t, g, unknown or other
  misc_feature (503)..(503): n is a, c, g, or t
tcagtctacgtagccacgaccggtgctcgatttagtgtagtgtgaaggggacccaaaaaccacaccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattctttccactacggtatgaattggtgagacnggcccccggagaggggcttggagtggatgggatggatcgagcccttacggaactaaaacgagagtatgcagagaacgttccgagggcagacgtcatcatcaccgcggacacatccacgagtacagacctanagtgactgagacgctnagntngacgacacggacacttatactgcncgagagtattacgtgactacgtcgtccgtcgctacgaacncgtcgttagcggngtacggtcgggaccgtaacggg

SEQ ID NO: 318634 - DNA, 660 bp, Homo sapiens
  misc_feature: GZ8MTXP02H04L2.15.20.B09.1.454.CMB.2.raw
  modified_base (483)..(483): a, c, t, g, unknown or other
  misc_feature (483)..(483): n is a, c, g, or t
tcagtctacgtagccacgaccggtgctcgatttagtgtagtgtgaaggggacccaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtgggcctcagtgatggtctcctgcagtgtcttcgtggttacatttccttttccaccttacggttatagtaagttggttgacgtacgaccgggccccggaggaggggtctggagtggagtgggatggatcgacgtacccgttaacggaaaactaaaacgaggtagtagtacgacgaaggaagtaaccgtccgaagggacaaggtacgtacgactcgaacgtccgaaccggacgaaccacgactaccgaacgtaacgacgacgacctaacgagtacggaacgnggaacggacctacgtacgagtacgtacgaacgtaccgaccgaccgtacctaacgttacgtacggtacgacgacgtagtagtagttacgtacgtacgtacgttcggtacgtacgtaccgttaccgtaccgtcggttcggtacgggtccggtacgtaccgggtacgggtacccgtacgg

SEQ ID NO: 318635 - DNA, 601 bp, Homo sapiens
  misc_feature: GZ8MTXP02JFJ1A.15.20.B09.1.454.CMB.2.raw
  modified_base (435)..(435): a, c, t, g, unknown or other
  misc_feature (435)..(435): n is a, c, g, or t
  modified_base (510)..(510): a, c, t, g, unknown or other
  misc_feature (510)..(510): n is a, c, g, or t
tcagtctacgtagccacgaccggtgctcgatttagtgtagtgtgaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggtacatctttccacctacgtatagattggtgagacgacggccccggaggacggggtcttaggagtggagtggatggatcgacgtacctaacggaaactaaaacagagtatgacaggagtaacgttccagggcagagtacatccgataccaccggacggaccactactacccgaaacggactaaccgacgtccctaaanagttacggaactacggaaggtacgcctaacgacgtattcgacgacgaaccgaccgggactacgttacttaccggngacgagagtagtattcgtacgacgtacgtcggtacgtcggtacgtacgtaccgtcgtcgtacggtcggacgtacgggtcggtacggtacgg

SEQ ID NO: 318636 - DNA, 658 bp, Homo sapiens
  misc_feature: GZ8MTXP02H0V08.15.20.B09.1.454.CMB.2.raw
  modified_base (187)..(187): a, c, t, g, unknown or other
  misc_feature (187)..(187): n is a, c, g, or t
  modified_base (457)..(457): a, c, t, g, unknown or other
  misc_feature (457)..(457): n is a, c, g, or t
  modified_base (474)..(474): a, c, t, g, unknown or other
  misc_feature (474)..(474): n is a, c, g, or t
tcagtctacgtagccacgaccggtgctcgatttagtgtagtgtgaaggggacccaaaaaaccacacccctccttgggagaatcccctagatcacagctcctcaccatggacgggacctggagcatccttttcttggtggcagcagcaacaggtgcccactcccaggttcacctggtgcagtctgganctgagctgcagaacgccgtggggcctcgagtgagtggtcctcgtgctagtgtcttgttggttactatttcctttccacgtacgttatgtaagttggtagacgacgaccggccccggaggaggtcttggaggtggagtgggatggataccgacgtcccgttaaacggaaaactaaaacgagtaagtatgacgaagagtacgtccgagggcagagacatcactcgaccgcgaacacactacgacgtaatacacgacctaagagtacgtaacnggacgactccagaagtntcgaacggacgaccgacggtaccctagtttaacgtcgtacggaccgagtagtaaagttattaacgttcgtaacgtaccggtttcggtacccgttcggtaaccgttaaccggtaacccgaaccggtttacggtttacggggccggtacgtaaccggggttacggggtaacccgtaaaccccgggg

SEQ ID NO: 318637 - DNA, 519 bp, Homo sapiens
  misc_feature: GZ8MTXP02FTLIC.15.20.B09.1.454.CMB.2.raw
  modified_base (413)..(413): a, c, t, g, unknown or other
  misc_feature (413)..(413): n is a, c, g, or t
  modified_base (418)..(418): a, c, t, g, unknown or other
  misc_feature (418)..(418): n is a, c, g, or t
  modified_base (456)..(456): a, c, t, g, unknown or other
  misc_feature (456)..(456): n is a, c, g, or t
tcagtctacgtagccacgaccggtgctcgatttagtgtagtgtgaaggggacccaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatctttccacctacggtatgaattggttgagacaggcccccggagaggggcttgagtggatgggatggatcgagcccttacggaactaaaacagagtatgcagagaagtccgaggcagagtacatcatcacgcgacacataccacgagtacagctacatagactgagagctnagatntgacacacggcacgttatactgcgcgagagattatcgntacgtgtccgtcggctgtaaccaacgtcgttaggtcggactacggtcggggaccgtaaccggg

SEQ ID NO: 318638 - DNA, 640 bp, Homo sapiens
  misc_feature: GZ8MTXP02HO3J1.15.20.B09.1.454.CMB.2.raw
  modified_base (292)..(292): a, c, t, g, unknown or other
  misc_feature (292)..(292): n is a, c, g, or t
tcagtctacgtagccacgaccggtgctcgatttagtgtagtgtgaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcagtgatggtctcctgcagtgcttctggttacatttctttccacttacggtatgaagttggtgagacgacggccccggagngggcttggagtggagtggagtggatcgacgtacccgttaacggaaactaaaacgagtacgtagtagacgaggtaagtaaccgttccgagggaccaggagtcatcacgtacgaccgacgaccacgactacccaacgtacgaactacgaccctagagttaggaaccgtgaacgggactccgtacaagtctacgagacgaaccgcggtaccaacgtttactacgtgccgagacgtagtactttagtacggtactacgttcgggttaccgtacggttacctacgtaaaccgtcggttccgttaaggggtcgggtacgtacccgggttacgggggtaccccgttaaaccgggg

SEQ ID NO: 318639 - DNA, 729 bp, Homo sapiens
  misc_feature: GZ8MTXP02FYXUI.15.20.B09.1.454.CMB.2.raw
tcagtctacgtagccacgaccggtgctcgatttagtgtagtgtgaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttactattccttttccaccttacggtattagtaagttggttgagacgacgggtcccccggaggacggggtctggagtggagtgggagtggactcgacgtacccgttaacggaaactaaaacgagagttactagacgaagaagtaacgtaccgaggacgagagtacgaactcgactccgaaccggaccggaacaaccgtacgtacccgaaacgtaacgtaacccgacggtaccctaaacgtaacgttaacgggaaaccgttagggaaacggggtaccacccgttaccgaaagttacttacgtaaccgggaaccggtaacccgtaaaccgggtacccttaaaccgtttaacgtacgtcggacggaccgtaaaggagttaactttacgttcgacgttaccggttcggttaccgtacggttacgtacgtaaaacccgtcggttcgtttcggggacgggtacctaacgggggttcggggaaccgttaaacccgggg

SEQ ID NO: 318640 - DNA, 739 bp, Homo sapiens
  misc_feature: GZ8MTXP02I5B0A.15.20.B09.1.454.CMB.2.raw
  modified_base (281)..(281): a, c, t, g, unknown or other
  misc_feature (281)..(281): n is a, c, g, or t
  modified_base (300)..(300): a, c, t, g, unknown or other
  misc_feature (300)..(300): n is a, c, g, or t
tcagtctacgtagccacgaccggtgctcgatttagtgtagtgtgaaggggacccaaaaaccacacccctccttgggagaatcccctagatcacagctcctcaccatggacgggacctggagcattccttttcttggtggcagcagcaacaggtgcccactcccaggttcacctggtgcagtctggagctgagctgcagaagccgtggggcctcgagtgatcggtcctcctgcgagtgtctttcgtggttactattctttccaccgtagtatgtaattggtnagacgacggccccggaggnggggtcttggaggtggagtgggagtgggtatacgaaccggtacccctttaaacggggaaaaccttaaaaacgagtaacggttaatacggtaccgaaaggtaacggtaaccggtttacccgaaggggttcgaacggtaaggtaacggttaccctagttaccaacgttaccccggaacccggggaaccggaaaccaaccgaacttaacccgaacggtaaaccggtaacctaacggtaccctaaacgtacggttaacggaaaccgttagggaaacgggactaccgttaccgaagtactaccgtagaacccgtaccgaccggtacccttaacttagttaccgtggaccgtagaagtatacgtttagtactccgaagttcggaccgtcgtacttaacgtaaccgacggtccgttagggtaccggacgtacggacgggtacccgg

SEQ ID NO: 318641 - DNA, 721 bp, Homo sapiens
  misc_feature: GZ8MTXP02HRKEX.15.20.B09.1.454.CMB.2.raw
  modified_base (249)..(249): a, c, t, g, unknown or other
  misc_feature (249)..(249): n is a, c, g, or t
tcagtctacgtagccacgaccggtgctcgatttagtgtagtgtgaaggggacccaaaaaccacacccctccttgggagaatcccctagatcacagctcctcaccatggacgggacctggagcattccttttcttggtggcagcagcaacaggtgcccactcccaggttcacctggtgcagtctggagctgagctgcagacggccgtggggcctcgagtgatggtcctcctgcagtgtcttgtgttactntttcctttccacgttacgtatagtagttggtagacgacgccgggccccggaggacgggtcttggaggtggagtgggagtggagtaccgaccggtacccgttaaacgggaaaacttaaaacgaggtaagtacgtcggaacaaggtaacggtacccggttaccggaacgggacgtaacggagttaccgattccgacgtaccgacccgacgaaccacgaacctaccgacgtaacgtacacgactacgagtagaccgtaggacgtaaccgccgtagacgtacgttaccgaggaacccgaacccgtaccgggaacctttaccggtttaacttaaccgggcggtacccggacggttaaaggtacgttaaagtttcgtacgttaccgttacggttcgggttaccgtacgtaccgttaaccggtaacgtccgttcggtacgggtacggcggttaccggccgggtttacggtaaccccggg

SEQ ID NO: 318642 - DNA, 640 bp, Homo sapiens
  misc_feature: GZ8MTXP02I3L2U.15.20.B09.1.454.CMB.2.raw
  modified_base (516)..(516): a, c, t, g, unknown or other
  misc_feature (516)..(516): n is a, c, g, or t
  modified_base (562)..(562): a, c, t, g, unknown or other
  misc_feature (562)..(562): n is a, c, g, or t
  modified_base (571)..(571): a, c, t, g, unknown or other
  misc_feature (571)..(571): n is a, c, g, or t
tcagtctacgtagccacgaccggtgctcgatttagtgtagtgtgaaggggacccaaaaaaccacacccctccttgggagaatcccctagatcacagctcctcaccatggacgggacctgggagcatccttttcttgggtggcagcagcaacaggtgcccactcccaggttcacctggtgcagtctggagctgagctgcagaagccgtggggcctcgagtcgatggtcctcctgcagtgtcttctggttacattctttccacctacggtatgtattggtgagacacgggaccccggaggagggtcttggagtggagtggggactggataccgacggtaccccgttaacgggaaaacctaaaagacgtaagtagtcgacgaagtaacgaacgttaccgaaggggacaggtaagtaccagttaccacgtaccgaccggacgtaaccacgaactcccgaagtaactacccgagtaacccaacgagtacggaaacttggacgggacacgtaccgaagtacncgtcggaacgtacgacggtaccctaacttatacgtacgacgtaagngaaaagttnttactcgacctacgtcgtacgtcgtactcgtaccgcgtcgtcggtacggcgtacggtcggaccgtacgg

SEQ ID NO: 318643 - DNA, 580 bp, Homo sapiens
  misc_feature: GZ8MTXP02H399H.15.20.B09.1.454.CMB.2.raw
  modified_base (210)..(210): a, c, t, g, unknown or other
  misc_feature (210)..(210): n is a, c, g, or t
  modified_base (293)..(293): a, c, t, g, unknown or other
  misc_feature (293)..(293): n is a, c, g, or t
  modified_base (330)..(330): a, c, t, g, unknown or other
  misc_feature (330)..(330): n is a, c, g, or t
  modified_base (337)..(337): a, c, t, g, unknown or other
  misc_feature (337)..(337): n is a, c, g, or t
  modified_base (343)..(343): a, c, t, g, unknown or other
  misc_feature (343)..(343): n is a, c, g, or t
  modified_base (353)..(353): a, c, t, g, unknown or other
  misc_feature (353)..(353): n is a, c, g, or t
  modified_base (356)..(357): a, c, t, g, unknown or other
  misc_feature (356)..(357): n is a, c, g, or t
  modified_base (359)..(359): a, c, t, g, unknown or other
  misc_feature (359)..(359): n is a, c, g, or t
  modified_base (362)..(362): a, c, t, g, unknown or other
  misc_feature (362)..(362): n is a, c, g, or t
tcagtctacgtagccacgaccggtgctcgatttagtgtagtgtgaaggggacccaaaaccacacccctccttgggagaatcccctagatcacagctcctcaccatggacgggacctggagcatccttttcttggtggcagcagcaacaggtgcccactcccaggttcacctggtgcagtctgggagctgagctgcagaagcctgggcctnagtgatggtctcctgcagtgcttctggttacattcttttccactacggtatgaattggttgagacaggcccccggagacgggnttgagtggatgggatggatcagcctaggaactaaaanagagtangcaganaagtcagganagnnancanacacgcgacacactaccaacaacgacacgacacgagtagaacgaggaacggacgtcacgagtacgtacgtacgaacgaacgaccggacgtaacgttaacgttacgtacgacggacgaagtagtaagttacgtacgtacgtacgtcggtaccgtacgtacgtacgtaaccgtaacgtcgtacggtcgggtacggtacggtaccgggtaccggtaaccgg

SEQ ID NO: 318644 - DNA, 509 bp, Homo sapiens
  misc_feature: GZ8MTXP01EDGQO.9.30.C08.1.454.CMB.2.raw
  modified_base (276)..(276): a, c, t, g, unknown or other
  misc_feature (276)..(276): n is a, c, g, or t
  modified_base (485)..(485): a, c, t, g, unknown or other
  misc_feature (485)..(485): n is a, c, g, or t
  modified_base (504)..(509): a, c, t, g, unknown or other
  misc_feature (504)..(509): n is a, c, g, or t
tcagtgatacgtctcacgaccggtgctcgatttagtctgacgtcaaagggaaagggttgtagtaggtgactccatcaccggtactaattactactggagttggatccgccagcccccgggaagggcctggagtggattggatacgccttttacagtggagtcacctactacaacccgtccctcaagagccgagttaccatatctgtcgacacgtcccagaatcagttctccctggagtgacctctgtgactgccgcagactcggccgtgtatttcngtgccagaacgcaaagcagcgcctactatactttaaactttgacttctggggccaggggatccctggtcaccgtctcctcagcctccaccaagggccccccatcggtcttccccctggccgccctgctccaggacgcacctccgagacgcacagcggccctggggctgcctggtcaaggactacttccaggacgtatcactgagcgggntgggcaagggcgcataagnnnnnn

SEQ ID NO: 318645 - DNA, 669 bp, Homo sapiens
  misc_feature: GZ8MTXP01CCRAD.9.30.C08.1.454.CMB.2.raw
  modified_base (234)..(234): a, c, t, g, unknown or other
  misc_feature (234)..(234): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtnactccatcaccggtactaattactactggagttgatcccgccacggccccccgggaaggcctggagtggattggatacgccttttacagtgagtcacctactaccaacccgtccctacaagacgaccccgagttaccatactctagtaccgaacaccgtcccaagaactcacgtttctcccgtggagttcgacccttcgtgtcgactcggcccgcgacgaccgtccgggtccgttggtttacttttccgtggttcgacccaaggaaaccgcgaaaacggccaaggcccgtacccttaacttaaactttaaaccctttttaaaacgttttcgtaaaccgttttcggttacggggggaccccttaagggggttaccttccccggttcgggttaccctaacccggttcctccccttccgaacgttcccctaacccccg

SEQ ID NO: 318646 - DNA, 570 bp, Homo sapiens
  misc_feature: GZ8MTXP01DVHG4.9.30.C08.1.454.CMB.2.raw
  modified_base (234)..(234): a, c, t, g, unknown or other
  misc_feature (234)..(234): n is a, c, g, or t
  modified_base (270)..(270): a, c, t, g, unknown or other
  misc_feature (270)..(270): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtnactccatcaccggtactaatactactggagttgganccgccacgcccccgggaaggcctggagtggattggatacgctttacagtggagtcacctactacacccgtcctcaagacgcccgagttaccatatctagtcaacacgtcccaagaactcagttctccctggagtgacctctgtgactgccgcagacctcggaccgttgttatttctggttcgcccaagaaccgcaaagcacgccgtaccttaactattaaacttttaaacttgtaactttcgtcgggggccaaggggttcttcccgtggtcctaaccgtctccttcaacgccctaacccg

SEQ ID NO: 318647 - DNA, 547 bp, Homo sapiens
  misc_feature: GZ8MTXP01D1TFV.9.30.C08.1.454.CMB.2.raw
  modified_base (423)..(423): a, c, t, g, unknown or other
  misc_feature (423)..(423): n is a, c, g, or t
  modified_base (541)..(541): a, c, t, g, unknown or other
  misc_feature (541)..(541): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgtgtcctgtcccaggtgcagctgcaggagtcgggcccaggactggtgaagccttcacagaccctgtccctcacctgcactgtctctggtgactccatcaccggtactaattactactggagttggatccgccagccccccgggaagggcctggagtggattggatacgccttttacagtggagtcacctactacaacccgtcctcaacgacgccgagttaccatatctgtcgacacgtcccagaatcagttctccctggagtgactctgtgactgccgnacgactcggccgttggtatttctgtcgccagaacgcaaaagcagcgcctaataacttaactttaaactttgaactttcgtgggggccttgggactcccgtggtccaccgtcttcctcncgtccc

SEQ ID NO: 318648 - DNA, 583 bp, Homo sapiens
  misc_feature: GZ8MTXP01DECEE.9.30.C08.1.454.CMB.2.raw
  modified_base (230)..(230): a, c, t, g, unknown or other
  misc_feature (230)..(230): n is a, c, g, or t
  modified_base (233)..(233): a, c, t, g, unknown or other
  misc_feature (233)..(233): n is a, c, g, or t
  modified_base (241)..(241): a, c, t, g, unknown or other
  misc_feature (241)..(241): n is a, c, g, or t
  modified_base (246)..(246): a, c, t, g, unknown or other
  misc_feature (246)..(246): n is a, c, g, or t
  modified_base (262)..(262): a, c, t, g, unknown or other
  misc_feature (262)..(262): n is a, c, g, or t
  modified_base (265)..(265): a, c, t, g, unknown or other
  misc_feature (265)..(265): n is a, c, g, or t
  modified_base (269)..(269): a, c, t, g, unknown or other
  misc_feature (269)..(269): n is a, c, g, or t
  modified_base (272)..(272): a, c, t, g, unknown or other
  misc_feature (272)..(272): n is a, c, g, or t
  modified_base (275)..(275): a, c, t, g, unknown or other
  misc_feature (275)..(275): n is a, c, g, or t
  modified_base (291)..(291): a, c, t, g, unknown or other
  misc_feature (291)..(291): n is a, c, g, or t
  modified_base (294)..(294): a, c, t, g, unknown or other
  misc_feature (294)..(294): n is a, c, g, or t
  modified_base (296)..(296): a, c, t, g, unknown or other
  misc_feature (296)..(296): n is a, c, g, or t
  modified_base (298)..(298): a, c, t, g, unknown or other
  misc_feature (298)..(298): n is a, c, g, or t
  modified_base (302)..(302): a, c, t, g, unknown or other
  misc_feature (302)..(302): n is a, c, g, or t
  modified_base (311)..(311): a, c, t, g, unknown or other
  misc_feature (311)..(311): n is a, c, g, or t
  modified_base (315)..(315): a, c, t, g, unknown or other
  misc_feature (315)..(315): n is a, c, g, or t
  modified_base (317)..(317): a, c, t, g, unknown or other
  misc_feature (317)..(317): n is a, c, g, or t
  modified_base (334)..(334): a, c, t, g, unknown or other
  misc_feature (334)..(334): n is a, c, g, or t
  modified_base (348)..(348): a, c, t, g, unknown or other
  misc_feature (348)..(348): n is a, c, g, or t
  modified_base (350)..(350): a, c, t, g, unknown or other
  misc_feature (350)..(350): n is a, c, g, or t
  modified_base (354)..(354): a, c, t, g, unknown or other
  misc_feature (354)..(354): n is a, c, g, or t
  modified_base (357)..(357): a, c, t, g, unknown or other
  misc_feature (357)..(357): n is a, c, g, or t
  modified_base (359)..(359): a, c, t, g, unknown or other
  misc_feature (359)..(359): n is a, c, g, or t
  modified_base (467)..(467): a, c, t, g, unknown or other
  misc_feature (467)..(467): n is a, c, g, or t
tcagtgatacgtctcacgaccggtgctcgatttagtctgacgtcaaaagggaaagggtctgtgaaggcttcaccagtcctggacctcctgtgcaagaacatgaaacacctgtggttcttcctcctgctggtggcagctcccagatgggtcctgtcccaggtgcagctgcagggagtcgggcccagggactggtgaagcccttcacagacccctgtcccctcaccctgccnctntctctgtnctccntcaccgtactattctntgngtgnccnccnccggccccggcggcgnggngngngtgntctctttcngtgncncctactaccaccctccncagcgcccgctacntntctntcncncctcccacatctcgttcctcccgtcggtggtcgtcctctgtcgctcgccgcgcgccgtccggtccgttgtttcgttttcgttcgtcgaccgacgaacgacgaacgacncgtccgtccttacttactttaactttttaaacttttcgttcgttcggtcggggtccggttcgggttccgttcccgttcggttccgtcccgttcctcccttcctccgcccgtccccg

SEQ ID NO: 318649 - DNA, 632 bp, Homo sapiens
  misc_feature: GZ8MTXP01BBKCY.9.30.C08.1.454.CMB.2.raw
  modified_base (234)..(234): a, c, t, g, unknown or other
  misc_feature (234)..(234): n is a, c, g, or t
  modified_base (267)..(267): a, c, t, g, unknown or other
  misc_feature (267)..(267): n is a, c, g, or t
  modified_base (422)..(422): a, c, t, g, unknown or other
  misc_feature (422)..(422): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtnactccatcacgtactaattactactggagtganccgccacggccccccgggaaggcctggagtggattggatacgtccttttacgagtggagtcacctactaccacccgtcctacaagacgccccgagttaccatactctagtcgaacaccgtcccagaactctagttctacccgtggagtcgacctntgtgactgccgcagactcggtccgttgttactttcgtgtcgaccgaagaaccgcaaaggccagccgtaccttaacttaactttaaaccttttaaaacgtttgtaaacccgtttcggtacggggggtacccttaagggggttcccttccccggttaagggttcccctaacccggtttccctcccttaccgaaccggttccccctaaccccg

SEQ ID NO: 318650 - DNA, 560 bp, Homo sapiens
  misc_feature: GZ8MTXP01BHPUM.9.30.C08.1.454.CMB.2.raw
  modified_base (234)..(234): a, c, t, g, unknown or other
  misc_feature (234)..(234): n is a, c, g, or t
  modified_base (271)..(271): a, c, t, g, unknown or other
  misc_feature (271)..(271): n is a, c, g, or t
  modified_base (412)..(412): a, c, t, g, unknown or other
  misc_feature (412)..(412): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtnactccatcaccggtactaattactactggagttgganccgccacggccccccgggaagggcctggagtggattggatacgtctttacagtgagtcacctactacacccgtcctcaagacgcccgtagttaccatatctagtcgcacgtcccagactcagttctccctggagtgacctntgtgactgccgcagactcggcgttgttatttctgtcaccaagacgcaaagcagtcgccttactattaactttaaacttgtacttcgtcggggccaggggttcttacccgttggtcctaaccgtcctcccgactaaccgccctaacccg

SEQ ID NO: 318651 - DNA, 587 bp, Homo sapiens
  misc_feature: GZ8MTXP01CKVYU.9.30.C08.1.454.CMB.2.raw
  modified_base (216)..(216): a, c, t, g, unknown or other
  misc_feature (216)..(216): n is a, c, g, or t
  modified_base (376)..(376): a, c, t, g, unknown or other
  misc_feature (376)..(376): n is a, c, g, or t
  modified_base (418)..(418): a, c, t, g, unknown or other
  misc_feature (418)..(418): n is a, c, g, or t
  modified_base (425)..(425): a, c, t, g, unknown or other
  misc_feature (425)..(425): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagacccctgtccctnacctgcactgtctctggtgactcatcaccggtactaatactactggagttggatccgccagccccccgggaaggcctggagtggattggatacgccttttacagtggagtcacctactaccaacccgtcctacaagagccccgagttaccatatctgtcncacgtcccagaactcacgttctccctggacgtgacctctgtnactgccncaggctcggccgtagtttgttctgtcgacgacgaacgacgaacgacgacgtccgtacctacttaacttaaactttaaactttacgttaccgttacgttacgggtcggttacgggttccgttccgtccgtccgtcccgtcctccgttccgtccgcccgtcccg

SEQ ID NO: 318652 - DNA, 605 bp, Homo sapiens
  misc_feature: GZ8MTXP01BGA3E.9.30.C08.1.454.CMB.2.raw
  modified_base (235)..(235): a, c, t, g, unknown or other
  misc_feature (235)..(235): n is a, c, g, or t
  modified_base (267)..(267): a, c, t, g, unknown or other
  misc_feature (267)..(267): n is a, c, g, or t
  modified_base (385)..(385): a, c, t, g, unknown or other
  misc_feature (385)..(385): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacacgaccctgtccctcacctgcactgtctctggtnactcatcacgtactatactactggagttgacnccgccgacggccccccgggaaggcctggacgtggattggatacgtctttactagtgtagtcacctactaccacccgtaccctacaacgacgacccgtacgtactatactctacgtacncacgtcccacgaatctacgttactccctacggaggtcgtacctctgtgacgtcgccgacagactccggtcgtcgttagtttcttggtcgacgagaaaccgcaaaggcacgaccgccttaacttaacttaaacttttaacttcgtacgttcgtacggggaccttagggcttcccgtggttccgtaaccttcccgtccttaccgtccgttcccgtaaccccg

SEQ ID NO: 318653 - DNA, 594 bp, Homo sapiens
  misc_feature: GZ8MTXP01AMYYJ.9.30.C08.1.454.CMB.2.raw
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagacccctgtccctcacctgcactgtctctggtgactccatcaccggtactaatactactggagttggatccgccacgccccccgggaaggcctggagtggattggatacgccttttacagtgagtcacctactaccaacccgtccctcaacgacgccccgagttaccatactctgtcgcacgtcccagaactcagttcctccctggagtcacctctgtgactgccgcagaccgtcggccgttgttacttttcgtggttcgacccgaaggaaccgcaaaacgccaagccgaccttaactaattaaccttttaaactttgaacctttcgtacgggggtcccaggggttcttccccgtaagggtccaaccgttctccttccaagcccctaacccg

SEQ ID NO: 318654 - DNA, 510 bp, Homo sapiens
  misc_feature: GZ8MTXP01D9QBW.9.30.C08.1.454.CMB.2.raw
  modified_base (249)..(249): a, c, t, g, unknown or other
  misc_feature (249)..(249): n is a, c, g, or t
  modified_base (282)..(282): a, c, t, g, unknown or other
  misc_feature (282)..(282): n is a, c, g, or t
  modified_base (404)..(404): a, c, t, g, unknown or other
  misc_feature (404)..(404): n is a, c, g, or t
  modified_base (450)..(450): a, c, t, g, unknown or other
  misc_feature (450)..(450): n is a, c, g, or t
  modified_base (504)..(510): a, c, t, g, unknown or other
  misc_feature (504)..(510): n is a, c, g, or t
tcagtgatacgtctcacgaccggtgctcgatttagtctgacgtcaaagggaaagggtctgtgaagccttcacagaccctgtccctcacctgcactgtctctggtgactccatcaccggtactaattactactggagttggatccgccacggccccccggggaagggcctggagtggattggatacgtccttttacagtggagtcacctactaacaaaccgaaaggcacgccccgaagaaaccacaggtntaccacccctgcccccaagaacgcaaagcagcncctaactataactttaaacttgacttcgtggggccaggggactcccgtggtccaccgtctcctcacgcctccacgaacggcccatccggtcctcccccgtggccgccctgcctccgaggacnccaccgtccgagacgccacgcggtccgggccctggggctcgccgtntacgaacgactactcagacgtatcacgtgagcgggctggacaaggcggcaatgnnnnnnn

SEQ ID NO: 318655 - DNA, 694 bp, Homo sapiens
  misc_feature: GZ8MTXP01ATF22.9.30.C08.1.454.CMB.2.raw
  modified_base (236)..(236): a, c, t, g, unknown or other
  misc_feature (236)..(236): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagcccttcacacgaccctgtccctcacctgcactgtctctggtnactcatcacgtactaatactacgtggagttgactccgccgacggccccccgggaaggcccgtggacgtggtacgttaggacttaccgtccttttacgacggttggtacgtcctaaccctaactacctaaccccgttccctacaaacgcgtaccccgtaacgtttaccatactccgtaacgtaccgaaccgacggtaccccaaggaaacctcgtacgttcctcccgtgggtacgtcgacccttgtagtcgacctcggaccgacgacgtccgtccgggtaccgttggtttactttccgtggtacgacccgaaggaacccagaaacgccacggtccctaccttaacgttaacttaaaccgttttaaacgttggtaacctttcgggacggggtacccgttaggggttaccttcccggttggtccctaaccggttcctcccggttacctccgttccctaaccg

SEQ ID NO: 318656 - DNA, 657 bp, Homo sapiens
  misc_feature: GZ8MTXP01A5YUG.9.30.C08.1.454.CMB.2.raw
  modified_base (235)..(235): a, c, t, g, unknown or other
  misc_feature (235)..(235): n is a, c, g, or t
  modified_base (373)..(373): a, c, t, g, unknown or other
  misc_feature (373)..(373): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacacgaccctgtccctcacctgcactgtctctggtnactcatcaccggtactaatactactggagttggactccgccacggccccccgggaaggcctggagtggattggactacgtcctttacagtgagtcacctactacacccgtcctcaagcgcccgagtacatatctgtcncacgtcccaagtactcacgttcctcccgtgggtagtacgacccttcgtgtcgtactcgaccgcagaccgtccgggccgttggttactttctggttcgacccgaaggaaccgacgaaaacgccgaacggccctaccttaaacttaactttaaaccttttaaaacccgttttggtaaccgtttcggtaccggggggacccttaaacgggggttccttcccccgggttcgggttacccctaacccggtttccctccccttacccgaaccggttccccctaaccccgg

SEQ ID NO: 318657 - DNA, 646 bp, Homo sapiens
  misc_feature: GZ8MTXP01DW92H.9.30.C08.1.454.CMB.2.raw
  modified_base (219)..(219): a, c, t, g, unknown or other
  misc_feature (219)..(219): n is a, c, g, or t
  modified_base (285)..(285): a, c, t, g, unknown or other
  misc_feature (285)..(285): n is a, c, g, or t
  modified_base (288)..(288): a, c, t, g, unknown or other
  misc_feature (288)..(288): n is a, c, g, or t
  modified_base (316)..(316): a, c, t, g, unknown or other
  misc_feature (316)..(316): n is a, c, g, or t
  modified_base (334)..(334): a, c, t, g, unknown or other
  misc_feature (334)..(334): n is a, c, g, or t
  modified_base (384)..(384): a, c, t, g, unknown or other
  misc_feature (384)..(384): n is a, c, g, or t
  modified_base (645)..(645): a, c, t, g, unknown or other
  misc_feature (645)..(645): n is a, c, g, or t
tcagtgatacgtctcacgaccggtgctcgatttagtctgacgtcaaagggaaagggtctgtgaagccttcacagaccctgtccctcacctgcactgtctctggtgactccatcaccggtactaattactactggagttggatccgccagccccccgggaaggcctggagtggattggatacgcttttacagtggagtcacctactacaacccgtccctnaagagccgagttaccatatctgtcgacacgtcccagaatcagttctccctggaggtgacctctgtnacngccgcagactcggccgtgtatttctgtnccagaacgcaaagcagcnctactatactttaaattgacttcgtggggacagggactcccgtggttccnccgtctacctcacgccctaccaccgaaacgggccccaagtccgggtcccttcccccgtggcccgcccctcgcctcccgaggacgccaaccgtcccgagggacgccaccgacggccggtccccgtggggccttacggccccgttcgggtaccgaaaccgggtactaaccctttaccgaaggtaaccggttacttaccgaaccgttggacggccgggggttctcgggggaacccaaagggggcccgttaacgaagttaacggng

SEQ ID NO: 318658 - DNA, 623 bp, Homo sapiens
  misc_feature: GZ8MTXP01BBKJJ.9.30.C08.1.454.CMB.2.raw
  modified_base (234)..(234): a, c, t, g, unknown or other
  misc_feature (234)..(234): n is a, c, g, or t
  modified_base (376)..(376): a, c, t, g, unknown or other
  misc_feature (376)..(376): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggtagctcccagatgggtcctgtcccaggtgcagctgcaggagtcgggcccaggactggtgaagccttcacagaccctgtccctcacctgcactgtctctggtnactcatcacgtactaattactactggagtgactccgccacgcccccgggaggcctggagtggattggatacgcttttacgagtggagtcacctactaccaacccgtcctacaagacgccgtacgtaccatactctgtacacncgtcccagactctagttctaccgtggacgtcgacctcgtgtcgacgtcggccgtcacgtaccgtcggtccgttgttactttcgtggttcgaccgaacggaaaccgacgaaacgccgtaaacggccgttacccttaaacttaaactttaaccttttaaaacgtttcgttaccgtttcggttacggggacccgtagggttacttcccgttaggtccctaccgtctcccacacgtcccttccgaacccgg

SEQ ID NO: 318659 - DNA, 618 bp, Homo sapiens
  misc_feature: GZ8MTXP01EZAIX.9.30.C08.1.454.CMB.2.raw
  modified_base (234)..(234): a, c, t, g, unknown or other
  misc_feature (234)..(234): n is a, c, g, or t
  modified_base (266)..(266): a, c, t, g, unknown or other
  misc_feature (266)..(266): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtnactcatcacgtactaatactactggagtgganccgcgacggcccccgggaaggccgtggagtggagttggactacgtcctttacagtgacgtcacctactaccacccgtccacaagacgcccgtagtacatatctagtacaacacgtccaagaatctacgttcctcccgtggacggtcgacctcgtgtcgacgtcgccgctacgaccgtccgggccgttgttactttcgtagtcgacccgaagaaccgcaaagccaagtccgtacctaacttaattaaaccttttaaacgtttcgaaccttttcggacgggggtaccttaagggggttccttccccggtgggttaccctccggttcctcccttacaacccgttccctaaccccg

SEQ ID NO: 318660 - DNA, 706 bp, Homo sapiens
  misc_feature: GZ8MTXP01ANIC0.9.30.C08.1.454.CMB.2.raw
  modified_base (235)..(235): a, c, t, g, unknown or other
  misc_feature (235)..(235): n is a, c, g, or t
  modified_base (531)..(531): a, c, t, g, unknown or other
  misc_feature (531)..(531): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacacgaccctgtccctcacctgcactgtctctggtnactccatccaccggtaactaattactacgtggtagttggactccgccgaccggccccccggggaagggccgtgggaggtggtagtttgggactaccgttccgttttacgaggttaggacgtacacccttaacctaaccaaccccgtcctacgaagacgaccccgtagttacatactctacgtacgaaccaccgtacccagtactctacgttctcccggttaggacgtcgacctcgttaggtgaccgtcggacccgacgtacggacccgttcgggtcgtttacggttactttttcgnggttaccgaccgaacgaaccggacaaaacggcaaccgtccgtaccctaatttaaactttaaacttttaaacgtttcggtaacctttcggggtaccgggggtacttacggggttaccttccccggtaagggtccctaacccgttctccccttacgaacccggttcccctaacccgg

SEQ ID NO: 318661 - DNA, 666 bp, Homo sapiens
  misc_feature: GZ8MTXP01BNXHR.9.30.C08.1.454.CMB.2.raw
  modified_base (235)..(235): a, c, t, g, unknown or other
  misc_feature (235)..(235): n is a, c, g, or t
  modified_base (384)..(384): a, c, t, g, unknown or other
  misc_feature (384)..(384): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacacgaccctgtccctcacctgcactgtctctggtnactccatcaccggtactaattactactggagtggatccgccgacggccccccgggaaggcctggagtggattggactacgtcctttagagtggatcaccctactaccaacccgtcctacaacgacgcccgagttacatatctacgtacncacgtcccagaactctagttcctcccgtgggacgtcgtacccgtcgtgtacgtactcggcccgtacacgtaccgttccgggaccgtttcggttacgtttcgtcgttcggacccgaagaaacccgacgaaaacgccgaagtcccgtaccttaaacttaacttaaaccgtttttaaactttcggtaaccgtttcggtacgggggtacccttaagggggttaccttccccggttgggtaccctaacccggttcctccccgttactaaccggttcccctaaccccg

SEQ ID NO: 318662 - DNA, 649 bp, Homo sapiens
  misc_feature: GZ8MTXP01APRKV.9.30.C08.1.454.CMB.2.raw
  modified_base (320)..(320): a, c, t, g, unknown or other
  misc_feature (320)..(320): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtgactcatcaccggtactaattactactggagtggactccgccgacgccccccgggaaggcctggagtggattggatacgtcctttangtgagtcacctactaccacccgtcctacgaagacgccccgtaagttacatactctagtcgaacacgtacccagtaactcgacgttctcccgtggacgtcgaccttgtcgtcgactcgccgtcgacgtaccgtcgggccgttgttacgtttccgtggtccgccgaaaggaacccgacgaaacggccaacggtccctacccttaaacttaacttaaccgttttaaaacttcggtaaaccgtttcggtacgggggtacccttaggggttaccttccccggtgggtaccctaacccgttcctacccgttccgtaacggttcccctaaccccgg

SEQ ID NO: 318663 - DNA, 610 bp, Homo sapiens
  misc_feature: GZ8MTXP01DUNVE.9.30.C08.1.454.CMB.2.raw
  modified_base (584)..(584): a, c, t, g, unknown or other
  misc_feature (584)..(584): n is a, c, g, or t
  modified_base (591)..(591): a, c, t, g, unknown or other
  misc_feature (591)..(591): n is a, c, g, or t
  modified_base (598)..(598): a, c, t, g, unknown or other
  misc_feature (598)..(598): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtgactccatcaccggtactaatactactggagttggatccgccgacggccccccgggaaggccgtggagtggattggatacgtccttttacagtggagtcaccttactaccaaccccgtccctacaacgacgccccgtagttaccatactctacgtaccgaacaccgtaccccagtaaactctacgtttcctccccgtgggacggttcgacctcgttgtcgacgtcgccgcacgacctccgggccgttgtttacgtttcgtggttcgaccgagaaccgacaaagccacgccgtacctactaattaactttaaacttgtacttcgtacggggcagggttcttcccgtggtccnccgttcnccgttcnccgcctaacccg

SEQ ID NO: 318664 - DNA, 568 bp, Homo sapiens
  misc_feature: GZ8MTXP01BPMGI.9.30.C08.1.454.CMB.2.raw
  modified_base (236)..(236): a, c, t, g, unknown or other
  misc_feature (236)..(236): n is a, c, g, or t
  modified_base (321)..(321): a, c, t, g, unknown or other
  misc_feature (321)..(321): n is a, c, g, or t
  modified_base (384)..(384): a, c, t, g, unknown or other
  misc_feature (384)..(384): n is a, c, g, or t
  modified_base (417)..(417): a, c, t, g, unknown or other
  misc_feature (417)..(417): n is a, c, g, or t
  modified_base (421)..(421): a, c, t, g, unknown or other
  misc_feature (421)..(421): n is a, c, g, or t
  modified_base (428)..(428): a, c, t, g, unknown or other
  misc_feature (428)..(428): n is a, c, g, or t
  modified_base (447)..(447): a, c, t, g, unknown or other
  misc_feature (447)..(447): n is a, c, g, or t
  modified_base (506)..(506): a, c, t, g, unknown or other
  misc_feature (506)..(506): n is a, c, g, or t
  modified_base (545)..(545): a, c, t, g, unknown or other
  misc_feature (545)..(545): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgtagctgcaggagtcgggcccaggactggtgaagccttcacagacccctgtcccctcacctgcactgtctctggtnactcatcaccgtataattactactggagttgatcccgccacggccccccgggaagggcctggagtggattggatcgtcctttacngtggatcacctactacaacccgtcctacaacgtcgccgtacgttaccatactctgtaccgacncgtcccagaactcagttctcctggagtcacctntgtnactgccnagctcggctgtactttcgngtcgaccagaacgcaaagcagcctcctaacttaataaccttttaaacttgactttcggngggcctaaggggttccttccgttggtccaccgttctccncgacgtcccttaaccgaacccgg

SEQ ID NO: 318665 - DNA, 636 bp, Homo sapiens
  misc_feature: GZ8MTXP01EZU27.9.30.C08.1.454.CMB.2.raw
  modified_base (235)..(235): a, c, t, g, unknown or other
  misc_feature (235)..(235): n is a, c, g, or t
  modified_base (270)..(270): a, c, t, g, unknown or other
  misc_feature (270)..(270): n is a, c, g, or t
  modified_base (321)..(321): a, c, t, g, unknown or other
  misc_feature (321)..(321): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagacccctgtccctcacctgcactgtctctggtnactcatcaccggtactaattactactggagttganccgccgacggcccccgggaaggcctggagtggattggatacgtcctttacngtggagtcacctactaccacccgtcctacagacgcccgagttaccatactctacgtcgaactaccgtcccagaactcgtagttcctcccgtggagtcgacctcgtgtcgacctgccgacacgaccgtcgggtcgttgttactttcgtggtcgaccgaagaaccgaccaaaggccaagccgtacccttaacttaacttaaccgtttttaaaactttcgtaaaccgttttccggtacggggtcccaaggggttccttccccggttgggtccctaacccggttcctccccgttactaacccggttcccctaaccccgg

SEQ ID NO: 318666 - DNA, 553 bp, Homo sapiens
  misc_feature: GZ8MTXP01BPC8O.9.30.C08.1.454.CMB.2.raw
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtgactccatcaccggtactaattactactggagttggatccgccacgccccccgggaaggcctggagtggattggatacgtccttttacagtggagtcacctactaccacccgtcctcaagacgccccgagttaccatactctgtcgcacgtcccagaatctagttctccctggagtgacctctgtgactgccgcagactcggccgtgtatttcgtgtcgccagaacgcaaagcacgcgcctactataactttaaacttgtacttcgcggggtcccaggggcttcccgtggtcctaacgtcctcgttctaacgcctaaccg

SEQ ID NO: 318667 - DNA, 724 bp, Homo sapiens
  misc_feature: GZ8MTXP01EELB9.9.30.C08.1.454.CMB.2.raw
  modified_base (237)..(237): a, c, t, g, unknown or other
  misc_feature (237)..(237): n is a, c, g, or t
  modified_base (270)..(270): a, c, t, g, unknown or other
  misc_feature (270)..(270): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaacgccttcacacgaccctgtccctcacctgcactgtctcgtggtnactccatcacgtactaatactactggagtgacnccgccgaccggacccccgggaaggccgtggaggtggtattggactacgtaccttttacgagtggtacgtctaccctactaccaaccccgtcctacaacgacgtaccccgtagttaccatactcgtacgtaccgaacgaccgtacccgaagtactacgtacgttacctcccgtagggtacgtccgtaccttcgttacgtacgtacctcggcccgtacgacggtaccgtccgggtccgtttagtttaccgtttcgtcggtacgaccccgaaaggaacccgaacgaaaacggccgaacggtcccgttaaccctttaaacctttaacttttaaaaccttttaaacgtttcggaaccgtttttccgggaaacgggggtcccttaacgggggttcccttaccccgggttgggtaccccttcccggttcccttacccacgtcccgttccccgtaaccccgg

SEQ ID NO: 318668 - DNA, 661 bp, Homo sapiens
  misc_feature: GZ8MTXP01EBWOZ.9.30.C08.1.454.CMB.2.raw
  modified_base (272)..(272): a, c, t, g, unknown or other
  misc_feature (272)..(272): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtgactccatcaccggtactaaattactactggagttgganccgccacggccccccgggaaggcctggagtggattggatacgtccttttacgagtggagtcacccttactaaccaccccgtccctacgaaacgacgccccgacgttaccatactctacgtccgaactacgtacccaagtaactccgtacgttacctcccgtagggacgttcgacccttgtagtcgaccttcggccgcacgtaccgtcgggtcgttagttacttttcgtggttcgaccctaggaaccgacaaacgccagtcccgtaccttaactaacttaaacttttaaacgtttggacctttgggtccggggtacccttaggggttaccctttcccggtgggttaccctaacccggttcctcccttaccgtaaccgttccctaaccccg

SEQ ID NO: 318669 - DNA, 559 bp, Homo sapiens
  misc_feature: GZ8MTXP01A283B.9.30.C08.1.454.CMB.2.raw
  modified_base (234)..(234): a, c, t, g, unknown or other
  misc_feature (234)..(234): n is a, c, g, or t
  modified_base (271)..(271): a, c, t, g, unknown or other
  misc_feature (271)..(271): n is a, c, g, or t
  modified_base (324)..(324): a, c, t, g, unknown or other
  misc_feature (324)..(324): n is a, c, g, or t
  modified_base (458)..(458): a, c, t, g, unknown or other
  misc_feature (458)..(458): n is a, c, g, or t
  modified_base (471)..(471): a, c, t, g, unknown or other
  misc_feature (471)..(471): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtnactccatcaccggtactaattactactggagttgganccgccacggccccccgggaagggccctggagtggattggatacgtcttttacngtgagtcacctactaccacccgtcctcaagacgccccgagttaccatactctgtacgaacacgtcccaagaactcacgttctcccgtggacggtgacccttctgtgactgccgcagctcgggcgttgtatttcngtgccagaaccgnaaagcagcgacctactattaacttaaactttgacttcgtggggccagggcttcccgtggtcaaccgtctccttcaacgccctaacccg

SEQ ID NO: 318670 - DNA, 680 bp, Homo sapiens
  misc_feature: GZ8MTXP01BB58K.9.30.C08.1.454.CMB.2.raw
  modified_base (360)..(360): a, c, t, g, unknown or other
  misc_feature (360)..(360): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagacccctgtccctcacctgcactgtctctggtgactccatccaccggtactaaattactactggagttggactcccgccacggccccccgggaaggcctggagtggattggactacgtctttacgagtggacgtcacctactaccaacccgtccctanaagacgccccgagttaccatactctagcaacacgtcccaagactcgtacgttctcccgtggtacgtcgacctcgtgtcgtacgtcgccgcgacgaccgtcgggtccgttagttacgttttcgtcggtacgacccgaaacgaaaccgacgaaaacggccaacgggtacccgtaccccttaaacttaactttaaacctttttaaaacgtttcggttaaacctttcgggtacgggggacccttaacgggggttccttaccccggttcgggtacccctaacccggttcctaccccttaccgtaaccgttcccccgttaaccccg

SEQ ID NO: 318671 - DNA, 682 bp, Homo sapiens
  misc_feature: GZ8MTXP01DRP9A.9.30.C08.1.454.CMB.2.raw
  modified_base (235)..(235): a, c, t, g, unknown or other
  misc_feature (235)..(235): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaacgccttcacacgaccctgtccctcacctgcactgtctctgtnactccatcaccgtactaatactactggagtgactccgccgacggccccccgggaaggccgtggaggtggattggactaccgtccttttacgagtggagtcacccttactacctaacccgtccctacgaagacgacccgtacgttaccatactctacgtaccgaactaccgtacccaagtaaactcctacgtttcctcccgtaggacggtcacctcgtgtagacctcggcccgtcgaacgtccgttcgggtccgttaggtttactttcgtcggtacgacccgaaggaacccgacgaaacgcacggtcctaaccttaacttaactttaaaaccgtttttaaacgtttcggtaccgtttttccgggacgggggtaccgttaacggggttccttccccggttgggttacccctccgtttcctcccttaccgaaccggttcccctaacccgg

SEQ ID NO: 318672 - DNA, 613 bp, Homo sapiens
  misc_feature: GZ8MTXP01BSL7O.9.30.C08.1.454.CMB.2.raw
  modified_base (236)..(236): a, c, t, g, unknown or other
  misc_feature (236)..(236): n is a, c, g, or t
  modified_base (387)..(387): a, c, t, g, unknown or other
  misc_feature (387)..(387): n is a, c, g, or t
  modified_base (431)..(431): a, c, t, g, unknown or other
  misc_feature (431)..(431): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagacccctgtcccctcacctgcactgtctctggtnactccatcaccgtactaattactactggagtggactccgccgacggccccccgggaaggcccgtggagtggattggacttacgtcttttacgagtgtagtccaccctactaccacccgtcctcaagcgacccctagttacatactctgtcnctacgtcccagactcgacgttctcccgtggtacgtcgactctgngactcgccgcacgccgtcggtcgttgttacgtttcgtgtcgaccgtaagaaccgacaacgcacgtcctaccttaacttaactttaaccttttaaacttcgtaccttcgggtcgggtaccgagggttccttcccggttcggtccctaaccggttcctcccgttacgtcgttccccgtaacccg

SEQ ID NO: 318673 - DNA, 645 bp, Homo sapiens
  misc_feature: GZ8MTXP01DO82Y.9.30.C08.1.454.CMB.2.raw
  modified_base (236)..(236): a, c, t, g, unknown or other
  misc_feature (236)..(236): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacacgacccctgtccctcacctgcactgtctctggtnactcatcacgtactaatactactggagttgactccgaccgacggccccccgggaaggcctggagtggattggactacgtccttttacgaggtggacgtccaccctactaccaaccccgtccctacaagacgccccgagttacagtactctacgtcaacaccgtcccaagtaactctacgtttcctccgtggtacgtcgacctcgtgtgacgtcgccgcgacgtaccgtcggtccgttgttacgttttcgtggttacgacccaaaggaaaccgacaaacggcgaacggtacccgtaccttaacgttaactttaaaccttttaaacgtttcgtaaccgtttcggtacggggccttaacgggttcttcccggtggtaccctccgttcctccgttacctcgttccctaacccg

SEQ ID NO: 318674 - DNA, 616 bp, Homo sapiens
  misc_feature: GZ8MTXP01ALN3T.9.30.C08.1.454.CMB.2.raw
  modified_base (236)..(236): a, c, t, g, unknown or other
  misc_feature (236)..(236): n is a, c, g, or t
  modified_base (272)..(272): a, c, t, g, unknown or other
  misc_feature (272)..(272): n is a, c, g, or t
  modified_base (379)..(379): a, c, t, g, unknown or other
  misc_feature (379)..(379): n is a, c, g, or t
  modified_base (414)..(414): a, c, t, g, unknown or other
  misc_feature (414)..(414): n is a, c, g, or t
  modified_base (451)..(451): a, c, t, g, unknown or other
  misc_feature (451)..(451): n is a, c, g, or t
  modified_base (468)..(468): a, c, t, g, unknown or other
  misc_feature (468)..(468): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagacccctgtcccctcacctgcactgtctctggtnactccatcaccggtataattactactggagttgganccgccacgccccccgggaaggcctggagtggattggatacgccttttacagtgagtcacctactacaacccgtccctcaaagacgccccgagttacatactctgtcncacgtcccagaatcagttctccctggagtgacctntcgtgactgccgcaggactcggccgttgtattttcgngtcgaccaagaaccganaaacgctaacgcctaccttaactaactttaaacttttaaaccgtttgtaaccgtttcggtacgggggtacccgaacggggttccttcccgttaacggtcccttaacccgttcccttacccttaccgtaaccgttaacccgtaaccccg

SEQ ID NO: 318675 - DNA, 695 bp, Homo sapiens
  misc_feature: GZ8MTXP01ALN6X.9.30.C08.1.454.CMB.2.raw
  modified_base (236)..(236): a, c, t, g, unknown or other
  misc_feature (236)..(236): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacacgacccctgtccctcacctgcactgtctctggtnactcatcaccgtactaatactactggagtggactcccgccgacggccccccggggaaggccgtggagtggtagttggacttaccgtccttttaacgaggttggacgtccacccttaacctaaccaaaccccgttccctacaaacgacgaccccgtaacgttaccattactctaacgtaccgaacaccgtacccaagtaactctacgttcctacccgtgggtacgtacgacccttcgtcggtcgaccgtcgcccgcacggtaccgtcgggtccgtttgttactttcgtggtccgaccgtaaagaaccgacgaaacgcaacggtccctaccttaacttaactttaaacttttaaaacgtttcgtaccgtttcggtaccgggggtacccaggggttccttccccggttgggtacccctaaccggttcccttcccgttacctaaccggttcccctaaccccgg

SEQ ID NO: 318676 - DNA, 636 bp, Homo sapiens
  misc_feature: GZ8MTXP01A3MBP.9.30.C08.1.454.CMB.2.raw
  modified_base (235)..(235): a, c, t, g, unknown or other
  misc_feature (235)..(235): n is a, c, g, or t
  modified_base (263)..(263): a, c, t, g, unknown or other
  misc_feature (263)..(263): n is a, c, g, or t
  modified_base (283)..(283): a, c, t, g, unknown or other
  misc_feature (283)..(283): n is a, c, g, or t
  modified_base (305)..(305): a, c, t, g, unknown or other
  misc_feature (305)..(305): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacacgacccctgtccctcacctgcactgtctctgtnactcatcacgtataatactatgagtganccgcgacgccccggaggccnggagtgatgatacgtctttacngtgactcacctactaccacccgtccacagacgacccgtagttaccatactctacgtaccaacacgtacccaagtaactctacgttcctcccgtaggacgtcgaccttcgtgtcgtaccgtcgcccgacgacggtaccgtccgggtaccgttcgtttacgtttcgtcggttacgacccgaagaaccgacgaaacgccaacgtcccgtaccttaacttaactttaaaccttttaaacgtttgtaaccgtttcggtacggggacccttacggggttcttccccggtaagggtccctaaccgttccctccgttacgaaccgttccccgtaacccg

SEQ ID NO: 318677 - DNA, 594 bp, Homo sapiens
  misc_feature: GZ8MTXP01EY5SO.9.30.C08.1.454.CMB.2.raw
  modified_base (234)..(234): a, c, t, g, unknown or other
  misc_feature (234)..(234): n is a, c, g, or t
  modified_base (264)..(264): a, c, t, g, unknown or other
  misc_feature (264)..(264): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtnactcatcacggtactatactactgagtganccgccacggccccccgggaaggcctggagtggattggatcgctttacagtggagtcacctactaccaccctcctacaagacgccccgagttaccatatctagtcgaacaccgtcccaagaactctacgttctcccgtaggtacggtcgacctctggtgtactcggcccgacgagacgtcggaccgttagttcttttcgtgtcgcccaaggaaccgcaaacgcgagccgtaccttacttaattaaactttttaaactttcgtaacttcggtaggggcccagggggttccttcccggtgtaccctccgttctccttcgaacgccctaacccg

SEQ ID NO: 318678 - DNA, 640 bp, Homo sapiens
  misc_feature: GZ8MTXP01CFQ65.9.30.C08.1.454.CMB.2.raw
  modified_base (235)..(235): a, c, t, g, unknown or other
  misc_feature (235)..(235): n is a, c, g, or t
  modified_base (324)..(324): a, c, t, g, unknown or other
  misc_feature (324)..(324): n is a, c, g, or t
  modified_base (430)..(430): a, c, t, g, unknown or other
  misc_feature (430)..(430): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagacccctgtccctcacctgcactgtctctggtnactccatcaccggtactaattactactggagttggactccgccacggccccccgggaagggcctggagtggattggatacgtcctttanagtgagtcacctactaccaacccgtcctacaagacgaccccgagttaccatatctagtcaacaccgtacccagaactcacgttcctacccgtggagtcgaccgttntcgtgaccttggacccgtcgaacgtacgtccgggccgtttgttactttcgtgtcaccgaagaaaccgcaaagccacgccgtaccttaacttaattaaacctttttaaacgtttcgtaaaccgttcggttacgggggaccttacgggggttaccttccccgtgggtaccctaacccggttcacccgttacgaaccgttccccgtaaccccg

SEQ ID NO: 318679 - DNA, 558 bp, Homo sapiens
  misc_feature: GZ8MTXP01EZGZQ.9.30.C08.1.454.CMB.2.raw
  modified_base (279)..(279): a, c, t, g, unknown or other
  misc_feature (279)..(279): n is a, c, g, or t
  modified_base (545)..(545): a, c, t, g, unknown or other
  misc_feature (545)..(545): n is a, c, g, or t
  modified_base (549)..(558): a, c, t, g, unknown or other
  misc_feature (549)..(558): n is a, c, g, or t
tcagtgatacgtctcacgaccggtgctcgatttagtctgacgtcaaagggaaagggttgtagtaggtgactccatcaccggtactaattactactggagttggatccgccagccccccgggaagggcctggagtggattggatacgccttttacagtggagtcacctactacaacccgtccctcaagagccgagttaccatatctgtcgacacgtcccagaatcagttctcctggaggtgacctctgtgactgccgcagactcgggccgtgtattttcngtgccagaacgcaaagcagcgctactatactttaaacttgacttcgtggggccaggggactcccgtggtccaccgtctccctcacgccctccaccgaacgggcccccccagtccggtcccttcccccgtggcccgccctcgcctcccgaggacgccaaccgtccgagacgcaacgaggccggccctggggcctcggccctgggtacaaacgggaccttacttccaggtacgtatccaacgtgacgcgggctgggcaaggcgactanaagnnnnnnnnnn

SEQ ID NO: 318680 - DNA, 583 bp, Homo sapiens
  misc_feature: GZ8MTXP01BUPB0.9.30.C08.1.454.CMB.2.raw
  modified_base (257)..(257): a, c, t, g, unknown or other
  misc_feature (257)..(257): n is a, c, g, or t
  modified_base (327)..(327): a, c, t, g, unknown or other
  misc_feature (327)..(327): n is a, c, g, or t
  modified_base (434)..(434): a, c, t, g, unknown or other
  misc_feature (434)..(434): n is a, c, g, or t
  modified_base (568)..(583): a, c, t, g, unknown or other
  misc_feature (568)..(583): n is a, c, g, or t
tcagtgatacgtctcacgaccggtgctcgatttagtctgacgtcaaagggaaagggttgtagtaggtgactccatcaccggtactaattactactggagttggatccgccagccccccgggaagggcctggagtggattggatacgccttttacagtggagtcacctactacaacccgtccctcaagagccgagttaccatatctgtcgacacgtcccagaatcagttctcctggaggtgacctctgtgactgccgnagactcgggccgttgtatttctgtgccagaacgcaaagcagcgcctactatactttaaacttgacttcgnggggccagggactccccgtggtcaccgtctcctcacgccctccaaccgaacgggcccccccagttccgggtccttccccccgtggcccgccctgccctccgagggcnccacccgtcgagacgcacgacggccggcccgtggggcctcggccgtcgggtacaaacgggtaccttaccgttcccgaaggggtaccgttaagtccacgttggacggcgggcgtgggcgaacgggcacgagtggnnnnnnnnnnnnnnnn

SEQ ID NO: 318681 - DNA, 565 bp, Homo sapiens
  misc_feature: GZ8MTXP01CD3EQ.9.30.C08.1.454.CMB.2.raw
  modified_base (234)..(234): a, c, t, g, unknown or other
  misc_feature (234)..(234): n is a, c, g, or t
  modified_base (469)..(469): a, c, t, g, unknown or other
  misc_feature (469)..(469): n is a, c, g, or t
  modified_base (482)..(482): a, c, t, g, unknown or other
  misc_feature (482)..(482): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtnactccatcaccggtactaattactactggagttggatccgccagccccccgggaaggcctggagtggattggatacgcctttactacgtggtagtctacctacctaacacccgtaccctccaacgagccccgagtactatatactcgtcgtcacgtcccacgaatactacgttctccctcggaggtgacctcctgtgtactcgcggcagactcgccgtgtatttctgttgccganaacgccaaagacncgcgcctactactaactttaaacttgtacttcttgggtcgaggacttccctggtctaaccgctcccttctaacgcgtaacccc

SEQ ID NO: 318682 - DNA, 633 bp, Homo sapiens
  misc_feature: GZ8MTXP01CLM1Q.9.30.C08.1.454.CMB.2.raw
  modified_base (237)..(237): a, c, t, g, unknown or other
  misc_feature (237)..(237): n is a, c, g, or t
  modified_base (274)..(274): a, c, t, g, unknown or other
  misc_feature (274)..(274): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacacgacccctgtcccctcacctgcactgtctctggtnactccatcaccggtactaattactactggagttgacnccgccacggcccccgggaaggcctggagtggattggactacgtctttacagtgacgtcacctactaccaaccccgtcctacaacgacgaccccgtagttaccatactcgtaacgtaccaacaccgtacccaagaactcacgttcctcccgtaggcgtcgacctcgtgtcgactcgccgcgacgacgtcggtccgttgtttacgtttcgtagtcgaccaagaacgacaaaggcctacggaccttactaacttaattaaaccttttaaacgttgtaaccttcggtacgggggacccttaggggttccttcccggtaaggttcccaaccgttccgtaccttaccgaaccgttccctaacccg

SEQ ID NO: 318683 - DNA, 737 bp, Homo sapiens
  misc_feature: GZ8MTXP01CYNNT.9.30.C08.1.454.CMB.2.raw
  modified_base (237)..(237): a, c, t, g, unknown or other
  misc_feature (237)..(237): n is a, c, g, or t
  modified_base (267)..(267): a, c, t, g, unknown or other
  misc_feature (267)..(267): n is a, c, g, or t
  modified_base (314)..(314): a, c, t, g, unknown or other
  misc_feature (314)..(314): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaacgccttcacacgaccctgtcccctcacctgcactgtctctggtnactccatcacgtactatactatgagtgacnccgcacggcccccgggaggccgtggagtggattggatacgtctttangtgacgtcacctactacaccctcctagaagcgacccgtagttacatactcgtacgtccaacaccgtacccagtaactcgtacgttcctacccgtagggacgttcgaccgttctaggttcgaacgttcggcccgacgtaacggacccgttccgggtaccggtttcgtttaacgggttttccgtcggggtttaccgaccccggaaaggtaaaccccgaacgtaaaaaccgggcctaacggggtaccccttaaacctttaacgtttaaaccttttaaaccctttttaaaacgtttccgggtaaaccttttccgggggtaaccgggggtaccccgttaaagggggttccctttccccggtaacggggttccccttaacccgggtcctttaccccgttaccgtaacccggttccccgttaacccccgg

SEQ ID NO: 318684 - DNA, 665 bp, Homo sapiens
  misc_feature: GZ8MTXP01A95MJ.9.30.C08.1.454.CMB.2.raw
  modified_base (235)..(235): a, c, t, g, unknown or other
  misc_feature (235)..(235): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtcccctcacctgcactgtctctggtnactccatcaccggtactaattactactggagtgatccgccacgcccccgggaaggcctggagtggatggatacgtctttacagtggatcacctactaccaacccgtcctacaagacgtccccgagttaccatactctagtcgcaccgtcccagtactctagttcctacccgtggacggtcaccctgtacgtgtaaccgtcggccgacgacgaccgtccgggtccgttggttacttttcgtggtccgacccgaaaggaaacccggacaaaacggccaaacgcccgtaaccttaaacttaactttaaccgttttaaaactttcggtaaccgtttcgggtacggggtcccttaaagggggttccttccccggttaaggggtcccctaacccgggtttccctcccttaccgaaccggtttccccctaaccccgg

SEQ ID NO: 318685 - DNA, 685 bp, Homo sapiens
  misc_feature: GZ8MTXP01BLGLL.9.30.C08.1.454.CMB.2.raw
  modified_base (236)..(236): a, c, t, g, unknown or other
  misc_feature (236)..(236): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacacgaccctgtcccctcacctgcactgtctctggtnactccatcaccggtactaattactactggtagtgactccgccgaccggcccccgggaaggccgtggaggtggtagtggactacgtcctttagagtggtactcacctactaccaccccgtcctacaacgacgacccgtacgttacatactctaacgtacgcaccgtacccaagtactcgtacgttcctacccgtagggtacgtcgaccttcgtgtacgtactcgccgcgacgaccgttcggtaccgtttgtttacgtttcgtggttaccgaaccgaaaggaaaccgacgaaaggcctaaacggtccgttaaccctttaaacgttaaacttttaaacccttttaaacgtttcggtaaccgtttcgggtcgggggaacccttaagggggttccttaccccggttgggtaccctcccggttcctaccttccgtaaccgttcccctaaccccgg

SEQ ID NO: 318686 - DNA, 733 bp, Homo sapiens
  misc_feature: GZ8MTXP01BV1BE.9.30.C08.1.454.CMB.2.raw
  modified_base (234)..(234): a, c, t, g, unknown or other
  misc_feature (234)..(234): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtnactccatcaccggtactaattactactggagtgatccgccacggccccccgggaaggcctggagtggtattggactaccgtccttttacagtggagtccacccttactaccaaccccgtccctacaacgacgaccccgtagttaccagttactccgtacgtaccgaacctaacccgtaccccaaaggtaaactccgtaacgtttccctccccggtagggtaacgttcggtaacccttcgttcggtagtaacccgtcgggccccgacgaaccggtaccgtccggggtcccgtttaggtttacttttcggtcggttacgacccgaaagtaaacccgacgtaaaacggccaacgcccggtacccttaaacttaaactttaaacctttttaaaacttttcggtaaaccgttttcggtacgggggtacccttagggggttaaccttcccggttaacgggttaccctaacccggttcctcccttaccgccgttcccctaaccccg

SEQ ID NO: 318687 - DNA, 612 bp, Homo sapiens
  misc_feature: GZ8MTXP01BPI64.9.30.C08.1.454.CMB.2.raw
  modified_base (234)..(234): a, c, t, g, unknown or other
  misc_feature (234)..(234): n is a, c, g, or t
  modified_base (263)..(263): a, c, t, g, unknown or other
  misc_feature (263)..(263): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtnactcatcacgtactaatactatgagtganccgccacgcccccgggaaggcctggagtggatggatacgtcctttacagtggatcacctactaccaacccgtcctacaaagacgcccgagttacatactctacgtacaacaccgtcccaagaactcacgttcctcccgtggagtcgacctctgtgacgtcgccgcacgacctcggtccgttagttacgtttcgtggtcgaccaaacgaaccgacaaagccaagccgtacctacttaattaacttttaaacgttcgtaaccgtttcggtacggggtaccttaaggggttccttcccggttaacgggtcctaacccggttcctcccttacgtaaccggttcccctaacccg

SEQ ID NO: 318688 - DNA, 541 bp, Homo sapiens
  misc_feature: GZ8MTXP01CI664.9.30.C08.1.454.CMB.2.raw
  modified_base (217)..(217): a, c, t, g, unknown or other
  misc_feature (217)..(217): n is a, c, g, or t
  modified_base (235)..(235): a, c, t, g, unknown or other
  misc_feature (235)..(235): n is a, c, g, or t
  modified_base (255)..(255): a, c, t, g, unknown or other
  misc_feature (255)..(255): n is a, c, g, or t
  modified_base (262)..(262): a, c, t, g, unknown or other
  misc_feature (262)..(262): n is a, c, g, or t
  modified_base (277)..(277): a, c, t, g, unknown or other
  misc_feature (277)..(277): n is a, c, g, or t
  modified_base (283)..(283): a, c, t, g, unknown or other
  misc_feature (283)..(283): n is a, c, g, or t
  modified_base (286)..(286): a, c, t, g, unknown or other
  misc_feature (286)..(286): n is a, c, g, or t
  modified_base (293)..(293): a, c, t, g, unknown or other
  misc_feature (293)..(293): n is a, c, g, or t
  modified_base (298)..(298): a, c, t, g, unknown or other
  misc_feature (298)..(298): n is a, c, g, or t
  modified_base (314)..(314): a, c, t, g, unknown or other
  misc_feature (314)..(314): n is a, c, g, or t
  modified_base (343)..(343): a, c, t, g, unknown or other
  misc_feature (343)..(343): n is a, c, g, or t
  modified_base (363)..(363): a, c, t, g, unknown or other
  misc_feature (363)..(363): n is a, c, g, or t
  modified_base (439)..(439): a, c, t, g, unknown or other
  misc_feature (439)..(439): n is a, c, g, or t
  modified_base (527)..(527): a, c, t, g, unknown or other
  misc_feature (527)..(527): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctccagatgggtcctgtcccaggtgcagctgcaggagtcgggcccaggactggtgaacgccttcacacgacccctgtccctnacctgcactgtctctggnactcatcacgtatatctacngagtgancgcacgcccggagcngagtgntgntctcttnagtgntcactacacacctcanagcgcccctatacatactctacgtcaacncgtcccaagactcagttccnccgtagggagtcaccgtgtagttcgactcgcctgacgtcgcgtacgttgttactttcgtagccgaactaggaaccnaaacgccagtcctactaacttaagtttaaaccttttaagttcgtacgtttcgcggggtacagttcttccgtgtaccgtcctcgtcacncgttcccctaaccg

SEQ ID NO: 318689 - DNA, 677 bp, Homo sapiens
  misc_feature: GZ8MTXP01CK8SC.9.30.C08.1.454.CMB.2.raw
  modified_base (216)..(216): a, c, t, g, unknown or other
  misc_feature (216)..(216): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagacccctgtccctnacctgcactgtctctggtgactccatccaccggtacttaattactactggagttggactccgccgacggccccccgggaaggccgtggagtggagttggatacgtctttacgagtgagtcacctacaccacccgtcctacgacgacgcccccgtagttaccatactctagtaccgaaccaccgtcccgaagtactctacgttcctcccgtagggtacggtcaccgttcgtgtcgactcggccgacacgtaccgtcggtaccgttgttactttcgtggttcacccgaagaaccgcaaagccgtaacgtccgtacccttaacttaactttaaaccttttaaacgtttcgttaaccgtttcgggtaccgggggtaccgttacggggttccttaccccggttggtaccccgttaacccggttccccttcccgttacctaacccggttccccgtttaacccccggg

SEQ ID NO: 318690 - DNA, 526 bp, Homo sapiens
  misc_feature: GZ8MTXP01BPZPJ.9.30.C08.1.454.CMB.2.raw
  modified_base (297)..(297): a, c, t, g, unknown or other
  misc_feature (297)..(297): n is a, c, g, or t
  modified_base (370)..(370): a, c, t, g, unknown or other
  misc_feature (370)..(370): n is a, c, g, or t
  modified_base (510)..(526): a, c, t, g, unknown or other
  misc_feature (510)..(526): n is a, c, g, or t
tcagtgatacgtctcacgaccggtgctcgatttagtctgacgtcaaagggaaagggtctgtgaagccttcacagaccctgtccctcacctgcactgtctctggtgactccatcaccggtactaattactactggagttggatccgccagccccccgggaagggcctggagtggattggatacgccttttacagtggagtcacctactacaaccaaaggcagccccgagaaccacaggtgtacacccctgccccccagaacgcaaagcagcgcctactatactttaaacttgacttcnggggccagggactcccgtgtccaccgtctcctcacgccctccaccaacggcccagtccggtcctttcccccgnggccgcccctgcctccaggcgccaccgtcccgagacgacacgcgccgggtccctgggcctggcctgggtacaacggtacctacctccgagaccgtatcgacgtggacggcggggactgggacaacgggcggaccagtagnnnnnnnnnnnnnnnnn

SEQ ID NO: 318691 - DNA, 694 bp, Homo sapiens
  misc_feature: GZ8MTXP01CJOZZ.9.30.C08.1.454.CMB.2.raw
  modified_base (235)..(235): a, c, t, g, unknown or other
  misc_feature (235)..(235): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctccagatgggtcctgtcccaggtgcagctgcaggagtcgggcccaggactggtgaagccttcacacgaccctgtcccctcacctgcactgtctctggtnactccatcaccggtactaattactactggagttggactcccgccacggccccccggggaaagggcccgtaggacgtggattggatacgtcttttacagtggagtcacctactaccaacccgtcctacaaacgacgacccccgacgttaccattactcctagtaccgaaccgaccgttaccccaaagtaactccaagtttcctccccgttggggacgtacgtaacccttcgtggttacggacttcggccgacgacggaccgtccggccgttgtttacgttttcctaggttcgaccgaagaaaccgacaaaaggtccaacgccgtaccctaaacttaacttaaaccgtttttaaaactttcggttaaaccgttccgttacgggggtcccttaaacggggttccttccccggttaagggtccctaaccccggttctaccccgttccaaccgccctaaccccg

SEQ ID NO: 318692 - DNA, 692 bp, Homo sapiens
  misc_feature: GZ8MTXP01DG0I4.9.30.C08.1.454.CMB.2.raw
  modified_base (238)..(238): a, c, t, g, unknown or other
  misc_feature (238)..(238): n is a, c, g, or t
  modified_base (387)..(387): a, c, t, g, unknown or other
  misc_feature (387)..(387): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccggatgggtcctgtcccaggtgcagctgcaggagtcgggcccaggactggtgaagccttcacagacccctgtccctcacctgctactcgtctcgtggtnactccatcaccgtactaattactacgtggagttgactccgccgacggcccccgggaaggcctggagtggatggactacgtctttagagtgacgtacacctactaaccacccgtcctacaagacgccgtacgtaccatatctgtaccacncgtcccaagaactcacgttctccgtagggacgtcgaccttcgtcgtagaccgtcgcccgacgtacggacctccgggacgttgtttactttccggtaggtccgaccgaacggaaaccgacaaaacggccgaaacggtcccgtaacctttaaacttaacttttaaaccgttttaaacgtttcggttaaaccgtttccgggttcgggggtaacccgtacgggggttaacctttccccgggttcgggttaacccctacccggtttccttacccctacgacccggttccccttaacccgtaaaccccggg

SEQ ID NO: 318693 - DNA, 993 bp, Homo sapiens
  misc_feature: GZ8MTXP01BJ96Q.9.30.C08.1.454.CMB.2.raw
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctccagatgggtcctgtccaggtgcagctgcaggagtcgggcccaggactggtgaacgtccttacacacgtacccctcgtcccctcacctgcctacttgtctcgtggtcacctccacttccgaaccggttaacttaaattactacgtggtagttcggactcccgaccgacccgggtaccccccggggaaagggtcccgtagggtacggttaggtacgtttacggggtaaccttaaccggtttaccccgttttttaacggacgggttacggggtaacccgtttaccccgtaaaccccctttaaacccgttaaacccccggtaaaacccccccggtttacccccgttaaacggaaaacgggtaaccgggttaacccccccggttaaacggttttaaaccctaaagtttaaaccgttcccggtttaacccgggttaacccgaacccgtaacccgggttaaccccctaaaggttaaaccttccgttaacgggtttccccgttaccccgggttaggggtaaccggttcgtaaccccgttgttacgggtacgtaaccgtccggccgtacgtacggtaccggtccggtaccgtttgttacgggtttcgtacgggtaccgaaccggttaaacggaaacccggaacaaaacggtccggtaacggtccccgttaacctttaaaaccgtttaaacttttaaaacccgttttttaaacggtttcggtaaaccccgggtttcggggttaacccgggggaaccctttaaacgggggttcccctttaccccgggttcggggttaaccccttaaccccgggtttcccttcccccgttaccggtaaccccggttaacccccttaaacccccgggg

SEQ ID NO: 318694 - DNA, 511 bp, Homo sapiens
  misc_feature: GZ8MTXP02HHJG3.9.30.C08.1.454.CMB.2.raw
  modified_base (399)..(399): a, c, t, g, unknown or other
  misc_feature (399)..(399): n is a, c, g, or t
  modified_base (475)..(475): a, c, t, g, unknown or other
  misc_feature (475)..(475): n is a, c, g, or t
  modified_base (503)..(511): a, c, t, g, unknown or other
  misc_feature (503)..(511): n is a, c, g, or t
tcagtgatacgtctcacgaccggtgctcgatttagtctgacgtcaaagggaaagggttgtagtaggtgactccatcaccggtactaattactactggagttggatccgccagccccccgggaagggcctggagtggattggatacgccttttacagtggagtcacctactacaacccgtccctcaagagccgagttaccatatctgtcgacacgtcccagaatcagttctccctggaggtgacctctgtgactgccgcagactcggccgtgtatttctgtgccagaacgcaaagcagcgcctactatactttaaactttgacttctggggccagggatccctggtcaccgtctcctcagcctccaccaagggccccccatccggtcttccccctggccnccctgcctccaggacgccacctccgagagcacagccggccctggggctcgcctggtcagactacttccagacgtancactgagcgggctggcaaggcgcatagnnnnnnnnn

SEQ ID NO: 318695 - DNA, 619 bp, Homo sapiens
  misc_feature: GZ8MTXP02G0X12.9.30.C08.1.454.CMB.2.raw
  modified_base (234)..(234): a, c, t, g, unknown or other
  misc_feature (234)..(234): n is a, c, g, or t
  modified_base (312)..(312): a, c, t, g, unknown or other
  misc_feature (312)..(312): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtnactcatcacgtactaatactactggatggatccgccacgccccccggaaggcctggagtggattggatacgtctttanagtgagtcactactacaacccgtcctacaagagcccgagttaccatatctgtcgacacgtacccagaatcagttcctccctggacgtcgacctctgtgtactcgcccgcacgacctcgggccgttgttacgttttcctggtcgacccaaggaaaccgacaaaaggccgaacgccgtacccttaactaaactttaacctttttaaaaactttggtaaacctttcggacgggggtaccctaacgggggtaccttccccgtgggtaccctaacccggttcctccctacgtaaccggtccctaaaccccgg

SEQ ID NO: 318696 - DNA, 533 bp, Homo sapiens
  misc_feature: GZ8MTXP02H3Q1H.9.30.C08.1.454.CMB.2.raw
  modified_base (402)..(402): a, c, t, g, unknown or other
  misc_feature (402)..(402): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtgactcatcaccgtactaattacactggagtggatccgccagccccccggaaggcctggagtggattggatacgctttacagtgagtcactactacaaccgtcctcaagagccccgagttaaccatatctgtcgacacgtcccagaatcaagtctccctgagtgacctcngtgactgccgcagactcggccgtgtatttctgtgccagaacgcaaaagcaagtcaccctaataatactttaaaactttgaacttcgtcggggaccaggggactcccgtggtcaccgtctcctcacgcaccc

SEQ ID NO: 318697 - DNA, 564 bp, Homo sapiens
  misc_feature: GZ8MTXP02FV4P3.9.30.C08.1.454.CMB.2.raw
  modified_base (234)..(234): a, c, t, g, unknown or other
  misc_feature (234)..(234): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtnactccatcaccggtactaattactactggagttggatccgccacgccccccgggaagggcctggagtggattggatacgccttttacagtgagtcacctactacaaccccgtcctacaagacgccccgagtaccatatctgtcgacaccgtcccagaaatccagtttctccctggacggtcgacctctgtgactcgccgcagactcggccgtgtatttctgtcgcagaacgcaaagcagcgactactattaactttaaacttgaactttcgtacgggggtaccaggggacttccccgtaaggtcctaccgtctcctcacgtccctacccg

SEQ ID NO: 318698 - DNA, 562 bp, Homo sapiens
  misc_feature: GZ8MTXP02J1KQN.9.30.C08.1.454.CMB.2.raw
  modified_base (383)..(383): a, c, t, g, unknown or other
  misc_feature (383)..(383): n is a, c, g, or t
  modified_base (492)..(492): a, c, t, g, unknown or other
  misc_feature (492)..(492): n is a, c, g, or t
  modified_base (561)..(561): a, c, t, g, unknown or other
  misc_feature (561)..(561): n is a, c, g, or t
tcagtgatacgtctcacgaccggtgctcgatttagtctgacgtcaaagggaaagggtctgtgaagccttcacagaccctgtccctcacctgcactgtctctggtgactccatcaccggtactaattactactggagttggatccgccagccccccgggaagggcctggagtggattggatacgccttttacagtggagtcacctactacaacccgtccctcaagagccgagttaccatatctgtcgacacgtcccagaatcagttctccctggagtgacctctgtgactgccgcagactcggccgtgtatttctgtgccagaacgcaaagcagcgcctatatactttaaattgacttcgtggggccagggactcccgtggtcnccgtctcctcagccctccaaccgaacgggcccacgtccggtcccttcccccgtggcccgccctcgccgtcccacggacgccacccgtccgagacgcacacggccgcccngggctcgccgtggtcaaggctaccgtcagacgtactcacgtgacggcggcgcggacacggcgcacgagng

SEQ ID NO: 318699 - DNA, 519 bp, Homo sapiens
  misc_feature: GZ8MTXP02JHT33.9.30.C08.1.454.CMB.2.raw
  modified_base (277)..(277): a, c, t, g, unknown or other
  misc_feature (277)..(277): n is a, c, g, or t
  modified_base (419)..(419): a, c, t, g, unknown or other
  misc_feature (419)..(419): n is a, c, g, or t
  modified_base (505)..(505): a, c, t, g, unknown or other
  misc_feature (505)..(505): n is a, c, g, or t
  modified_base (508)..(519): a, c, t, g, unknown or other
  misc_feature (508)..(519): n is a, c, g, or t
tcagtgatacgtctcacgaccggtgctcgatttagtctgacgtcaaagggaaagggttgtagtaggtgactccatcaccggtactaattactactggagttggatccgccagccccccgggaagggcctggagtggattggatacgccttttacagtggagtcacctactacaacccgtcctcaagagccgagttaccatatctgtcgacacgtcccagaatcagttctccctggaggtgacctctgtgactgccgcagactcggccgtgtatttcngtgccagaacgcaaagcagcgcctactatactttaaacttgactttctggggccagggactccctggtcaccgtctcctcacgcctccaccaagggccccccatccggtccttcccccgtggccgccctgcctccagggacncacctccgagacgcacacgccggccctggggctcgcctggtcaaagctactccagacgtatcactgacgcggctggcaaggcgcanagnnnnnnnnnnnn

SEQ ID NO: 318700 - DNA, 575 bp, Homo sapiens
  misc_feature: GZ8MTXP02F03D2.9.30.C08.1.454.CMB.2.raw
  modified_base (430)..(430): a, c, t, g, unknown or other
  misc_feature (430)..(430): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtgactccatcacggtactaatactactggagttggatccgccacggccccccgggaaggcctggagtggattggatacgccttttacagtggagtcacctactacaacccgtccctcaagacgccccgagttaccatatctcgtcgacacgtcccagaactcagttcctccctggagtcgacctcgtgtgactgccgntagactcggccgttgtatttccgtgtcgccaggaaccgcaaaacgcaagcgaccttaactactttaactttaaaacgtttcgaactttcgtacggggcctaaggggcttcccgtggtccaccgttctacctcgactccctacccg

SEQ ID NO: 318701 - DNA, 547 bp, Homo sapiens
  misc_feature: GZ8MTXP02GMSP2.9.30.C08.1.454.CMB.2.raw
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtgactccatcaccggtactaattactactggagttggatccgccagccccccgggaaggcctggagtggattggatacgccttttacagtggagtcacctactacaacccgtcctcaagagccccgagttaccatatctgtcgcacgtcccagaatcagttcctccctggagtgacctctgtgactgccgcacgactcggccgtgtatttctgtgcccagaacgcaaaagcaagcgacctactattaactttaaacttgaactttcgcggggaccagggactcccgtgtccaccgtctcctcacgtccctacccg

SEQ ID NO: 318702 - DNA, 578 bp, Homo sapiens
  misc_feature: GZ8MTXP02GI2VE.9.30.C08.1.454.CMB.2.raw
  modified_base (234)..(234): a, c, t, g, unknown or other
  misc_feature (234)..(234): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtnactccatcaccggtactaattactactggagttggatccgccacggccccccgggaaggcctggagtggattggatacgccttttacagtggagtcacctactacacccgtcctcaagcgccccgagttaccatactctgtcgacacgtcccaagatcagttctccctggagtcgacctctgtgactcgccgcacgactcggccgtgttactttctgtcgccaagaaccgcaaagcaacgccgacctaactaacttaaccttttaaaacgtttgtaactttcgtacggggtacctaggggtacttcccgtggtcctaccgttcctcctacgacgtccctacccg

SEQ ID NO: 318703 - DNA, 605 bp, Homo sapiens
  misc_feature: GZ8MTXP02G5V65.9.30.C08.1.454.CMB.2.raw
  modified_base (414)..(414): a, c, t, g, unknown or other
  misc_feature (414)..(414): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtgactccatcaccggtactaattactactggagttggatccgccacggccccccgggaaggcctggagtggattggatacgcctttacagtgagtcacctactacaacccgtcctacaagacgcccgagttaccatactctgtcgacacgtccagaactcagttctccctggacgtcacctntgtgactcgccgcagactcggccgttgttactttcgtgtcgacccaagaaccgacaaaagcaagccgtacctaacttaacttaaacctttttaaaactttcgaaaccttttcggacgggggtccctaaacgggggtcttccccgttgggtaccctaccggttcttacccttcgaccgttaccctaaccccg

SEQ ID NO: 318704 - DNA, 567 bp, Homo sapiens
  misc_feature: GZ8MTXP02IFGV4.9.30.C08.1.454.CMB.2.raw
  modified_base (265)..(265): a, c, t, g, unknown or other
  misc_feature (265)..(265): n is a, c, g, or t
  modified_base (361)..(361): a, c, t, g, unknown or other
  misc_feature (361)..(361): n is a, c, g, or t
  modified_base (384)..(384): a, c, t, g, unknown or other
  misc_feature (384)..(384): n is a, c, g, or t
  modified_base (485)..(485): a, c, t, g, unknown or other
  misc_feature (485)..(485): n is a, c, g, or t
  modified_base (567)..(567): a, c, t, g, unknown or other
  misc_feature (567)..(567): n is a, c, g, or t
tcagtgatacgtctcacgaccggtgctcgatttagtctgacgtcaaagggaaagggtctgtgaagccttcacagaccctgtccctcacctgcactgtctctggtgactccatcaccggtactaattactactggagttggatccgccagccccccgggaagggcctggagtggattggatacgccttttacagtggagtcacctactacaacccgtccctcaagagccgagttaccatatctgtcgacacgtccagatcagttcnccctggaggtgacctctgtgactgccgcagactcggccgtgtatttctgtgccagaacgcaaagcagcgcctatataactttaaacttgacttcgnggggccagggctcccgtggtccnccgtcctcctcacgccctaccacgaaacgggccctagtccggtcccttcccccgtcggcccgtccctcgcctccgacggacgccacctccgagacgcaacncggccgcccgtggctcgccgtggcgaaggacctacttccaggactactcacgtggagcgggcgtcggacgacggcgcgatgn

SEQ ID NO: 318705 - DNA, 662 bp, Homo sapiens
  misc_feature: GZ8MTXP02H126D.9.30.C08.1.454.CMB.2.raw
  modified_base (353)..(353): a, c, t, g, unknown or other
  misc_feature (353)..(353): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagacccctgtccctcacctgcactgtctctggtgactccatcaccggtactaattactactggagttggactccgccacgccccccgggaaggcctggacgtggatggatacgtctttacagtgatcactacgtacaccgtcctacaagacnccccgagttaaccagtactctgtcgacaccgtcccaagtaactccacgtttcctcccgtggtaacggtcgtaacccttcgtagtcgtaccgttcgacccgcaaccggtaccgttccggggacccgttggtttaacttttccgttgtcgaccgaacggaacgaaccgaaaagccgaaggcccgtacccttaaactaaactttaaccttttaaaacgtttcggaaaccttttcggacggggttacccgacgggggtaccttccccgttaaggtccctaaccggtcctaccctcgaccgtaccctaaccccg

SEQ ID NO: 318706 - DNA, 489 bp, Homo sapiens
  misc_feature: GZ8MTXP02F3R24.9.30.C08.1.454.CMB.2.raw
  modified_base (405)..(405): a, c, t, g, unknown or other
  misc_feature (405)..(405): n is a, c, g, or t
  modified_base (479)..(489): a, c, t, g, unknown or other
  misc_feature (479)..(489): n is a, c, g, or t
tcagtgatacgtctcacgaccggtgctcgatttagtctgacgtcaaagggaaagggtctgtgaagccttcacagaccctgtccctcacctgcactgtctctggtgactccatcaccggtactaattactactggagttggatccgccagccccccgggaagggcctggagtggattggatacgccttttacagtggagtcacctactacaaccaaagggcagccccgagaaccacaggtgtacaccctgcccccagaacgcaaagcagcgcctactatactttaaacttgacttctggggccagggactccctggtcaccgtctcctcacgcctccaccaacgggccccatccggtccttcccccgtggccgcccctgcctccaggcgccacctcgagcgccacnggccggccctggggcctcgctggtcaaggactactccagacgtatcactgagcgggctggcaaggcgcagtagnnnnnnnnnnn

SEQ ID NO: 318707 - DNA, 499 bp, Homo sapiens
  misc_feature: GZ8MTXP02G7LSM.9.30.C08.1.454.CMB.2.raw
  modified_base (278)..(278): a, c, t, g, unknown or other
  misc_feature (278)..(278): n is a, c, g, or t
  modified_base (391)..(391): a, c, t, g, unknown or other
  misc_feature (391)..(391): n is a, c, g, or t
  modified_base (402)..(402): a, c, t, g, unknown or other
  misc_feature (402)..(402): n is a, c, g, or t
  modified_base (487)..(499): a, c, t, g, unknown or other
  misc_feature (487)..(499): n is a, c, g, or t
tcagtgatacgtctcacgaccggtgctcgatttagtctgacgtcaaagggaaagggttgtagtaggtgactccatcaccggtactaattactactggagttggatccgccagccccccgggaagggcctggagtggattggatacgccttttacagtggagtcacctactacaacccgtccctcaagagccgagttaccatatctgtcgacacgtcccagaatcagttctccctggaggtgacctctgtgactgccgcagactcggccgtgtatttcngtgccagaacgcaaagcagcgcctactatactttaaactttgacttctggggccaggggatcccctggtcaccgtctcctcagcctccaccaggccccatcgtctcccctgcncctgctcagancactccgagagcacagcgccctgggctgcctggtcaggctacttccagacgtatcactgagcgggactggcaaggcgacagtagnnnnnnnnnnnnn

SEQ ID NO: 318708 - DNA, 464 bp, Homo sapiens
  misc_feature: GZ8MTXP02G8XEU.9.30.C08.1.454.CMB.2.raw
  modified_base (394)..(394): a, c, t, g, unknown or other
  misc_feature (394)..(394): n is a, c, g, or t
  modified_base (460)..(464): a, c, t, g, unknown or other
  misc_feature (460)..(464): n is a, c, g, or t
tcagtgatacgtctcacgaccggtgctcgatttagtctgacgtcaaagggaaagggtctgtgaagccttcacagaccctgtccctcacctgcactgtctctggtgactccatcaccggtactaattactactggagttggatccgccagccccccgggaagggcctggagtggattggatacgccttttacagtggagtcacctactacaaccaaagggcagccccgagaaccacaggtgtacaccctgcccccagaacgcaaagcagcgcctactatacttaaacttgacttctggggccagggatccctggtcaccgtctcctcagcctccaccaagggcccatcggtcttccccctggcgcccctgctccaggacgcacctcgagagcacngcgccctgggctgcctggtcaaggctactccagacgtatcactgagcgggctggcaggcgcatagnnnnn

SEQ ID NO: 318709 - DNA, 533 bp, Homo sapiens
  misc_feature: GZ8MTXP02JXNV8.9.30.C08.1.454.CMB.2.raw
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagacccctgtccctcacctgcactgtctctggtgactccatcaccggtactaattactactggagttggatccgccacggccccccgggaaggcctggagtggattggatacgcctttacagtggagtcacctactacaacccgtcctacaagacgccccgagttaccatatctgtcgacacgtcccagatcagtttctccctggagtcgacctctgtgactgccgcagactcggcctgtattctgtgccagacgcaaagcagcgctatattactttaaacttgacttcgtcgggccagggactccgtgtcaccgtctcctcacgcctaccg

SEQ ID NO: 318710 - DNA, 588 bp, Homo sapiens
  misc_feature: GZ8MTXP02HVAJG.9.30.C08.1.454.CMB.2.raw
  modified_base (454)..(454): a, c, t, g, unknown or other
  misc_feature (454)..(454): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggccccaggactggtgaagccttcacagacccctgtcccctcacctgcactgtctctggtgactccatcaccggtactaattactactggagttgatccgccacgcccccggaaggcctggagtggattggatacgcctttacagtggagtcactactacaacccgtcctcaagacgccccgagttaccatactctgtcgcacgtcccagactcagtttctccctggacgtcactctgtcgactcgccgcagacctcggccgtgttattttcgtgtcnccgaagaacgcaaaagcaaggccgcctaacttacttaacctttttaaaactttcggtaacctttcgttacgggggaccctaaggggtactccccgttggtacccaccggttcctccgtcctacgcccctacccg

SEQ ID NO: 318711 - DNA, 549 bp, Homo sapiens
  misc_feature: GZ8MTXP02F7QCK.9.30.C08.1.454.CMB.2.raw
  modified_base (234)..(234): a, c, t, g, unknown or other
  misc_feature (234)..(234): n is a, c, g, or t
  modified_base (317)..(317): a, c, t, g, unknown or other
  misc_feature (317)..(317): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtnactccatcaccggtactaattactactggagttggatccgcagccccccgggaaggcctggagtggattggatacgcctttanagtggagtcacctactacaacccgtcctcaagagccccgagttaccatatctgtcgcacgtcccagatcagttctccctggagtgacctctgtgactgccgcagactcggccgtgtatttcctgtcgtccaagaaccgacaaagcaagcgcctaactattaactttaaaactttgactttcgtcggggccaggggactcccgtggtcctaccgtctcctcacgtcctacccg

SEQ ID NO: 318712 - DNA, 589 bp, Homo sapiens
  misc_feature: GZ8MTXP02H3E4K.9.30.C08.1.454.CMB.2.raw
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtgactccatcaccggtactaattactactggagttggactccgccacggcccccgggaaggcctggagtggattggatacgtctttacgagtggagtcactactaccaacccgtcctacaacgacgcccgagttaccatactctgtcacaccgtccagaactctacgttcctcccgtggagtcgaccctcgtgtgactcgccgcacgaccgtcggccgttagtttactttcgtgtcgaccaggaacacaaagcaagccgacttactaatttactttaaaactttgaactttcggtcgggaccaggggtaccttcccgtcggtacctacccggttcctaccgtccacgtcccaacccg

SEQ ID NO: 318713 - DNA, 540 bp, Homo sapiens
  misc_feature: GZ8MTXP02GFY5N.9.30.C08.1.454.CMB.2.raw
  modified_base (234)..(234): a, c, t, g, unknown or other
  misc_feature (234)..(234): n is a, c, g, or t
  modified_base (448)..(448): a, c, t, g, unknown or other
  misc_feature (448)..(448): n is a, c, g, or t
  modified_base (512)..(512): a, c, t, g, unknown or other
  misc_feature (512)..(512): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtnactccatcaccggtactaattactactggagtggatccgccacggccccccgggaaggcctggagtggattggatacgcctttacagtgagtcacctactaccaacccgtcctcaagagcccgagttaccatactctgtcgacacgtcccagaatcagttctccctggacgtgacctctgtgactgccgcagactcggccgtgtatttctgtcnccagaacgcaaagcagcacctatatactttaaaacttgacttcgcggggccaaggggctcccgnggttccaccgtctcctcacgcctacccg

SEQ ID NO: 318714 - DNA, 621 bp, Homo sapiens
  misc_feature: GZ8MTXP02JUJAP.9.30.C08.1.454.CMB.2.raw
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagacccctgtccctcacctgcactgtctctggtgactcatcaccggtactaattactactggagttggactccgccacggccccccgggaaggccgtggagtggattggatacgtctttacagtggagtcacctactaccaacccgtcctacaagacgccccgtagttaccatactctagtcgaccaccgtcccaagaactcacgtttcctcccgtcggtacggtcgtacctcgtgtcgtacgtcgccgcgacgacgtccggtccgtcgttacgtttcgttgtcgtaccgaacgaacgacgaaacgacgacgacgtacctactaacttaactttaaactttacggggggggttacttacgtacgggtccgtacggtacgtccgtcggtccgtaccgttccgtcctcctaccgcctacccg

SEQ ID NO: 318715 - DNA, 506 bp, Homo sapiens
  misc_feature: GZ8MTXP02ID1CS.9.30.C08.1.454.CMB.2.raw
  modified_base (278)..(278): a, c, t, g, unknown or other
  misc_feature (278)..(278): n is a, c, g, or t
  modified_base (395)..(395): a, c, t, g, unknown or other
  misc_feature (395)..(395): n is a, c, g, or t
  modified_base (499)..(506): a, c, t, g, unknown or other
  misc_feature (499)..(506): n is a, c, g, or t
tcagtgatacgtctcacgaccggtgctcgatttagtctgacgtcaaagggaaagggttgtagtaggtgactccatcaccggtactaattactactggagttggatccgccagcccccccgggaagggcctggagtggattggatacgccttttacagtggagtcacctactacaacccgtccctcaagagccgagttaccatatctgtcgacacgtcccagaatcagttctccctggagtgacctctgtgactgccgcagactcggccgtgtatttcngtgccagaacgcaaagcagcgcctactatactttaaactttgacttctggggccagggatccctggtcaccgtctcctcagcctccaccaggcccccatccggtctccccctggccnccctgctccaggagccacctccgagagcacagccggccctgggctgcctggtcaggactacttccgacgtatcactgagcgggactggcaagggcgacgatagnnnnnnnn

SEQ ID NO: 318716 - DNA, 648 bp, Homo sapiens
  misc_feature: GZ8MTXP02HC5RU.9.30.C08.1.454.CMB.2.raw
  modified_base (235)..(235): a, c, t, g, unknown or other
  misc_feature (235)..(235): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagacccctgtccctcacctgcactgtctctggtnactccatcaccggtactaattactactggagttggactccgccacggccccccgggaagggcctggagtggattggatacgtcctttacgagtggacgtcacctactaccaaccccgtcctacaagacgaccccgtagttacccatactctcgttacgaccgaccgttacccaaagaacttccgtaacgtttcctccccgtagggaacggttcgtaacccttcgtggtcgtactcgcccgacacgtaccgtccggtccgttgttactttcgtgtcgaccaagaaaccgacgaaaagcaacgccgtacctactaactttaacttttaaaactttgtacctttcggtacgggtcctaacggggtaccttcccgtcggttaccctaccgttcctcccgtcaccgtcccctaacccg

SEQ ID NO: 318717 - DNA, 596 bp, Homo sapiens
  misc_feature: GZ8MTXP02H32KO.9.30.C08.1.454.CMB.2.raw
  modified_base (440)..(440): a, c, t, g, unknown or other
  misc_feature (440)..(440): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtcccctcacctgcactgtctctggtgactccatcaccggtactaattactactggagttgactccgccacggccccccggggaaggccgtggacgtggattggatacgccttttacagtgagtcaacctactacaacccgtcctacaaagacgcccgagttaccatactctgtacgcaccgtcccaagaactcacgttctccctggacgtgaccctctgtcgactcgccgnacgactcgggccttgtactttcgtgtcgaccagaaacgcaaagcagaccgtactaactaattaaccttttaaaacgtttgacttcgtacggggacctaacgggtcttccccgtggtaccctacccgttctacccgtaccgacgtaccccgtacccg

SEQ ID NO: 318718 - DNA, 571 bp, Homo sapiens
  misc_feature: GZ8MTXP02H9WLU.9.30.C08.1.454.CMB.2.raw
  modified_base (265)..(265): a, c, t, g, unknown or other
  misc_feature (265)..(265): n is a, c, g, or t
  modified_base (280)..(280): a, c, t, g, unknown or other
  misc_feature (280)..(280): n is a, c, g, or t
  modified_base (334)..(334): a, c, t, g, unknown or other
  misc_feature (334)..(334): n is a, c, g, or t
  modified_base (358)..(358): a, c, t, g, unknown or other
  misc_feature (358)..(358): n is a, c, g, or t
  modified_base (391)..(391): a, c, t, g, unknown or other
  misc_feature (391)..(391): n is a, c, g, or t
  modified_base (433)..(433): a, c, t, g, unknown or other
  misc_feature (433)..(433): n is a, c, g, or t
  modified_base (454)..(454): a, c, t, g, unknown or other
  misc_feature (454)..(454): n is a, c, g, or t
  modified_base (468)..(468): a, c, t, g, unknown or other
  misc_feature (468)..(468): n is a, c, g, or t
tcagtgatacgtctcacgaccggtgctcgatttagtctgacgtcaaagggaaagggtctgtgaagccttcacagaccatgtccctcacctgcactgtctctggtgactccatcaccggtactaattactactggagttggatccgccacggcccccgggaaggcctggagtggattggatacgccttttacagtggagtcacctactacaacccgtcctacaagagccgattaccatatctgtcgacacgtccagaatcagttcncctggagtcgacctngtgactgccgcagactcggcgtgttatttctgtcgaccagaacgcaaagcagcnctatatactttaacttgaccttgngggcagggtactcccgtggtccaccgtctcctnacgccctcaacccgaacgggcccagtccggtcccttccccgnggccgccctgcctccgagacnccaccgtcgagacncacgacgccggccgtggcctcgaccgtggtacgaaacggtctacgttccgaagtaccgtactacgacgtcggacgtcggcgtaggacgaacggcgactagacg

SEQ ID NO: 318719 - DNA, 625 bp, Homo sapiens
  misc_feature: GZ8MTXP02G7DFT.9.30.C08.1.454.CMB.2.raw
  modified_base (235)..(235): a, c, t, g, unknown or other
  misc_feature (235)..(235): n is a, c, g, or t
  modified_base (317)..(317): a, c, t, g, unknown or other
  misc_feature (317)..(317): n is a, c, g, or t
  modified_base (341)..(341): a, c, t, g, unknown or other
  misc_feature (341)..(341): n is a, c, g, or t
  modified_base (401)..(401): a, c, t, g, unknown or other
  misc_feature (401)..(401): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcagggagtcgggcccaggactggtgaagccttcacagaccctgtccctcacctgcactgtctctggtnactcatcacggtactaattactactggagtgactccgccacggacccccgggaggcctggacgtggatggatacgtctttanagtgatcactactacaccgtccanaacgcgcccgagtaccatatctgtcacacgtccaagactcacgttcctcccgtggagtcncctacgtgtacgactcgccgcgacgaccgtcggacgttgttactttcgtggtacaccgaagaaccgtacgaaacgacgacggacctaccttaaactaactttaacctttaaaacgtttcggtaaacctttacgggtaccggggtaccgtaaacggggtcccttacccggtcgggttaaccctacccggttaccctcccttaccgaccggtacccctaaccccgg

SEQ ID NO: 318720 - DNA, 576 bp, Homo sapiens
  misc_feature: GZ8MTXP02FU8FD.9.30.C08.1.454.CMB.2.raw
  modified_base (235)..(235): a, c, t, g, unknown or other
  misc_feature (235)..(235): n is a, c, g, or t
  modified_base (402)..(402): a, c, t, g, unknown or other
  misc_feature (402)..(402): n is a, c, g, or t
  modified_base (457)..(457): a, c, t, g, unknown or other
  misc_feature (457)..(457): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagacccctgtccctcacctgcactgtctctggtnactccatcaccggtataatactactggagttggatccgccacgccccccgggaaggcctggagtggatttggatacgccttttacagtggagtcacctactaccaacccgtccctcaagacgccccgagttaccatatctgtcgacacgtcccagaactcagtttcncccttggaggtcgacctctgtgactgccgcagacctcgggccgtgttactttcgngtcgaccagaacgacgaagcacgcgtacctaacttaacttaactttaaacttcgtacttcggtacgggtacctacggtactcccgtcggtcctacccgtctccgtacaccgtcctaccg

SEQ ID NO: 318721 - DNA, 737 bp, Homo sapiens
  misc_feature: GZ8MTXP02JC4UV.9.30.C08.1.454.CMB.2.raw
  modified_base (235)..(235): a, c, t, g, unknown or other
  misc_feature (235)..(235): n is a, c, g, or t
  modified_base (319)..(319): a, c, t, g, unknown or other
  misc_feature (319)..(319): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagacccctgtccctcacctgcactgtctctggtnactccatcaccggtactaatactactgagttgatccgccacgcccccgggaaggcctggacgtggattggatacgtcctttacngtggagtcacctactaccaacccgtcctacaagacgccccgagttaccatactctagttaccgacgaccgtaccccaagtaactcctaacgtttccctccccgtaggggtacgtacgtacccgttacgttggtacgtaacgtcggacccgtacgacgtaccgtcccgggtacccgtttggtttaaactttcccgtggttccgaacccgtaaggaaaaccgtccgaaaaacggccgtaaacgcccggtaacccttaaacgttaaaacgttttaaaaccttttaaaaccgtttcggaaacccgttttacggttaccgggggaacccgtaacgggggttaaccctttcccccggtgggttaaccccctaacccggtttcccctacccggtttcccaacccggtccccctttaaacccccgg

SEQ ID NO: 318722 - DNA, 617 bp, Homo sapiens
  misc_feature: GZ8MTXP02JPL2T.9.30.C08.1.454.CMB.2.raw
  modified_base (266)..(266): a, c, t, g, unknown or other
  misc_feature (266)..(266): n is a, c, g, or t
  modified_base (312)..(312): a, c, t, g, unknown or other
  misc_feature (312)..(312): n is a, c, g, or t
  modified_base (383)..(383): a, c, t, g, unknown or other
  misc_feature (383)..(383): n is a, c, g, or t
  modified_base (616)..(616): a, c, t, g, unknown or other
  misc_feature (616)..(616): n is a, c, g, or t
tcagtgatacgtctcacgaccggtgctcgatttagtctgacgtcaaagggaaagggtctgtgaagccttcacagaccctgtccctcacctgcactgtctctggtgactccatcaccggtactaattactactggagttggatccgccagcccccgggaagggcctggagtggattggatacgccttttacagtggagtcacctactacaacccgtccctcaagagccgagttaccatatctgtcgacacgtcccagaatcagttcnccctggagtgacctctgtgctgccgcagactcggccgtgtatttcngtcgccagaacgcaaagcagccgctatataactttaaacttgacttcgtgggccagggtactcccgtgccnccgtctctcagccctaccaccgaacgggcccacgttccggtcccttcccccgtggcccgtcccgtcgcctcccgagggcaccaccctcgagacgcaccgacgcccggcccgtcggggcctcggccgtcgggtaccgaaacggtaccttaaccgttcccaacggtaccgttacgtaccgaaccgtggaaccggccggggtccgtcgggaccgaaacgggccgacgaacgtacgng

SEQ ID NO: 318723 - DNA, 662 bp, Homo sapiens
  misc_feature: GZ8MTXP02FUE70.9.30.C08.1.454.CMB.2.raw
  modified_base (235)..(235): a, c, t, g, unknown or other
  misc_feature (235)..(235): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctcgtggtnactccatccaccggtactaattactactggtagttggactccgccaccggccccccggggaaggcctgggacgtggattggactacgtccttttacgagtggacgtcaccctactaacctacccgtcctacaacgacgcccgtacgttaccattactctcgtcgaccaccgtccaagaactctacgttcctcccgtagggacggtcaccgttctcggttacgactcgccgacacggaccgttcgggtaccgttgtttaactttccgtaggttcgaccgaagaacccgacaaacggcaacggcctacccttaaacttaactttaaaccttttaaaacgtttgtaccgtttacggttcgggggacctaaggggtccctttcccggtcggtaccctacccggttctacccgtcgaacgtcccctaacccg

SEQ ID NO: 318724 - DNA, 650 bp, Homo sapiens
  misc_feature: GZ8MTXP02G0UMM.9.30.C08.1.454.CMB.2.raw
  modified_base (234)..(234): a, c, t, g, unknown or other
  misc_feature (234)..(234): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtnactcatcaccgtactaattactactggagttggatccgccacgcccccgggaaggccgtggagtggagtttggatacgtcctttacagtggagtcacctactaccaacccgtccctacaagacgaccccgtagttaccatactctgtacgccacgtcccagaactctacgttcctcccgtggagtcgacctctgtgactcgccgcacgtaccgtcggccgttgttactttcgtgtcgaccaagaaaccgacgaaaacgcaacgcccgtacccttaaacttaactttaaacctttttaaaacgttttcgtaaccgttttccggtacgggggtaccccgtaaagggggtacccttaccccggtcggtttaccccgaacccggttccttaccccgtcgtaacccggtcccctaaccccg

SEQ ID NO: 318725 - DNA, 586 bp, Homo sapiens
  misc_feature: GZ8MTXP02HM349.9.30.C08.1.454.CMB.2.raw
  modified_base (234)..(234): a, c, t, g, unknown or other
  misc_feature (234)..(234): n is a, c, g, or t
  modified_base (412)..(412): a, c, t, g, unknown or other
  misc_feature (412)..(412): n is a, c, g, or t
  modified_base (416)..(416): a, c, t, g, unknown or other
  misc_feature (416)..(416): n is a, c, g, or t
  modified_base (424)..(424): a, c, t, g, unknown or other
  misc_feature (424)..(424): n is a, c, g, or t
  modified_base (449)..(449): a, c, t, g, unknown or other
  misc_feature (449)..(449): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgtgtcctgtcccaggtgcagctgcaggagtcgggcccaggactggtgaagccttcacagaccctgtccctcacctgcactgtctctggtnactccatcaccggtactaatactactggagttggatccgccacggcccccgggaaggcctggacgtggattggatacgtcctttacgagtggagtcacctactaccaacccgtcctacaacgacgccgagttaccatatctgtcgacacgtccagaatcagtctcctggagtcacctntgtnactgccgnacgcgtcggccgttgtacttttcgngtcgaccaagacgacaagcgacgtaccgtaccttaacttaactttaaaccgttttaaacttcgtaaccgtttcgggacggggacctaacgggtccttaacccgtcggtaccctccgttcctccgtacgtaccgtccc

SEQ ID NO: 318726 - DNA, 662 bp, Homo sapiens
  misc_feature: GZ8MTXP02HF022.9.30.C08.1.454.CMB.2.raw
  modified_base (239)..(239): a, c, t, g, unknown or other
  misc_feature (239)..(239): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagattgggtcctgtcccaggtgcagctgcaggagtcgggcccaggactgggtgaagccttcgacacgacccctgtccctcacctgcactgtctctggtnactccatcaccggtactaattactactggagttggactccgccaccggccccccggggaaggcccgtaggacgtggtagttggacgttacgtacctttacgaggtggacgtctaccctactaccaaccccgtcctacaacgtacgaccccgtagttaaccaatactctgtaccgacaccgtccaagtaactctaacgttcctacccgtagggtacgtcgtacctcgttgtacgactcgccgcagtccgtccgggtcttaggttactttcgtgtcgccgaagaaccgacaaagcgagcccgtacttaactaacgtttaaacttttaaacgttcgtaacgtttcggtacgggggtacccgtaacgggtccgttccccgtgggttaccctaccggttccttacccgtcaaccgtccccgtaacccg

SEQ ID NO: 318727 - DNA, 663 bp, Homo sapiens
  misc_feature: GZ8MTXP02G3LFC.9.30.C08.1.454.CMB.2.raw
  modified_base (235)..(235): a, c, t, g, unknown or other
  misc_feature (235)..(235): n is a, c, g, or t
  modified_base (325)..(325): a, c, t, g, unknown or other
  misc_feature (325)..(325): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacacgaccctgtccctcacctgcactgtctctggtnactccatcaccggtactaattactactggagttggactccgccacggccccccgggaaggccgtggacgtggattggatacgtcctttangtgagtcacctactacacccgtcctacaagacgcccgagttaccatactctcgtcgacctaccgtccaagtaactctaacgtttcctcccgtagggacgtcgtaccctcgtgtcgactcggcccgacgtacgacgtccggtccgttgttactttcgtgtcgaccgaaaggaaaccgacaaaacggcaacggcctaccttaaacttaactttaaaccttttaaaacgtttcggtaaacctttcggttaacgggggaccctaacgggggttaccttccccggtaacggttcccgtaacccggttcccttaccgtaccgttaaccgcccttaaacccccgg

SEQ ID NO: 318728 - DNA, 634 bp, Homo sapiens
  misc_feature: GZ8MTXP02JETMO.9.30.C08.1.454.CMB.2.raw
  modified_base (351)..(351): a, c, t, g, unknown or other
  misc_feature (351)..(351): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtgactccatcaccggtactaattactactggagttgatccgccacggcccccggaaggcctggagtggattggatacgtcctttagagtgagtcacctactacacccgtcctcaagacncccgagttaccatactctgtcgaccacgtcccaagtaaactctacgtttcctccctagggtacggttcgaccttcgtgtcgactcgcccgcgacgaccgtcgggccgttgttactttcgtgttcgccgtaacgaacgacaaaacgccgaacgtccgtaccctaaacgttactttaaaccgtttttaaaactttcggtaaacctttcggtacgggggtacccaaggggtaccttcccgtgggtaccctaaccggttcctacccttccgaccgtccctaaccccg

SEQ ID NO: 318729 - DNA, 608 bp, Homo sapiens
  misc_feature: GZ8MTXP02GQH9J.9.30.C08.1.454.CMB.2.raw
  modified_base (235)..(235): a, c, t, g, unknown or other
  misc_feature (235)..(235): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcgacagaccctgtccctcacctgcactgtctctggtnactccatcaccggtataattactactggagttggatccgccacgccccccggaaggcctggagtggattggatacgctttacagtggagtcacctactaccaacccgtcctacaaagacgccccgaagttaccaatatctgtcgacaccgtcccaagaactccagttcctccctggacgtcgacctcgtgtgaccttcggacccgcaacgtacctccgggtcccgttgttaacttttcgtgtcgaccgagaaacgcaaaagcacgccgacctaactattaacttttaaaactttgaactttcgtcggggtaccaaggggtacttacccgtgggtaccctacccggttcctcccgtacaccgcccttaaccccg

SEQ ID NO: 318730 - DNA, 675 bp, Homo sapiens
  misc_feature: GZ8MTXP02JF5VL.9.30.C08.1.454.CMB.2.raw
  modified_base (234)..(234): a, c, t, g, unknown or other
  misc_feature (234)..(234): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtnactccatcaccgtactaattactactggagtgatccgccacgcccccgggaaggcctggagtggattggatacgtctttagagtggagtcaccctactaccaacccgtcctacaacgacgaccccgtagttaccattactctcgtacgacctaccgtacccaagtaactcctaacgtttccctacccgtaggggtacggttcgtaacccttcgtaggtcgaccttcgggcccgacgaacgtaccgtcggggtcccgttagtttacgtttccgtgtcgtaccgaagaccgaacaaagcgacggcctaccttaactaaacgtttaaacctttaaaacgtttgaaccgttttcggacggggtacccgtaaacggggtcccttcccggtaaggttaccccctaccggtttccctaccgtacctaccggtcccccttaaaccccgg

SEQ ID NO: 318731 - DNA, 717 bp, Homo sapiens
  misc_feature: GZ8MTXP02JN7QB.9.30.C08.1.454.CMB.2.raw
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacacgacccctgtccctcacctgcactgtctctggtgactccatccaccggtactaattactactggtagttgatccgccacggaccccccgggaggcctggagtggattggatacgtcctttacgagtggacgtcacctactaccacccgtcctacaagacgacccgagttaccatactctgtcaccaccgtccagtactctacgttcctcccgtagggtacgtcgtacccttcgtcgtacgacttcggacccgtacgaagtacccgtccgggtaccgttgtttaacgttttccgtggttccgacccgtaaggaaaccgtacgaaaacggccaacgggtcccgtaaccctttaacttaaacctttaaccttttttaaaaccgtttcgtaaaccccgtttttcgggaccgggggttaccctaacgggggttacccttacccccggttaaggggttacccctaaccccggtttcccgttacccctttaaccgacccggtaccccctttaaacccccggg

SEQ ID NO: 318732 - DNA, 672 bp, Homo sapiens
  misc_feature: GZ8MTXP02HMN5S.9.30.C08.1.454.CMB.2.raw
  modified_base (646)..(646): a, c, t, g, unknown or other
  misc_feature (646)..(646): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtgactccatcaccggtataattactactggagtggactccgccacggccccccgggaaggccgtggagtggattggatacgtcctttacgagtggacgtcaaccctactacctaacccgtccctacaacgacgccccgagttaccatactctacgtcgaccacgtacccagaactcagttcctcccgtgggacgtcgtaccctcgtgttcgacctcggccgtacgaacgtccgtccgggtccggtttacgtttattttccgttggtcggtacccaaaggaaacccggtacaaaacggtcaacggcccgtacccttaaacttaaactttaaacctttttaaaacgtttcgtaacctttcgggtacggggtacccgtacggggtaaccttcccggttaaggtcccaccggtttccncccttccgaccggtacccctccccgg

SEQ ID NO: 318733 - DNA, 683 bp, Homo sapiens
  misc_feature: GZ8MTXP02G5LGV.9.30.C08.1.454.CMB.2.raw
  modified_base (235)..(235): a, c, t, g, unknown or other
  misc_feature (235)..(235): n is a, c, g, or t
  modified_base (245)..(245): a, c, t, g, unknown or other
  misc_feature (245)..(245): n is a, c, g, or t
  modified_base (262)..(262): a, c, t, g, unknown or other
  misc_feature (262)..(262): n is a, c, g, or t
  modified_base (370)..(370): a, c, t, g, unknown or other
  misc_feature (370)..(370): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggccaggactggtgaagccttcacacgaccctgtccctcacctgcactgtctcgtggtnactccatccnccggtaaaaaaaacttnttaactacgtggtagttcggatcccgccgaccggccccccgggaaggcctaggagtggattggactacgtctttagaggtgagtcacctactaaccaacccgtcctanaagacgccccgtagttaaccatactctgtacgaccaccgtacccaaagtaaactccgtacgtttccctacccgttagggacggtacgtacccttcgtaggtacgtaccgcgacccgacgtacgaccgtccgggtaccgttagttaccttttcgtgtacgacccgaaagaaacccgacaaaacggcaacggcctaccttaaactaactttaaaccttttaaaacgtttacgtaaccgtttccggacgggggtaccaacggggtaccttcccggtcggtacctacccgtctaccctcaaccgtcccctaacccgg

SEQ ID NO: 318734 - DNA, 612 bp, Homo sapiens
  misc_feature: GZ8MTXP02H2KKK.9.30.C08.1.454.CMB.2.raw
  modified_base (382)..(382): a, c, t, g, unknown or other
  misc_feature (382)..(382): n is a, c, g, or t
  modified_base (472)..(472): a, c, t, g, unknown or other
  misc_feature (472)..(472): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggccccaggactggtgaagccttcacagacccctgtcccctcacctgcactgtctctggtgactccatcaccggtactaattactactggagttggatccgccacggcccccgggaaggcctggacgtggattggattacgccttttacgagtggagtcacctactacacccgtcctacaagcgcccgagttaccatactctgtcncacgttaccagaactcagttctccctggagtcgacctctgtgactcgccgacacgctcggtccgttgttactttcgtgtcaccgagaacncaaagcagccgtacctaaacttactttaaaccttttaaaactttcggtaaaccttttccggacgggggtaccctaacgggggtaaccttcccgtaacgggtacccaacccggttcctcccgtactacgacccctacccgg

SEQ ID NO: 318735 - DNA, 620 bp, Homo sapiens
  misc_feature: GZ8MTXP02F2W1I.9.30.C08.1.454.CMB.2.raw
  modified_base (233)..(233): a, c, t, g, unknown or other
  misc_feature (233)..(233): n is a, c, g, or t
  modified_base (476)..(476): a, c, t, g, unknown or other
  misc_feature (476)..(476): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggccaggactggtgaagccttcacacgaccctgtccctcacctgcactgtctctgtnactcatcacgtactaatactactggagtgatccgccgacggccccccgggaaggcctggacgtggattggatacgtcttttacgagtggagtcaccctactaccaacccgtcctacaagacgaccccgtagttaccatactctacgtcgacctaccgtacccaagtaactcgtacgtttcctacccgtgggacgtcgaccctcgtgtgactcgccgcacgtacctcggacttgttactttcgngtcgaccaagaacgacaaagcaaggcctacctaacttacttaaactttaaactttcgaaaccgtttcggtacgggggaccctaaaggggtccttcccggtaacggtacctaccggttccctaccgtacgaccgtccctaacccg

SEQ ID NO: 318736 - DNA, 675 bp, Homo sapiens
  misc_feature: GZ8MTXP02GK1KV.9.30.C08.1.454.CMB.2.raw
  modified_base (234)..(234): a, c, t, g, unknown or other
  misc_feature (234)..(234): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtnactccatcacggtactaatactactggagtgatccgccgacgcccccgggaaggccgtggagtggattggatacgtcctttacagtggagtcacctactaccaaccccgtcctacaacgacgccccgtacgttaccatactctcgtacgaccaccgtacccaagtaactactacgtttcctcccgtaggggtaggtccgtacccttcgtggtacgacgttcggcccggcaacggaccgtccgggtaccgtttagttactttcgtgtacgaccgaaagaacccgacgaaaacgccaaagcccgtaccttaaacttaactttaaacttttaaaacgtttgtaccgtttacggtacgggggtaccaacggggttacccttccccggtaagggttcccctaacccggttccttccccgtacgtaaccggtccccctaaaccccgg

SEQ ID NO: 318737 - DNA, 657 bp, Homo sapiens
  misc_feature: GZ8MTXP02F86N2.9.30.C08.1.454.CMB.2.raw
  modified_base (234)..(234): a, c, t, g, unknown or other
  misc_feature (234)..(234): n is a, c, g, or t
  modified_base (404)..(404): a, c, t, g, unknown or other
  misc_feature (404)..(404): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtnactccatcaccggtactaattactactggagttggactccgccgacggccccccgggaaggcctggagtggattggatacgccttttacagtggagtcacctactaccaacccgtcctacaagcgccccgagttaccatactctgtcgcacgtccagaactcagtttccncccgtggacgtcgacctcgtgtgactgcccgcacgtacgtccggccgttgttactttcgtcgccgtaccgaacgaaccgacaaaacggccaacggacccgtacccttaacttaactttaaaacctttttaaaacctttcggtaaaccgttttccggtacgggggtacccctaagggggtacccttccccggttaacggggttacccctaaccccggttccgttacccctccgtaacccgccccctaaccccgg

SEQ ID NO: 318738 - DNA, 556 bp, Homo sapiens
  misc_feature: GZ8MTXP02G6I9O.9.30.C08.1.454.CMB.2.raw
  modified_base (281)..(281): a, c, t, g, unknown or other
  misc_feature (281)..(281): n is a, c, g, or t
  modified_base (302)..(302): a, c, t, g, unknown or other
  misc_feature (302)..(302): n is a, c, g, or t
  modified_base (408)..(408): a, c, t, g, unknown or other
  misc_feature (408)..(408): n is a, c, g, or t
  modified_base (414)..(414): a, c, t, g, unknown or other
  misc_feature (414)..(414): n is a, c, g, or t
  modified_base (422)..(422): a, c, t, g, unknown or other
  misc_feature (422)..(422): n is a, c, g, or t
  modified_base (430)..(430): a, c, t, g, unknown or other
  misc_feature (430)..(430): n is a, c, g, or t
  modified_base (494)..(494): a, c, t, g, unknown or other
  misc_feature (494)..(494): n is a, c, g, or t
  modified_base (538)..(538): a, c, t, g, unknown or other
  misc_feature (538)..(538): n is a, c, g, or t
  modified_base (540)..(544): a, c, t, g, unknown or other
  misc_feature (540)..(544): n is a, c, g, or t
  modified_base (546)..(556): a, c, t, g, unknown or other
  misc_feature (546)..(556): n is a, c, g, or t
tcagtgatacgtctcacgaccggtgctcgatttagtctgacgtcaaagggaaagggttgtagtaggtgactccatcaccggtactaattactactggagttggatccgccagcccccccgggaagggcctggagtggattggatacgccttttacagtggagtcacctactacaaccccgtccctcaagagcccgagttaccatatctgtcgacacgtcccagaatcagttctccctggaggtgacctctgtgactgccgcagctcggccgtgttatttcngtgccagaacgcaaagcagcncctatatactttaacttgacttcgtggggccaggggactccccgtggtccaccgtctcctcacgccctccaccgacgggccccccagtccggtcccttcccccggnggcccnccctgccncgaggacnccacgcgagcgcacgcgccggccgtggctcgccgtaggacacgtcctaccgtcgaagtacgtanctacgtaggacggccgggtacgcgggacgaacgggcagaagtgngnnnnncnnnnnnnnnnn

SEQ ID NO: 318739 - DNA, 587 bp, Homo sapiens
  misc_feature: GZ8MTXP02IQOV5.9.30.C08.1.454.CMB.2.raw
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtgactccatcaccggtactaattactactggagttggatccgccacgccccccgggaaggcctggagtggattggatacgccttttacagtggagtcacctactacaacccgtcctcaagacgccccgagttacccatactctgtcgacacgtcccagaactccagttcctcccgtgaggtcgacctctgtgactgccgacacgactcggccgttgttaactttcgtgtacgaccgaagaaccgacaaaacggcaacggtccgacctaactaactttaactttaaaactttgtacctttcgtacggggacctaggggtactcccgtaagtccaccgttctcctcacgcctacccg

SEQ ID NO: 318740 - DNA, 607 bp, Homo sapiens
  misc_feature: GZ8MTXP02G266J.9.30.C08.1.454.CMB.2.raw
  modified_base (222)..(222): a, c, t, g, unknown or other
  misc_feature (222)..(222): n is a, c, g, or t
  modified_base (267)..(267): a, c, t, g, unknown or other
  misc_feature (267)..(267): n is a, c, g, or t
  modified_base (283)..(283): a, c, t, g, unknown or other
  misc_feature (283)..(283): n is a, c, g, or t
  modified_base (311)..(311): a, c, t, g, unknown or other
  misc_feature (311)..(311): n is a, c, g, or t
  modified_base (319)..(319): a, c, t, g, unknown or other
  misc_feature (319)..(319): n is a, c, g, or t
  modified_base (511)..(511): a, c, t, g, unknown or other
  misc_feature (511)..(511): n is a, c, g, or t
  modified_base (517)..(517): a, c, t, g, unknown or other
  misc_feature (517)..(517): n is a, c, g, or t
  modified_base (521)..(521): a, c, t, g, unknown or other
  misc_feature (521)..(521): n is a, c, g, or t
  modified_base (529)..(529): a, c, t, g, unknown or other
  misc_feature (529)..(529): n is a, c, g, or t
  modified_base (574)..(574): a, c, t, g, unknown or other
  misc_feature (574)..(574): n is a, c, g, or t
  modified_base (587)..(587): a, c, t, g, unknown or other
  misc_feature (587)..(587): n is a, c, g, or t
  modified_base (593)..(593): a, c, t, g, unknown or other
  misc_feature (593)..(593): n is a, c, g, or t
  modified_base (604)..(604): a, c, t, g, unknown or other
  misc_feature (604)..(604): n is a, c, g, or t
  modified_base (606)..(606): a, c, t, g, unknown or other
  misc_feature (606)..(606): n is a, c, g, or t
tcagtgatacgtctcacgaccggtgctcgatttagtctgacgtcaaagggaaagggtctgtgaagccttcacagaccctgtccctcacctgcactgtctctggtgactccatcaccggtactaattactactggagttggatccgccagccccccgggaaggcctgggagtggattggatacgtccttttacagtggagtcacctactaccaacccgtcctnaagcgccgagttaccatatctgtcgacacgtcccagatcagttcnccgtggagtcgacctntgtgactcgccgcagccgtcggccgttntactttcnggtcgaccagaacgacaaagtcacgccgtaccttaactacgtttaaaccttttaaacttggtaccttccggtacggggccctaagggtcttaccccgtggttcccacccgttctccgtacacgtcccctacgaaccgtaacgggccctacgtccggttccctcccccgtggccctccctgcctcgaggaccncgaccncgancgccacgnggccgcccgtggcctggcctgacgaacgtctaactcgagtcgtancacgtgacgcggngtcggngacgcgacagngng

SEQ ID NO: 318741 - DNA, 562 bp, Homo sapiens
  misc_feature: GZ8MTXP02IADBC.9.30.C08.1.454.CMB.2.raw
  modified_base (236)..(236): a, c, t, g, unknown or other
  misc_feature (236)..(236): n is a, c, g, or t
  modified_base (403)..(403): a, c, t, g, unknown or other
  misc_feature (403)..(403): n is a, c, g, or t
  modified_base (416)..(416): a, c, t, g, unknown or other
  misc_feature (416)..(416): n is a, c, g, or t
  modified_base (419)..(419): a, c, t, g, unknown or other
  misc_feature (419)..(419): n is a, c, g, or t
  modified_base (428)..(428): a, c, t, g, unknown or other
  misc_feature (428)..(428): n is a, c, g, or t
  modified_base (543)..(543): a, c, t, g, unknown or other
  misc_feature (543)..(543): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacacgaccctgtcccctcacctgcactgtctctggtnactcatcaccgtactaattactactggagttgactccgccacggcccccggaaggcctggagtggattggatacgtcctttacgagtggagtcacctactacaacccgtcctacaacgacgcccgaagttaccatatctagtcacacgtccagtatcagttctcccnggagtcgtacctntgngtactgccnagcctcggccgttgttacttcgtgtcgaccagaacgacaaagcagcactactaacttaactttaaacttgaactttcggcgggacgtacgggtctcccgttggtaccaccgttcnccctcaacgtccctacccg

SEQ ID NO: 318742 - DNA, 665 bp, Homo sapiens
  misc_feature: GZ8MTXP02HQHTI.9.30.C08.1.454.CMB.2.raw
  modified_base (236)..(236): a, c, t, g, unknown or other
  misc_feature (236)..(236): n is a, c, g, or t
  modified_base (351)..(351): a, c, t, g, unknown or other
  misc_feature (351)..(351): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcagggagtcgggcccaggactggtgaagccttcacagacccctgtccctcacctgcactgtctctggtnactccatcaccggtactaattactactggagttggactccgccacggccccccgggaaggccgtggagtggatggatacgtcctttacagtggagtcactactacacccgtcctnaagagccccgagttaccatactctcgtcgacctacgtacccaagactctacgttcctacccgtggaacgtcgacccttctcggtgtacctcgcccgcacgaccgtcggccgttgttactttcgtgtagacccgagaaaccgacgaaaacgcaaggtcccgtacccttaaattaactttaaacctttttaaaacgttttcggaaacctttcgggtaacggggtacccgtaaacgggggttacccttacccccggttcgggttacccaaccccggtttcctaccccgttaccgaaccggtccccttaaacccccgg

SEQ ID NO: 318743 - DNA, 611 bp, Homo sapiens
  misc_feature: GZ8MTXP02GSWPS.9.30.C08.1.454.CMB.2.raw
  modified_base (234)..(234): a, c, t, g, unknown or other
  misc_feature (234)..(234): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtnactccatcaccggtactaattactactggagttggactccgccacggccccccgggaaggcctgggacgtggattggatacgtctttacaggtgagtcacctactaccacccgtcctcaacgacgccccgagtaccatactctcgtcgacacgtcccagactcagtttcctccctggacgtcgacctctgtgactcggccgcagaccgtcggccgttgtactttcgagtcgccgaagaacgacaaacgcaacgccgtacctaacttaacttaacctttttaaaacgtttcgtaaccgtttacggtcgggggtaccctaacggggtaccttccccgtgggtaccctacccggttctcccgtacaccggtccctacccg

SEQ ID NO: 318744 - DNA, 759 bp, Homo sapiens
  misc_feature: GZ8MTXP02H1573.9.30.C08.1.454.CMB.2.raw
  modified_base (236)..(236): a, c, t, g, unknown or other
  misc_feature (236)..(236): n is a, c, g, or t
  modified_base (266)..(266): a, c, t, g, unknown or other
  misc_feature (266)..(266): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctccagatgggtcctgtcccaggtgcagctgcagggagtcgggcccaggactggtgaagccttcacacgacccctgtccctcacctgcactgtctctggtnacctccatccaccgtataattactactggngtgactcccgccaccggcccccgggaaggccgtaggagtggtattcggaacgtacgtacctttacgaggtcggtacgtcctaaccttaacctaccgtaacccgtcccctacgaaacggtacgtcccccggtaaacgttaccctaagtacgttcgttacggtaccgacccgtacccgttacccgaaacgtaaacttcctaacggtttccctaccccgtagggtaaccggtcggtaacccttcggtacggttacgtaccgtcggtcccggacgaaccgggtacccgttccggggtcccgtttaggtttactttccgtaggttacgccgaaacggtaaaccgaacgaaaacgccgaacggtaccgtaccgttaaacttaaactttaaacctttaaaacgtttcgtaaaccgtttcggttaccggggaccgtaacggggtaccttcccggttaacggtccttacccggtcctacccgtcgtacctacccgtaacccg

SEQ ID NO: 318745 - DNA, 627 bp, Homo sapiens
  misc_feature: GZ8MTXP02FKY2L.9.30.C08.1.454.CMB.2.raw
  modified_base (235)..(235): a, c, t, g, unknown or other
  misc_feature (235)..(235): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagacccctgtccctcacctgcactgtctctggtnactccatcaccggtactaatactactggagtggatccgccacggccccccgggaaggcctggagtggattggatacgtcctttacagtggacgtcacctactaccaaccccgtccctacaaacgacgaccccgtagttaccatatctgtcgacaccgtcccaagaaactctagttcctacccgtgggaacgtcgaccctctgtagaccgtcgcccgcgtacgaccgtccgggtacccgtgttactttccgtgtcgacccaagaaaccgcgaaaacgcaacgccgtaccttaataacttaaaaccttttaaaactttcgaaacctttcggtacggggccctaaggggacttccccgtaaggtccaccggttctccgtacaccgccctaacccg

SEQ ID NO: 318746 - DNA, 645 bp, Homo sapiens
  misc_feature: GZ8MTXP02F40G1.9.30.C08.1.454.CMB.2.raw
  modified_base (234)..(234): a, c, t, g, unknown or other
  misc_feature (234)..(234): n is a, c, g, or t
  modified_base (295)..(295): a, c, t, g, unknown or other
  misc_feature (295)..(295): n is a, c, g, or t
  modified_base (312)..(312): a, c, t, g, unknown or other
  misc_feature (312)..(312): n is a, c, g, or t
  modified_base (494)..(494): a, c, t, g, unknown or other
  misc_feature (494)..(494): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtnactcatcacgtataatactactggagtgatccgccacggcccccggaaggcctggagtggnttggatacgtctttacngtggatcacctactaccaacccgtcctacaagacgaccccgagttacccatactctcgtacgactaccgtacccaagtaaactcctaacgtttcctacccgtgggacgtcgacctcgtgtcgacgtcgccgtacgacgtaccgtcggtccgttgttactttcgtgtcgacccgagaaaccgngaaaacgcaacggcctaccttaactaactttaaaaccttttaacgtttcgtaaccgtttcgggtacggggtacccgtaacggggtacctttccccgtaagggttcccctaaccgttccctacccggttacacccggtccctaaacccccgg

SEQ ID NO: 318747 - DNA, 634 bp, Homo sapiens
  misc_feature: GZ8MTXP02F4H03.9.30.C08.1.454.CMB.2.raw
  modified_base (234)..(234): a, c, t, g, unknown or other
  misc_feature (234)..(234): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtnactccatcaccgtactatactactggagtgatccgccacgcccccggaggcctggagtggattggatacgtcctttacgagtggagtcacctactacaacccgtcctacaagacgccccgtacgttaccatactctcgtcgacaccgtcccaagaactcctaacgtttcctcccgtagggtacgttcgacccttcgtggtgacttcgccgcgacgaccgtcgggtccgttgttatttcgtgtcgaccgagaaccgacgaaacgcacgcgtaccttactaaactttaaccttttaaaactttgtaaccgtttcggtaccggggtaccgtaacgggggtaccttcccggtaacggttacccgtaacccgttcccttccctaccgtaccggtccctaaccccg

SEQ ID NO: 318748 - DNA, 713 bp, Homo sapiens
  misc_feature: GZ8MTXP02HB21F.9.30.C08.1.454.CMB.2.raw
  modified_base (302)..(302): a, c, t, g, unknown or other
  misc_feature (302)..(302): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccagggactggtgaagccttcacagaccctgtccctcacctgcactgtctctggtgactccatcaccggtactaattactactggagttggatccgccacggccccccgggaaggcctggagnggattggatacgcctttacagtggagtcacctactaccaacccgtcctcaagagccccgagttaccatatctcgtcgacctaccgtcccaagaaactccaacgtttcctaccccgtagggtacggtcgtaacccgtccgttaggttcggtaaccttcggcccgcgaacggaccgtccgggtaccccgtttcggttaatttttcccgtggttacggtcccaaacggaaacccgaccgtaaaaagcccgtaaaggcccggtaccctaaaacgttaaactttaaaaccgtttttaaaaaacctttcggtaaaccttttcggtaccgggggttaccgaaaacgggggtaccttcccccggtggggttacccaaccccggtttcctccccttaccgaccgttacccctaacccccg

SEQ ID NO: 318749 - DNA, 602 bp, Homo sapiens
  misc_feature: GZ8MTXP02IJ0BV.9.30.C08.1.454.CMB.2.raw
  modified_base (234)..(234): a, c, t, g, unknown or other
  misc_feature (234)..(234): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtnactcatcacgtactaattactactggagtgatccgccacggccccccgggaaggcctggagtggattggatacgtcctttacagtggagtcacctactaccaacccgtcctacaagacgccccgtagttaccatactctagtacgacaccgtcccagtaactctacgttcctcccgtgtacggtcgtaccctctggtcgtactggcccgcacgaccgtcggccgttgttactttcgtgtcgaccgaagaacgacaaacgcacgccgtactaacttaacttacttttaaaactttcgaactttcggtacggggtaccctacgggtactcccgtggtcctaaccgttcctacctccacgtaccctacccg

SEQ ID NO: 318750 - DNA, 630 bp, Homo sapiens
  misc_feature: GZ8MTXP02JGIBH.9.30.C08.1.454.CMB.2.raw
  modified_base (236)..(236): a, c, t, g, unknown or other
  misc_feature (236)..(236): n is a, c, g, or t
  modified_base (296)..(296): a, c, t, g, unknown or other
  misc_feature (296)..(296): n is a, c, g, or t
  modified_base (429)..(429): a, c, t, g, unknown or other
  misc_feature (429)..(429): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaacgccttcacacgaccctgtccctcacctgcactgtctctggtnactccatcaccgtataattactactggattgactccgccacggcccccggaaggcctggngtgatgatacgtctttagagtgacgtccacctactacctaaccccgtcctacaaacgcgaccccgtaacgtaccattactcgtagtccgaccaccgtcccaagaactcacgttcctcccgtggagtcgacctntggtgactcgccgtacagtaccgtcggtccgttgttacttcgtgtcgaccgtaagaacgacaaacgcacgccgtaaccttaacttaaacgtttaaccttttaaaacgtttcgtaacccgtttcggtacgggggtaccctaacgggtacccttcccggtgtacccgtacccgttcctccgtacctaccgtccccgtaacccg

SEQ ID NO: 318751 - DNA, 701 bp, Homo sapiens
  misc_feature: GZ8MTXP02IFJ5N.9.30.C08.1.454.CMB.2.raw
  modified_base (234)..(234): a, c, t, g, unknown or other
  misc_feature (234)..(234): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtnactcatcaccggtactaattactactggagttgactccgccacggccccccgggaaggcctggacgtggattggatacgtccttttaacgagtggagtcaacctactaccaaccccgtccctacaaagacgaccccgaagttaccatactctgtcgacaccgtaccagtaactcacgttctccctgggtagtcgtacctcgttagtcgtactcggaccgcgacggaccgttccgggcccgtttaggtttaacttttccgttgggttaccgacccgtaaaggaacccgggaaacaaaacggccgaacgggtccgtacccgtttaaaacttaaacttttaaaccgtttttaaaactttcggtaaaccgtttttccgggacgggggtacccctaaagggggttcccttaccccggtggggttaccctaaccggttccttacccttccgaaccggttcccctaacccccgg

SEQ ID NO: 318752 - DNA, 665 bp, Homo sapiens
  misc_feature: GZ8MTXP02HQM02.9.30.C08.1.454.CMB.2.raw
  modified_base (234)..(234): a, c, t, g, unknown or other
  misc_feature (234)..(234): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtnactccatcaccggtactaattactactggagttggactccgccgacggccccccgggaaggcctggagtggattggatacgtctttacagtggagtcactactaccaacccgtcctacaagacgcccgagttaccatactctcgtcaccaccgtacccagaactctacgtttcctcccgtggacgtcgaccttcgtgtcgactcgaccgtcgaacgtcgtccggccgttagttacttttcgtgtcgaccgaagaaccgacaaacgcgaacggcctaccttaaacttactttaaaacctttttaaaaccgtttttggaacccttttcggggttacgggggaccctaaacgggggttacccttccccgttaacggggttacccctaaccggtttcccctcctttacccgaaccggtcccctttaaacccccgg

SEQ ID NO: 318753 - DNA, 689 bp, Homo sapiens
  misc_feature: GZ8MTXP02JD6RP.9.30.C08.1.454.CMB.2.raw
  modified_base (233)..(233): a, c, t, g, unknown or other
  misc_feature (233)..(233): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggccaaggactggtgaagccttcacagaccctgtccctcacctgcactgtctctgtnactccatcacgtataatactactgagtgatccgccgacgcccccgggaaggccgtggagtggattggagtaccgtcctttacgagtggagtcctaccctactaaccaaccccgtccctacaaacgacgcccgaacgttaccatactctacgcaccgtacctcccaagaactccgtaacgttccgtacccgtgggacggttcgacccgttcgttacggttacgtaccgttcgggaccccgtacgtacgtacccgtccggggtcccggtttagtttaacgttttccgttcgttacggacccgaaaggtaacgaccgtaaaggccgtaacgcccgtaccttaactaactttaacgttttaaaacttcgtaccgtttacgtacggggtacccgtaacgggttcctaccggttcggtaccctaccggttcccttaccctctaacccgtcctaaacccccgg

SEQ ID NO: 318754 - DNA, 642 bp, Homo sapiens
  misc_feature: GZ8MTXP02JS3QO.9.30.C08.1.454.CMB.2.raw
  modified_base (234)..(234): a, c, t, g, unknown or other
  misc_feature (234)..(234): n is a, c, g, or t
  modified_base (350)..(350): a, c, t, g, unknown or other
  misc_feature (350)..(350): n is a, c, g, or t
  modified_base (446)..(446): a, c, t, g, unknown or other
  misc_feature (446)..(446): n is a, c, g, or t
  modified_base (519)..(519): a, c, t, g, unknown or other
  misc_feature (519)..(519): n is a, c, g, or t
  modified_base (614)..(614): a, c, t, g, unknown or other
  misc_feature (614)..(614): n is a, c, g, or t
  modified_base (627)..(627): a, c, t, g, unknown or other
  misc_feature (627)..(627): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagacccctgtccctcacctgcactgtctctgtnactcatcacgtataatactactggagttgactccgccgacggcccccgggaaggcctggagtggattggactacgtccttttacagtggacgtcacctactaccaacccgtcctanaacgtacgccccgagttaccattactctacgtacgaccaccgtacccaagtaactcctacgtttccgtcccgtaggggtacgttacgtacccgttntcggtacgacgtcggacccgacgacgtaccgtccgggtcgttgttactttcgtcgtgacccgaaagaaccganaaaacgcgacgaccgtacctaaacttaaactttaacctttaaaactttcgaccgtttacggcggggtacctacggggtaccttccgtcggtaccnccgttcctacccnccgaccacccgaccg

SEQ ID NO: 318755 - DNA, 627 bp, Homo sapiens
  misc_feature: GZ8MTXP02JLDKL.9.30.C08.1.454.CMB.2.raw
  modified_base (234)..(234): a, c, t, g, unknown or other
  misc_feature (234)..(234): n is a, c, g, or t
  modified_base (482)..(482): a, c, t, g, unknown or other
  misc_feature (482)..(482): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtnactccatcaccggtactaattactacgtggagttgactccgccacggcccccgggaaggcctggagtggattggatacgtctttacgagtggagtccacctactaccaaccccgtcctacaagcgaccccgtagttaccatactcgtcgtacgactaccgtacccaagtactcacgtttcctcccgtagacggtcgacctcgtgtcgactcgccgacacgtaccgtcggtccgttgttactttcgtgngaccgaagaaccgacgaacgcgacgcctaccttaaactactttaaaccttttaaacgttcgtaaccgtttcggtacggggtacctacgggtaccttcccggtaacggtccctaccggttcctcctaccgaccgtccctaaccccg

SEQ ID NO: 318756 - DNA, 630 bp, Homo sapiens
  misc_feature: GZ8MTXP02ICBRN.9.30.C08.1.454.CMB.2.raw
  modified_base (234)..(234): a, c, t, g, unknown or other
  misc_feature (234)..(234): n is a, c, g, or t
  modified_base (263)..(263): a, c, t, g, unknown or other
  misc_feature (263)..(263): n is a, c, g, or t
  modified_base (317)..(317): a, c, t, g, unknown or other
  misc_feature (317)..(317): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtnactccatcaccgtactaattactactggntggatccgccacggcccccggaaggcctggagtggattggatacgtctttacgngtggacgtcacctactacaacccgtcctcaagacgccccgtacgttaccatatctgtcgacaccgtacccagtaaactcgacgttctcccggtaggacggtcaccgttctgtcgtacttcggcccgacgacgaccgtcgggtacccttggttatttcgtcggtacgacccaaggaaccgacaaaacgctaacgggccgtaccctaaacttaactttaaacctttttaaaacgtttcgaactttcggttacggggcctaaggggtacccttccgtggtcctaaccggtcctacccgtacgcgtaccctaacccg

SEQ ID NO: 318757 - DNA, 642 bp, Homo sapiens
  misc_feature: GZ8MTXP02G1XLF.9.30.C08.1.454.CMB.2.raw
  modified_base (235)..(235): a, c, t, g, unknown or other
  misc_feature (235)..(235): n is a, c, g, or t
  modified_base (317)..(317): a, c, t, g, unknown or other
  misc_feature (317)..(317): n is a, c, g, or t
  modified_base (343)..(343): a, c, t, g, unknown or other
  misc_feature (343)..(343): n is a, c, g, or t
  modified_base (349)..(349): a, c, t, g, unknown or other
  misc_feature (349)..(349): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagacccctgtccctcacctgcactgtctctggtnactccatcaccgtataatactactggatgactccgccgaccggcccccgggaaggccgtggagtggatggatccgtctttangtgacgtcactacacacccgtcctanaacgcncccgtagtacatatctacgtcacgtacctacccaagaactcctacgttcctcccggtaggggacgtacggtaccctcgttaggtcgtacgtcgacccgtagtaacggaccgtccgggttaccttgttttactttcgtcggtacgacccgaaaggaaacccgacgaaaacgcgaacggccgttaacctaactttaactttaaaacccttttaaagtttccgtaaccttacggggccggtacgacgggttactcccggtaagtaccctccgtctccctacgccttaccaaccccg

SEQ ID NO: 318758 - DNA, 637 bp, Homo sapiens
  misc_feature: GZ8MTXP02I5U3Q.9.30.C08.1.454.CMB.2.raw
  modified_base (236)..(236): a, c, t, g, unknown or other
  misc_feature (236)..(236): n is a, c, g, or t
  modified_base (319)..(319): a, c, t, g, unknown or other
  misc_feature (319)..(319): n is a, c, g, or t
  modified_base (444)..(444): a, c, t, g, unknown or other
  misc_feature (444)..(444): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagacccctgtccctcacctgccactgtctctggtnactccatcaccggtactaattactactggagtggatccgccacgcccccgggaaggcctggacgtggatggatacgtctttanagtgacgtcacctactaccacccgtcctacaaagcaccccgtagttaccatactctagcgacaccgtccaagactcacgttccttacccgagggtacgtcgaccttctggtcgtacgtcgcccgnacgtaccgtccgggtcgtagtttactttcgtcgtcgacccaagaaaccggcaaaacgcgaacgccgtaccttaactaactttaaaactttaaacgttcgtaaacgtttcggacggggaccctaaacggggtccttaacccggtggtaacccctaccggttccctaccttaccgaaccggtccctaaaccccgg

SEQ ID NO: 318759 - DNA, 624 bp, Homo sapiens
  misc_feature: GZ8MTXP02G7V0E.9.30.C08.1.454.CMB.2.raw
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtgactccatcaccggtataattactactggagttggatccgccacggccccccgggaaggcctggagtggattggatacgtctttacagtggagtcacctactaccaacccgtccctacaagcgccccgagttaccatactctgtcgacacgtcccaagaactcacgttcctcccgtggacgtcaccctcgtgtcgactcggcccgtcgacgtaccgtcggtccgttgttactttcgtgtcgaccgaagaaccgacaaaacggcaacggtccgaccttaacttaactttaaactttaaaacgtttgaacctttcggtacgggggtaccctaaggggtaccttccccgtgggtaccctaacccggttcctaccctcgaccgtccctaaccccg

SEQ ID NO: 318760 - DNA, 665 bp, Homo sapiens
  misc_feature: GZ8MTXP02J24TR.9.30.C08.1.454.CMB.2.raw
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtcccctcacctgcactgtctctggtgactcatcaccggttactaattactactggagttggactccgccacggccccccgggaaggcctgggacgtggattggacttacgtccttttacgagtggagtccacctactaccaccccgtcctacaacgacgccccgtagttaccatacttctcggtcgaccaccgtaccccaaggaactccgtaacgtttcctccccgtaggggtacggtcgaacccttcgtacggttcgaccgtcgcccgacgaaccgggtacctccgggtacccgttggttacttttcgtcgttcgacccgaaggaaccgacgaaaagtcaacggcctacctaaacttactttaaaccttttaaaacgtttcgaacgtttcgacgggggaccaggggttacctccccggtggtacccacgtcctaccgtacgaactcccaaccccg

SEQ ID NO: 318761 - DNA, 679 bp, Homo sapiens
  misc_feature: GZ8MTXP02JN7EC.9.30.C08.1.454.CMB.2.raw
  modified_base (237)..(237): a, c, t, g, unknown or other
  misc_feature (237)..(237): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacacgacccctgtcccctcacctgcactgtctctggtnactcatccaccggtactaattactacgtggtagttgactccgccgaccggcccccggggaaggccgtggagtggagttggataccgtcctttagagtggacgtcctacctactaaccacccgtcctacgaacgacgaccccgtaacgttaccatactctacgtaccgacctaccgtacccagtaacttctaacgttcctacccgtagggtacgttacgtacccttgtcggtacgtaccgtccgaccgtacgaacgtcccgttccgggtccgttacgtttactttcgtgtaccgaccgaaagaaccgacgaaaacgccgaacgtcccgtaacttaacttaaactttaaccttttaaaacgttcgtaaccgttcggacggggtacctacgggtacctcccgtaaggtccctacccgtctaccgtccgtaccgtccctaacccgg

SEQ ID NO: 318762 - DNA, 551 bp, Homo sapiens
  misc_feature: GZ8MTXP02G1V3K.9.30.C08.1.454.CMB.2.raw
  modified_base (393)..(393): a, c, t, g, unknown or other
  misc_feature (393)..(393): n is a, c, g, or t
  modified_base (406)..(406): a, c, t, g, unknown or other
  misc_feature (406)..(406): n is a, c, g, or t
  modified_base (531)..(551): a, c, t, g, unknown or other
  misc_feature (531)..(551): n is a, c, g, or t
tcagtgatacgtctcacgaccggtgctcgatttagtctgacgtcaaagggaaagggtctgtgaagccttcacagaccctgtccctcacctgcactgtctctggtgactccatcaccggtactaattactactggagttggatccgccagccccccgggaagggcctggagtggattggatacgccttttacagtggagtcacctactacaaccaaagggcagccccgagaaccacaggtgtacaccctgcccccagaacgcaaagcagcgcctactatactttaaacttgacttctggggccagggatccctggtccaccgtctcctcagcctccaccaacgggccccagtccggtcctttcccccctggccgcccctgcctccgaggacccnccacctcgagacncacgcggccggcccgtggggcctcgcccgtcgggtaccgaaaggtaccttaaccgttacccaaggtacgttactcaccgtcggacggccggggctacggggacgaaacgggccgacgaagtacgnnnnnnnnnnnnnnnnnnnnn

SEQ ID NO: 318763 - DNA, 571 bp, Homo sapiens
  misc_feature: GZ8MTXP02FLRHT.9.30.C08.1.454.CMB.2.raw
  modified_base (235)..(235): a, c, t, g, unknown or other
  misc_feature (235)..(235): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggttgcagctcccagatgggtcctgtcccaggtgcagctgcaggagtcgggcccaggactggtgaagccttcacagacccctgtccctcacctgcactgtctctggtnactccatcaccggtactaatactactggagtgatccgccacggcccccggaaggcctggagtggattggatacgctttacagtgagtcacctactacaacccgtccacaacgacgccccgagttaccatactctcgtacgaccaccgtcccaagaactcagttcctcccgtgggacgtcgacctctgtcgactcgccgacgagacctcgggccgttgtactttcgtgtcgaccagaaccgacaaagcagccacctactattaactttaaaacttgtacttcgtcgggggacctaggggacttcccgtggtccaccgtctccctcacgccctacccg

SEQ ID NO: 318764 - DNA, 675 bp, Homo sapiens
  misc_feature: GZ8MTXP02F3RGY.9.30.C08.1.454.CMB.2.raw
  modified_base (234)..(234): a, c, t, g, unknown or other
  misc_feature (234)..(234): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtnactccatcaccggttactaattactactggagttggactccgccacggcccccgggaaggcctggagtggattggatacgccttttacagtggagtcacctactaccaacccgtccctacaaagtacgcccgtaagttacccatactctgtacgacaccgtcccaagtaactctaacgtttcctcccgtaggacgtcgaccttctgtacgtactcggaccgcgaacgtaccgtcggtaccgttggtttaactttccgtggttacgacccgaagaaaccgacgaaaagccgaaaggccgttaaccctaacttaaacttaaaacctttttaaaaccgttttgaacgtttaccggtaacgggggtccctaaagggggtaccttccccggtaacgttacccgaacccggtttcctacccgtttcgtaaccgccctttaaaccccg

SEQ ID NO: 318765 - DNA, 716 bp, Homo sapiens
  misc_feature: GZ8MTXP02JLLMT.9.30.C08.1.454.CMB.2.raw
  modified_base (235)..(235): a, c, t, g, unknown or other
  misc_feature (235)..(235): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacacgaccctgtccctcacctgcactgtctctggtnactcatcacgtatatactactggagtgactccgccacggcccccgggaaggcctggagtcggagttggactaccgtctttagagtcggagtccacctactacctaacccgtcctacgaacgacgaccccgtacgttaccatactctacgttaccgaccgtaccgtacccagtaaactctaacgtttcctacccgtaggggtacggttctacccgttgtacggttcgaccgttcggacccgtacgaacggtaccgttccgggtccgtttaggtttaacttttcgtacgttaccgtacccgaaacgaaaccgacgaaaacgggcctaaacgggcccgttaaccgttaaactttaaacttttaaaaccgtttttaaaacgttcgtaaaccgttttcgggacggggtaacccgtaacggggtcccttccggttaacggtaccttaacccggttcctaccctaccggacctaccccgtaaacccgg

SEQ ID NO: 318766 - DNA, 510 bp, Homo sapiens
  misc_feature: GZ8MTXP02FW4D0.9.30.C08.1.454.CMB.2.raw
  modified_base (403)..(403): a, c, t, g, unknown or other
  misc_feature (403)..(403): n is a, c, g, or t
  modified_base (408)..(408): a, c, t, g, unknown or other
  misc_feature (408)..(408): n is a, c, g, or t
  modified_base (436)..(436): a, c, t, g, unknown or other
  misc_feature (436)..(436): n is a, c, g, or t
  modified_base (479)..(479): a, c, t, g, unknown or other
  misc_feature (479)..(479): n is a, c, g, or t
  modified_base (497)..(510): a, c, t, g, unknown or other
  misc_feature (497)..(510): n is a, c, g, or t
tcagtgatacgtctcacgaccggtgctcgatttagtctgacgtcaaagggaaagggttgtagtaggtgactccatcaccggtactaattactactggagttggatccgccagcccccccgggaagggcctggagtggattggatacgccttttacagtggagtcacctactacaacccgtccctcaagagccgagttaccatatctgtcgacacgtcccagaatcagttctccctggagtgacctctgtgactgccgcagactcggccgtgtatttctgtgccagaacgcaaagcagcgcctactatactttaaacttgacttctggggccagggatccctggtcaccgtctcctcagcctccaccaggccccccatccgtctccccctggccgcctgctccnggacncacctcgagagcacagcggccctgggcngcctggtcaaggctaccttccagtcgtatcactgacgcggggntcggcaagggcgcatagnnnnnnnnnnnnnn

SEQ ID NO: 318767 - DNA, 731 bp, Homo sapiens
  misc_feature: GZ8MTXP02GTAG3.9.30.C08.1.454.CMB.2.raw
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacacgaccctgtcccctcacctgcactgtctctggtgactccatccaccggtactaattactacgtggtagttggactccgccgacggaccccccggggaaggccgtaggagtggagttggactacgtcgtttacaggtgtagtaccacctactacaaccccgtcctacaacgtacgaccccgtacgttaccatacttctcgtacgtacctaccgtaccccgaaagtaactctaacgtttccctacccgtagggacggttaccgtacccttcggttgttacgtacctcggacccggctaacgtaccgtcgggtcccgttaggtttactttcggtcgtcgaccgaacggaaccgacgaaacgcaacggacccgtaccgttaaacttaacgtttaaacctttttaaacgtttacggttaacctttacgggtaccggggtacccgtaacgggggttaccctttacccggtaacgggttaccctaaaccccggtttcctaccccggtacctaacccggtccccttaaacccccggg

SEQ ID NO: 318768 - DNA, 677 bp, Homo sapiens
  misc_feature: GZ8MTXP02IGNKG.9.30.C08.1.454.CMB.2.raw
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccagggactggtgaagccttcacacgacccctgtccctcacctgcactgtctctggtcactcatcaccgtataatacactgagtgctccgccacggccccggagctggagtgatgactacgtccttagagtgatacacctactaccacccgtccacaagtacgacccgtagttaaccatactcgtacgtacgaccgtccgtaccaacgtaaacttaccgtacgttcccttacccggtggtaacggtacgtacccttcgtggtaccgtacgcgacccgagaaccgtaccgtccggtaccgtttgttactttcggtgtacgtaccgaacgtaacgacaaaacggcgaacggtacccgttaccttaaacgttaaaactttaaaaccttttaaactttacggtaaccttttcgggaccggggtaaccgtacggtaacccgtttcgtaacccggtccgtaacccggttcctacccgttccaaacggttccccctaaaccccgg

SEQ ID NO: 318769 - DNA, 711 bp, Homo sapiens
  misc_feature: GZ8MTXP02HHYGC.9.30.C08.1.454.CMB.2.raw
  modified_base (233)..(233): a, c, t, g, unknown or other
  misc_feature (233)..(233): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagccctgtccctcacctgcactgtctctggtnctccatcacgtactaattactactggagtgactccgccgacggacccccccgggaagggcccgtagggacggtggtaagtttcggaagttaccggtttaccttttacgaaggttcggtaacggtcctaacccttaaccgttaaccctaaccccggttacccctagaaaaccggacgtacccccgtaaccgttaaccacgttactccgtcgttaccgacctacccgggtaccaaagtacgtactacgttacctcccggtaggtcgtcgtacctcgtagtttacgctcgaccgtcgaacgtcgccggtcgttgttactttcgtggtccgaccgaacgaccgacgaaacgcgtacggacctcttaacttaactttaactttaaacgtttgaaccgtttcggttacggggaccgtaacgggtcccgttcccgtcgggtaccctacccggtccttcccgtacctaaccggtcccctaccccgg

SEQ ID NO: 318770 - DNA, 797 bp, Homo sapiens
  misc_feature: GZ8MTXP02GTCXF.9.30.C08.1.454.CMB.2.raw
  modified_base (236)..(236): a, c, t, g, unknown or other
  misc_feature (236)..(236): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagacccctgtccctcacctgcactgtctcgtggtnactcatcgaccgtatattactactggagtgactccgccgaccggcccccgggaaggcctaggacgtggagttggactacgtacctttacgaggtgtacgtcacctaacgtacctaacccgtccctacaacgacgtccccgtacgttaccatacttcgtacgtaccgaccgtaccgtacccagtaaaccgtccgtaacgtttcccgttaccccgtaggggtacccggttacggtaccccttggtcgttacgtacgttccgggccgtacggtaccggaccgttaccggggttcccgttaggtttaccgttttacccggtgttccgggtaaccctaacggggaaaaccacgaaaacgtccggaaacgtaccccgttaccgttaaaactttaaaccttttaaaaccgtttttaacccgttttacggtaacccgttttccgggtaccgggggtaaccccgtaaacgggggttaccctttccccggttaaccggggttaaccctaacccggggtttttaccccctacccggttaacccgtaaccccggttacccccgtaaacccggg

SEQ ID NO: 318771 - DNA, 623 bp, Homo sapiens
  misc_feature: GZ8MTXP02HBJT1.9.30.C08.1.454.CMB.2.raw
  modified_base (235)..(235): a, c, t, g, unknown or other
  misc_feature (235)..(235): n is a, c, g, or t
  modified_base (287)..(287): a, c, t, g, unknown or other
  misc_feature (287)..(287): n is a, c, g, or t
  modified_base (310)..(310): a, c, t, g, unknown or other
  misc_feature (310)..(310): n is a, c, g, or t
  modified_base (614)..(614): a, c, t, g, unknown or other
  misc_feature (614)..(614): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacacgaccctgtccctcacctgcactgtctctggtnactcatcacgtatatactatggagtgactccgcaccggcccccggaggccgnggagtgatgatacgtctttacgngtggatcacctactaccacccgtcctacgaacgacgaccccgtagttaccatacgtctcgacgtaccaccgtacccaagtactcgtacgttcctcccgtagggacgtccgtacctcgtgtcgaccgtgcccgtagtacgaccgtccggtaccgttgtttacttcgtgtaccgaccgtaaggaaaccgagaaaacgccaacggtcctacctttaaactaacgttttaaaactttaacgtttcgaaacgtttcggacgggtacgaacgggtccttaccggcgttcctaccgtctaccgcgtacccncccgtaccg

SEQ ID NO: 318772 - DNA, 645 bp, Homo sapiens
  misc_feature: GZ8MTXP02JM07U.9.30.C08.1.454.CMB.2.raw
  modified_base (236)..(236): a, c, t, g, unknown or other
  misc_feature (236)..(236): n is a, c, g, or t
  modified_base (427)..(427): a, c, t, g, unknown or other
  misc_feature (427)..(427): n is a, c, g, or t
  modified_base (479)..(479): a, c, t, g, unknown or other
  misc_feature (479)..(479): n is a, c, g, or t
  modified_base (505)..(505): a, c, t, g, unknown or other
  misc_feature (505)..(505): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacacgacccctgtccctcacctgcactgtctctggtnactccatcaccggtataattactacgtggtagttgactccgccacggccccccgggaaggcctagggagtggattggacttaccgtccttttacgagtggacgtctacccttactacctaaccccgtcctagaacgacgccccgtagttaccatactctcgtacgacaccgtccaagtactcgtagttccnccgtggagtcgaccctgtgtcgactcgaccgcgagtaccgtcgggtaccgtnttacttcgtgcgaccgaaagaccganaaacgcgacgacctacttaaactaatttaaaccttttaaacgttcggtaaaccgttcggttacgggggacctaacggggtacccttcccgtcgggtaccctacccgttcctaccgttccggaacctccccgtaaacccgg

SEQ ID NO: 318773 - DNA, 592 bp, Homo sapiens
  misc_feature: GZ8MTXP02HK0CU.9.30.C08.1.454.CMB.2.raw
  modified_base (235)..(235): a, c, t, g, unknown or other
  misc_feature (235)..(235): n is a, c, g, or t
  modified_base (280)..(280): a, c, t, g, unknown or other
  misc_feature (280)..(280): n is a, c, g, or t
  modified_base (298)..(298): a, c, t, g, unknown or other
  misc_feature (298)..(298): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagacccctgtccctcacctgcactgtctctggtnactccatcacgtatatacatgatgactcgcacgcccggagctggngtgatgatcgtctttacngtgatcaccctactaccacccgtcctacaacgtacgcccgtacgtaccatactctcgtcgacctacgtccaagtaatcctacgttcctacccgttagggacgtacgtacctcgtagtcgactcgccgcacgtcgtccgtcgtattgtttctgtacgcaagaacacgaaacgctacggcctactacctaatttaaccttttaaacgttgtaaccgttcggtaccggggtacctacgggtaaccttccccggtaaggtccctaccgttcctcccgtaccgccgtaccctaaccccg

SEQ ID NO: 318774 - DNA, 688 bp, Homo sapiens
  misc_feature: GZ8MTXP02G6SSC.9.30.C08.1.454.CMB.2.raw
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctcgtccctcacctgcactgtctcgtggtcactcatcacgtactaattctactggagtgactccgccgacggcccccgggaaggccgtggagtggatggaactacgtctttacgaggtggtagtcctaaccctactaccgaaccccgtccctacaacgacgaccccgtaaacgttaccaataacttcctacggttaccgaccgtacccgtacccgaaacgtaaacttacccgttaacggttccccttacccgggtacggggtacgtcccggtaaacttcgtggtacgtactccggaccgcgtaacggacccgtcggtaccgttggtttacttccgttagtcgaaccaacggaacgaacgaaaggcacggacctactaacttaatttaaaacttttaaaacccgtttgtaaccgttcggaccgggtccgaaacgtccgttaacccgcggtcctaacccgtcgttaccacgcctaccctacccg

SEQ ID NO: 318775 - DNA, 778 bp, Homo sapiens
  misc_feature: GZ8MTXP02FX5S3.9.30.C08.1.454.CMB.2.raw
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctccagatgggtcctgtcccaggtgcagctgcaggagtcgggcccaggactggtgaacgccttcacacgacccctgtcccctcacctgcctactcgtctcgtggtcactccatccgaacgtactaattactacgtggtagttggactccgaccgaccgggaccccccggggaaggtccgtagggacgtggtagttggacttaccgtaccttttaagaggttcggtactacctaacccttaaccgtaacccgtaaacccccgttcctacgaaacggaccgtaccccgtaacgttaccatactcgtacgacgaccgtaccgtaccaagtaactcgtacgtttacctcccgtagggtacggtcctactcgtacgtacgactcgaccgcgaacgtaccgtcggtacgttagttctttcggtagtccgaacccgaaagaacccgaacgaaaacggcccgtaaacggtcccgtaaacctttaaaacctttaaacttttaaaaccccgttttaaaacggtttccgttacccggttttaaccggggaccgggggtaacccgttaacggggtaccctttcccggttaaccggtaccccgttaaaccggttccccttacccgtaccgacccggtaccccttaaaacccccggg

SEQ ID NO: 318776 - DNA, 628 bp, Homo sapiens
  misc_feature: GZ8MTXP02IROXV.9.30.C08.1.454.CMB.2.raw
  modified_base (264)..(264): a, c, t, g, unknown or other
  misc_feature (264)..(264): n is a, c, g, or t
  modified_base (291)..(291): a, c, t, g, unknown or other
  misc_feature (291)..(291): n is a, c, g, or t
  modified_base (317)..(317): a, c, t, g, unknown or other
  misc_feature (317)..(317): n is a, c, g, or t
  modified_base (411)..(411): a, c, t, g, unknown or other
  misc_feature (411)..(411): n is a, c, g, or t
  modified_base (586)..(586): a, c, t, g, unknown or other
  misc_feature (586)..(586): n is a, c, g, or t
  modified_base (626)..(627): a, c, t, g, unknown or other
  misc_feature (626)..(627): n is a, c, g, or t
tcagtgatacgtctcacgaccggtgctcgatttagtctgacgtcaaagggaaagggtctgtgaagccttcacagaccctgtccctcacctgcactgtctctggtgactccatcaccggtactaattactactggagttggatccgccagcccccgggaaggcctggagtggattggatacgccttttacagtggagtcacctactacaacccgtcctcaagagccgagttaccatatctgtcgacacgtcccagaatcagttcncctggagtgaccctctgtgactgccgnacgcctccggccgttgttactttcgngtcgccgaagaaccgacaaagcaggcctaccttactaactttaactttaaactttgactttccgcggggccaagggtaccttcccgtggtcccncccgttctccctacgaccgtcccctaccgaaccgaaacgggccctacgtcccggtttcccttcccccggtcggcccgcccctcgcctccgaagcgccacccgtcgagacgcacgcggacccgccgtcggctcgccgttggacgtaacgactttaccgtcgacgtaccggttaccncgtacgtacggcggtactcggacgacggtcgacagtacgnng

SEQ ID NO: 318777 - DNA, 633 bp, Homo sapiens
  misc_feature: GZ8MTXP02FH3ZC.9.30.C08.1.454.CMB.2.raw
  modified_base (237)..(237): a, c, t, g, unknown or other
  misc_feature (237)..(237): n is a, c, g, or t
  modified_base (372)..(372): a, c, t, g, unknown or other
  misc_feature (372)..(372): n is a, c, g, or t
  modified_base (494)..(494): a, c, t, g, unknown or other
  misc_feature (494)..(494): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagacccctgtccctcacctgcacgtgtctcgtggtnactccatcacggtactaatactactggagttggactccgccgacggccccccggggaaggcctgggacgtggattggatacgtccttttaacgaggtggactaccgaacctaacctaccaaaccccgttccctanaaacgacgccccgtacgttaccatatctcgtcgacaccgtacccaagaatcctagttcctcccgtaggacggtcacctctgtgactgccgacgagaccgtcgggaccgttgtacttttccgngtcgaccgaagaaccacgaaacgcgacgtccgtaccttaacttaactttaaacctttaaagttcgtacgttcggtacgggaccgtacgggcccttccgtcgtcccgtaccgttccctacctccgaccgtccctaacccg

SEQ ID NO: 318778 - DNA, 619 bp, Homo sapiens
  misc_feature: GZ8MTXP02HSN8M.9.30.C08.1.454.CMB.2.raw
  modified_base (414)..(414): a, c, t, g, unknown or other
  misc_feature (414)..(414): n is a, c, g, or t
  modified_base (597)..(597): a, c, t, g, unknown or other
  misc_feature (597)..(597): n is a, c, g, or t
tcagtgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagacccctgtccctcacctgcactgtctctggtgactccatcgaccggtataattactacgtggagttggactccgaccgacggccccccgggaaggcctggagtggtattggactaccgtcttttacagttggacgtccacctactaccaaccccgtcctacaagacgcccgtagttaccatatctcgtcactacgtccagactcacgttcnccgtagacgtcgacctctgtgactgccgagcgaccgttcgggcgtttgttcttttcgtcgtacacccgaaagaccgacaaacgcgaaacgtccgtaccttaacttaattaaccgttttaaaactttcgaacctttcggtcggggacctaacgggtccgtcccgtaacggtcccaccgttaccnccgttaccgcctaccctacccg

SEQ ID NO: 318779 - DNA, 731 bp, Homo sapiens
  misc_feature: GZ8MTXP02F1M67.9.30.C08.1.454.CMB.2.raw
tcagtgatacgtctcacgaccggtgctcgatttagtctgacgtcaaagggaaagggtctgtgaaggcttcaccagtcctggacctcctgtgcaagaacatgaaacacctgtggttcttcctcccgctggtggcagctcccagatgggtcctgtcccaggtgcagctgcaggagtcgggcccaggactggtgaagccttcacacgaccctgtccctcacctgcactgtctctggtcactccatccaccggtaacttaacttactacgtggtagttggactcccgccgaccgggccccccggggaaggccgtggacggtaggtacgtttgggtaacttaccgtaccctttttaacgaggttacggacgttacctaacccgttacctaacccgaacccccgttcccctacgaaacggaccgccgtaaccgttacccatactcgtcgtccgactccgtacccaagaacttcacgttcctaccgtagggacgtcgaccttcgtgtacgacctcggacccgcgaacgtcgtcccgggtcgttagttactttcgtacggtccgtaacgaacggaaacgacaaaacggcctaacgggtccctaaaccttaactttaaaactttaaaccttttaaaaccgtttcgtaaccggtttcgacgggggtaccgtacgggttaccctcccgttacggtcccgtaccgttcctcccgttaccgaccgtacccctcccgaaacccgg

SEQ ID NO: 318780 - DNA, 500 bp, Homo sapiens
  misc_feature: GZ8MTXP01C20KU.52.75.G09.1.454.CMB.2.raw
  modified_base (223)..(223): a, c, t, g, unknown or other
  misc_feature (223)..(223): n is a, c, g, or t
  modified_base (327)..(327): a, c, t, g, unknown or other
  misc_feature (327)..(327): n is a, c, g, or t
  modified_base (427)..(427): a, c, t, g, unknown or other
  misc_feature (427)..(427): n is a, c, g, or t
  modified_base (434)..(434): a, c, t, g, unknown or other
  misc_feature (434)..(434): n is a, c, g, or t
  modified_base (439)..(439): a, c, t, g, unknown or other
  misc_feature (439)..(439): n is a, c, g, or t
tcagcgcagtacgacacgaccggtgctcgatttagtatagacatcagggggctggggtctcaggaggcagcgctctcgggacgtctccaccatggcctgggctctgctattcctcaccctcctcactctgggcacaggatcccgggccagtctgccctgactcagcctgcctccgtgtctgggtctcctggacagtcgatcaccatctcctgcactggaaccngcagtgacattggtcttataactatgtctcctggtaccgacaacacccggacaaacgcccccaaactcatgatttatgctgtcactatcggccgcaggatttcnatccgcttctctggctccaagtctggcaacacggcctccctcaccatctctggctctgactgaggacgaggctgattattactgcagctcaatttacaancacaccnctccngtaatcttgggcgagggaccaagcgttcgaccgtctaggcagcccaagccgttcgtccccg

SEQ ID NO: 318781 - DNA, 531 bp, Homo sapiens
  misc_feature: GZ8MTXP01E29HO.52.75.G09.1.454.CMB.2.raw
  modified_base (223)..(223): a, c, t, g, unknown or other
  misc_feature (223)..(223): n is a, c, g, or t
  modified_base (333)..(333): a, c, t, g, unknown or other
  misc_feature (333)..(333): n is a, c, g, or t
  modified_base (365)..(365): a, c, t, g, unknown or other
  misc_feature (365)..(365): n is a, c, g, or t
  modified_base (381)..(381): a, c, t, g, unknown or other
  misc_feature (381)..(381): n is a, c, g, or t
  modified_base (390)..(390): a, c, t, g, unknown or other
  misc_feature (390)..(390): n is a, c, g, or t
  modified_base (404)..(404): a, c, t, g, unknown or other
  misc_feature (404)..(404): n is a, c, g, or t
  modified_base (416)..(416): a, c, t, g, unknown or other
  misc_feature (416)..(416): n is a, c, g, or t
  modified_base (429)..(429): a, c, t, g, unknown or other
  misc_feature (429)..(429): n is a, c, g, or t
  modified_base (446)..(446): a, c, t, g, unknown or other
  misc_feature (446)..(446): n is a, c, g, or t
tcagcgcagtacgacacgaccggtgctcgatttagtatagacatcagggggctggggtctcaggaggcagcgctctcgggacgtctccaccatggcctgggctctgctattcctcaccctcctcactctgggcacaggatcccgggccagtctgccctgactcagcctgcctccgtgtctgggtctcctggacagtcgatcaccatctcctgcactggaaccngcagtgacattggtcttataactatgtctcctggaccgacaacaccccggacaaaacgcccccaaactcatgatttatgctgtcacttatcgggcccgcagggtatttcncatccgcttctctggctcaagtctggcaaacncgcctcctcaccatcnctggctccngactgagcgagctnattatactgcanctacatttacaancaacctaccaactcctntaaactcttacgggcggacgggaccaaagcgttcgaacccgtttccgtaagggtcaacggcccaaagggcccttcgtccccccgg

SEQ ID NO: 318782 - DNA, 537 bp, Homo sapiens
  misc_feature: GZ8MTXP01EC3WR.52.75.G09.1.454.CMB.2.raw
  modified_base (321)..(321): a, c, t, g, unknown or other
  misc_feature (321)..(321): n is a, c, g, or t
  modified_base (432)..(432): a, c, t, g, unknown or other
  misc_feature (432)..(432): n is a, c, g, or t
  modified_base (437)..(437): a, c, t, g, unknown or other
  misc_feature (437)..(437): n is a, c, g, or t
  modified_base (448)..(448): a, c, t, g, unknown or other
  misc_feature (448)..(448): n is a, c, g, or t
  modified_base (463)..(463): a, c, t, g, unknown or other
  misc_feature (463)..(463): n is a, c, g, or t
tcagcgcagtacgacacgaccggtgctcgatttagtatagacatcagggggctggggtctcaggaggcagcgctctcgggacgtctccaccatggcctgggctctgctattcctcaccctcctcactctgggcacaggatcccgggccagtctgccctgactcagcctgcctccgtgtctgggtctcctggacagtcgatcaccatctcctgcactggaaccagcagtgactattggtcttataactatgtctctggaccacaacaccccggcaaacgcccccaaactcatcgatttatgctgtctacttatccggcccgnagggtatttctcattccgcttctctcggctccaagtctggcaaccacggccctccctcacccatctcgtgggctcctgactggacggacgaggctgatttattactggacngtctntaatttacaanccaccacctactctntaactcttcgggcggaagggaccaagccgttcgaccggttccgtagtccacgcccgaaggccttccgtcccccg

SEQ ID NO: 318783 - DNA, 513 bp, Homo sapiens
  misc_feature: GZ8MTXP01ASDQD.52.75.G09.1.454.CMB.2.raw
  modified_base (194)..(194): a, c, t, g, unknown or other
  misc_feature (194)..(194): n is a, c, g, or t
  modified_base (223)..(223): a, c, t, g, unknown or other
  misc_feature (223)..(223): n is a, c, g, or t
  modified_base (301)..(301): a, c, t, g, unknown or other
  misc_feature (301)..(301): n is a, c, g, or t
tcagcgcagtacgacacgaccggtgctcgatttagtatagacatcagggggctggggtctcaggaggcagcgctctcgggacgtctccaccatggcctgggctctgctattcctcaccctcctcactctgggcacaggatcccgggccagtctgccctgactcagcctgcctccgtgtctgggtctcctggacngtcgatcaccatctcctgcactggaaccngcagtgactagttggtcttataactatgtctctggtaccgacaacaccccggcaaacgcccccaaactcatgatttangctgtcacttatcggcccgcaggtatttctcatccgcttctctggctccaagtctgggcaacacggccctcctcaccatctctgggctctgactgagacgagctgattatacgtgcagctctatttacgaatccacctaccactcctgtaatcgttcggcgagggaccaagcgttcgaccgtccgtagtcacgcccaggtccttcgtccccg

SEQ ID NO: 318784 - DNA, 582 bp, Homo sapiens
  misc_feature: GZ8MTXP01DRXBF.52.75.G09.1.454.CMB.2.raw
  modified_base (224)..(224): a, c, t, g, unknown or other
  misc_feature (224)..(224): n is a, c, g, or t
  modified_base (324)..(324): a, c, t, g, unknown or other
  misc_feature (324)..(324): n is a, c, g, or t
  modified_base (444)..(444): a, c, t, g, unknown or other
  misc_feature (444)..(444): n is a, c, g, or t
tcagcgcagtacgacacgaccggtgctcgatttagtatagacatcagggggctggggtctcaggaggcagcgctctcgggacgtctccaccatggcctgggctctgctattcctcaccctcctcactctgggcacaggatcccgggcccagtctgccctgactcagcctgcctccgtgtctgggtctcctggacagtcgatcaccatctcctgcactggaaccngcagtgactattggtcttaataactatgtctcctggtaccgacaaccaccccggacaaacgcccccaaactcatgatttatgctgtcacttatcggcccnaggatttctcatccgcttctctggctcccaagtctggacctaaacaccggccctacccctcacccatctcgtcgggcttcctgacctggaggaccgaggctgtattattactgctagctntaactttacaacaccacctacctactccctagttaaactccgtttcggggacgggaacggggaacctaacgggccttcggaacccggttcgtacggtccgaacggccccgttaaacgggcccgttccggtcccccccg

SEQ ID NO: 318785 - DNA, 556 bp, Homo sapiens
  misc_feature: GZ8MTXP01D6M0M.52.75.G09.1.454.CMB.2.raw
  modified_base (218)..(218): a, c, t, g, unknown or other
  misc_feature (218)..(218): n is a, c, g, or t
tcagcgcagtacgacacgaccggtgctcgatttagtatagacatcaggggggggtctcaggaggcagcgctctcgggacgtctccaccatggcctgggctctgctattcctcaccctcctcactctgggcacaggatcccgggccagtctgccctgactcagcctgcctccgtgtctgggtctcctggacagtcgatcacatctctgcactggaaccngcagtgactatttgggtacttataactatgtctctggtaccacaacacccggcaaacgccccaaactcatgatttatgctgtctacttacgtccggcccgcagggtactttctctatcgtctttcctctggctccaagtctcggcaacacgccctcctcacactctcgtggtctcgtgacgtagacgggacgaggtctagtattacttactcgtacgaactctactaatttaacaagtccaaccacctacgttcctagtaacttcgtaacggcgggacggacaacgcgtcgaccgttcgttacgcaacgccaaggccttccgtcccgttcggtaaccc

SEQ ID NO: 318786 - DNA, 614 bp, Homo sapiens
  misc_feature: GZ8MTXP01B7I4E.52.75.G09.1.454.CMB.2.raw
  modified_base (255)..(255): a, c, t, g, unknown or other
  misc_feature (255)..(255): n is a, c, g, or t
  modified_base (308)..(308): a, c, t, g, unknown or other
  misc_feature (308)..(308): n is a, c, g, or t
  modified_base (333)..(333): a, c, t, g, unknown or other
  misc_feature (333)..(333): n is a, c, g, or t
  modified_base (356)..(356): a, c, t, g, unknown or other
  misc_feature (356)..(356): n is a, c, g, or t
tcagcgcagtacgacacgaccggtgctcgatttagtatagacatcagggcacgaccggtgctcgatttagtatagacatcaggggggggtctcaggaggcagcgctctcgggacgtctccaccatggcctgggctctgctattcctcaccctcctcactctgggcacaggactcccgggccagtctgccctgactcagcctgcctcgtgtctgggtctcctggacagtcgatcaccatctcctgcactggaaccngcagtgacattggtcgttataactatgtctcctggtaccgacaacaccccggnaaacgcccccaaatcatcgatttangctcgtcacttatccggcccganagggtaactttctcattccgctttctcgtcggtccttccaacgttctacgggacctaaaccgaacccgggtccccttccccgtaccaaaccctacgttcctcgtcggggtccttacccgttggaacccttggaacggacccgaagggtccttaggtatttacttaaccggtcgcgtaacgtcttactacttaacgtaacgtaccacccaccttacctaacctacgtaacgtcgtcggttacggtaacggaacgtaacg

SEQ ID NO: 318787 - DNA, 717 bp, Homo sapiens
  misc_feature: GZ8MTXP01CY47Q.52.75.G09.1.454.CMB.2.raw
  modified_base (194)..(194): a, c, t, g, unknown or other
  misc_feature (194)..(194): n is a, c, g, or t
  modified_base (208)..(208): a, c, t, g, unknown or other
  misc_feature (208)..(208): n is a, c, g, or t
  modified_base (222)..(222): a, c, t, g, unknown or other
  misc_feature (222)..(222): n is a, c, g, or t
tcagcgcagtacgacacgaccggtgctcgatttagtatagacatcagggggctggggtctcaggaggcagcgctctcgggacgtctccaccatggcctgggctctgctattcctcaccctcctcactctgggcacaggatcccgggccagtctgccctgactcagcctgcctccgtgtctgggtctcctggacngtcgatcaccatcnctgcactggaaccngcagtgactattgggtcttaataactatgtctctggtacccgacaaccgaccccggacaaacgcccccaaaatcatagatttatgctcgtacacttacgtccggcccgcgtagggttactttctacacgttcccgtctttctctacgggccttaacccgaaagttcctacgggaccaaaccgtcccgggccccttcccctacaccctacttccgtcgttcgggccttccgttacgaacgttcgggaacgggtaccggaggtctaggttaactttaactttaacggtcggaccgtaacgtccttaccgttaacttttaaaccgaaaccgtacccctaacccaaaccccttaacccggtcccttaacggttaaacttcccgttacgggggaccgggttaacggggaacccaaggttccgttaccgggttaccccgttaacccggttaacggtcccgtaccgggaccccgaacggggtcccgttcccggtccccccgg

SEQ ID NO: 318788 - DNA, 533 bp, Homo sapiens
  misc_feature: GZ8MTXP01B6VPH.52.75.G09.1.454.CMB.2.raw
  modified_base (312)..(312): a, c, t, g, unknown or other
  misc_feature (312)..(312): n is a, c, g, or t
  modified_base (422)..(422): a, c, t, g, unknown or other
  misc_feature (422)..(422): n is a, c, g, or t
tcagcgcagtacgacacgaccggtgctcgatttagtatagacatcagggggctggggtctcaggaggcagcgctctcgggacgtctccaccatggcctgggctctgctattcctcaccctcctcactctgggcacaggactcccgggccagtctgccctgactcagcctgcctcgtgtctggtctccgtggacagtcgatcacatctctgcactggaaccagcagtgactagttggtacttaataactatgtctctgaccgacaacacccggacaaacgcccccaaactcatgtatttatgctgtcacttanccggcccgcgagggtatttctcatcccgtcttctctggcctaccctaagtctgggacaacgaccgccctccctcaccatctcgtcgggctcctgactgagacgacggttntagtattatacgtgctctctactatacacaccacctacctactctataactcgttcggacgacgacacgcgcgttaccgtcgtacgcgacgccgacgtccgttccgtcccg

SEQ ID NO: 318789 - DNA, 550 bp, Homo sapiens
  misc_feature: GZ8MTXP01CYJZB.52.75.G09.1.454.CMB.2.raw
  modified_base (222)..(222): a, c, t, g, unknown or other
  misc_feature (222)..(222): n is a, c, g, or t
  modified_base (299)..(299): a, c, t, g, unknown or other
  misc_feature (299)..(299): n is a, c, g, or t
  modified_base (320)..(320): a, c, t, g, unknown or other
  misc_feature (320)..(320): n is a, c, g, or t
  modified_base (332)..(332): a, c, t, g, unknown or other
  misc_feature (332)..(332): n is a, c, g, or t
  modified_base (420)..(420): a, c, t, g, unknown or other
  misc_feature (420)..(420): n is a, c, g, or t
  modified_base (457)..(457): a, c, t, g, unknown or other
  misc_feature (457)..(457): n is a, c, g, or t
tcagcgcagtacgacacgaccggtgctcgatttagtatagacatcagggggctggggtctcaggaggcagcgctctcgggacgtctccaccatggcctgggctctgctattcctcaccctcctcactctgggcacaggatcccgggccagtctgccctgactcagcctgcctccgtgtcgtggtctcctggacagtcgatcacatctcctgcactggaaccngcagtgactattggtacttaataactatgtctctggaccacaacacccggacaaacgcccccaaactcatgatttangctgtcacttatccggcccgngaggtactttcncactccgtctttctctcggctacccaagtctgggacaaacgtccggcctccctcacctatctcgtgggtctcctagactggaggacgnggctgtaattattacgtgctagctactatttaacaanaccactaccacgtcctataactcgttacggacggacgggtaaccagacgttcgacccgtcgtacgtcacgaccgttacggtcttccgtccccg

SEQ ID NO: 318790 - DNA, 560 bp, Homo sapiens
  misc_feature: GZ8MTXP01D1076.52.75.G09.1.454.CMB.2.raw
  modified_base (223)..(223): a, c, t, g, unknown or other
  misc_feature (223)..(223): n is a, c, g, or t
  modified_base (467)..(467): a, c, t, g, unknown or other
  misc_feature (467)..(467): n is a, c, g, or t
  modified_base (480)..(480): a, c, t, g, unknown or other
  misc_feature (480)..(480): n is a, c, g, or t
  modified_base (536)..(536): a, c, t, g, unknown or other
  misc_feature (536)..(536): n is a, c, g, or t
tcagcgcagtacgacacgaccggtgctcgatttagtatagacatcagggggctggggtctcaggaggcagcgctctcgggacgtctccaccatggcctgggctctgctattcctcaccctcctcactctgggcacaggatcccgggccagtctgccctgactcagcctgcctccgtgtctgggtctcctggacagtcgatcaccatctcctgcactggaaccngcagtgacattgggtcttaataactatgtctcctggtaccgacaaccaccccggacaaacgcccccaaactcatgtatttatgctgtctacttactccggcccgcgagggtatttctctatcccgtctttctctcggcctacccaaagttcgtagggaccaaccgaccggccctcccctacaccctatcctcgttcgggcttccgtagactggaggacgacggctgtaatttattactgactanctactattacaanccaccacctactctgtaatcgttcggcgagggaccaagcgttcgacctcgtaggcncgcccgttagccgttcggtccccg

SEQ ID NO: 318791 - DNA, 535 bp, Homo sapiens
  misc_feature: GZ8MTXP01C6FWW.52.75.G09.1.454.CMB.2.raw
tcagcgcagtacgacacgaccggtgctcgatttagtatagacatcagggggctggggtctcaggaggcagcgctctcgggacgtctccaccatggcctgggctctgctattcctcaccctcctcactctgggcacaggatcccgggccagtctgccctgactcagcctgcctccgtgtctgggtctcctggacagtcgatcaccatctcctgcactggaaccagcagtgacattggtcttaataactatgtctcctggaccgacaacaccccggcaaacgcccccaaactcatgatttatgctgtcacttatccggcccgcagggatttctcatcccgcttctctggcctaccaagtctggctaacgacggccctccctcaccatctcgtcggctcctgactgaggacgagctgattactacgtgcagctcattacagcaccctaccactcctgtaactcgttcgggcggacgggaccaacgcgttcgacccgttccgtacggtcaacggcccgaaggtccgttcccgtcccccg

SEQ ID NO: 318792 - DNA, 671 bp, Homo sapiens
  misc_feature: GZ8MTXP01A4UEP.52.75.G09.1.454.CMB.2.raw
  modified_base (217)..(217): a, c, t, g, unknown or other
  misc_feature (217)..(217): n is a, c, g, or t
  modified_base (223)..(223): a, c, t, g, unknown or other
  misc_feature (223)..(223): n is a, c, g, or t
  modified_base (244)..(244): a, c, t, g, unknown or other
  misc_feature (244)..(244): n is a, c, g, or t
tcagcgcagtacgacacgaccggtgctcgatttagtatagacatcaggggggggtctcaggaggcagcgctctcgggacgtctccaccatggcctgggctctgctattcctcaccctcctcactctgggcacaggactcccgggccagtctgccctgactcagcctgcctcgtgtctgggtctctggacagtcgatcacatctctgcactggaaccngcagtnactagttggtacttaatactntcgtctcgtacgtacacaaccgacccgacaaaccgacccaactacatagtattatcgtctcgtactacttacgtccggccgacgtaggtactttctactactcgtcttcctctcgtcctaccgtacgtacgtacgtaaccgaaccgtacccgtccctcccctacaacctactccgttccgtcgggtccttccgtacgtacgtaggacgggtacgtacggtacttacgtaacttaacgttacgtacgacggtacgtaccttacttaacgttaacaactacctaaccctaaccctaccgttaccttacgttaacgttccggtaacgggtaaccgggaacggtaaccaacggtaccgtacgttacccgttaccgttacggtaaccacggtaacccgtacggtccgttcccggtccccgttccggtaaccg

SEQ ID NO: 318793 - DNA, 619 bp, Homo sapiens
  misc_feature: GZ8MTXP01EST9D.52.75.G09.1.454.CMB.2.raw
  modified_base (340)..(340): a, c, t, g, unknown or other
  misc_feature (340)..(340): n is a, c, g, or t
  modified_base (386)..(386): a, c, t, g, unknown or other
  misc_feature (386)..(386): n is a, c, g, or t
  modified_base (438)..(438): a, c, t, g, unknown or other
  misc_feature (438)..(438): n is a, c, g, or t
tcagcgcagtacgacacgaccggtgctcgatttagtatagacatcagggggctggggtctcaggaggcagcgctctcgggacgtctccaccatggcctgggctctgctattcctcaccctcctcactctgggcacaggatcccgggcccagtctgccctgactcagcctgcctccgtgtctgggtctcctggacagtcgatcaccatctctgcactggaaccagcagtgacattgggtacttataactatgtactcctggtaccgacaaacaccccggacaaaacgcccccaaatcatgatttatgctgtcactttagtccggcccgacagggtatttcnctatccgctttctctggctaccaagtctggacacaccgccctaccncaccactctctggctctgactggagacgagtcgtatattacttacgtgcganctactaactttaacgaacaccaaccctacctacctaccttagtaaacttccgttaccggggacggaacgggggaaaccctaaacggttcccgttcggttaaaccccggttcccggttaacgggtaacccgaaccgggacccccgaaaacgggttccccgttaacccggtcccccccccggg

SEQ ID NO: 318794 - DNA, 558 bp, Homo sapiens
  misc_feature: GZ8MTXP01AL9P4.52.75.G09.1.454.CMB.2.raw
  modified_base (218)..(218): a, c, t, g, unknown or other
  misc_feature (218)..(218): n is a, c, g, or t
  modified_base (245)..(245): a, c, t, g, unknown or other
  misc_feature (245)..(245): n is a, c, g, or t
  modified_base (318)..(318): a, c, t, g, unknown or other
  misc_feature (318)..(318): n is a, c, g, or t
  modified_base (363)..(363): a, c, t, g, unknown or other
  misc_feature (363)..(363): n is a, c, g, or t
  modified_base (372)..(372): a, c, t, g, unknown or other
  misc_feature (372)..(372): n is a, c, g, or t
  modified_base (377)..(377): a, c, t, g, unknown or other
  misc_feature (377)..(377): n is a, c, g, or t
tcagcgcagtacgacacgaccggtgctcgatttagtatagacatcaggggggggtctcaggaggcagcgctctcgggacgtctccaccatggcctgggctctgctattcctcaccctcctcactctgggcacaggatcccgggccagtctgccctgactcagcctgcctcgtgtctgggtctcctggacagtcgatcacatctcctgcactggaaccngcaagtgactattggtacttataactntgtctctgtaccgacaacacccggacaaacgccccaaactcatgtatttatgctgtctacttatccggcccgngagggtatttctcactcgtcttcctctggctcaagtctgcaaacncgcctcccncaccntctcgtcggctctgactgagacgagctgtattatactcgcaacgtctactaactttacaactccaaccaccgtacctccgttagtaaccttcgttcggggcggacgggaccaaagtccgtacggacccgttcgttacggtccacgtcccgaaggccgttccgcccccgttcgggttccccg

SEQ ID NO: 318795 - DNA, 642 bp, Homo sapiens
  misc_feature: GZ8MTXP01BFE0Z.52.75.G09.1.454.CMB.2.raw
  modified_base (222)..(222): a, c, t, g, unknown or other
  misc_feature (222)..(222): n is a, c, g, or t
  modified_base (228)..(228): a, c, t, g, unknown or other
  misc_feature (228)..(228): n is a, c, g, or t
  modified_base (317)..(317): a, c, t, g, unknown or other
  misc_feature (317)..(317): n is a, c, g, or t
tcagcgcagtacgacacgaccggtgctcgatttagtatagacatcagggggctggggtctcaggaggcagcgctctcgggacgtctccaccatggcctgggctctgctattcctcaccctcctcactctgggcacaggatcccgggccagtctgccctgactcagcctgcctccgtgtctgggtctcctggacagtcgatcacatctcctgcactggaaccngcagtnactattggtcttataactatgtctctggtaccacaacacccggacaaacgcccccaaatcatgatttatgctgtcacttatccggccgnagggtatttcgtcatccgcttctctggcctaccaagtctgggaccaacaccggccctcctcaacctcgtctctcgggcctcgtgacttggacggaccgagggtctaggtaatttacttaacgtcggttacaacgtcttactaattttaccgaaagtacccaaccctaaccctaaccttcccgttagttaaacttccggttttaccggggccgggttaacggggaaacccttaaacggcccgttccggttaaacccggttcccgtttaacggggtaaccaacccgggtaccccgaaacgggtcccgttccccggttcccccccggg

SEQ ID NO: 318796 - DNA, 596 bp, Homo sapiens
  misc_feature: GZ8MTXP01ASM5Q.52.75.G09.1.454.CMB.2.raw
  modified_base (314)..(314): a, c, t, g, unknown or other
  misc_feature (314)..(314): n is a, c, g, or t
  modified_base (343)..(343): a, c, t, g, unknown or other
  misc_feature (343)..(343): n is a, c, g, or t
  modified_base (381)..(381): a, c, t, g, unknown or other
  misc_feature (381)..(381): n is a, c, g, or t
tcagcgcagtacgacacgaccggtgctcgatttagtatagacatcagggcacgaccggtgctcgatttagtatagacatcaggggggggtctcaggaggcagcgctctcgggacgtctccaccatggcctgggctctgctattcctcaccctcctcactctgggcacaggactcccgggcccagtctgccctgactcagcctgcctcgtgtctgggtctcgtggacagtcatcacatctctgcactggaaccagcaagtgactattggtcttaataactagtgtctcctggtacccgacaaaccgaccccgganaaaaccgcccccaaatccatgtactttangctgtacacttagcccggcccgtacgaagggtctttcncgtatccgtcttctcgttcggtcctaccgtaaggttctacgggtaccaaaccgtacccggtccctccctacaccctactctcgtcgggcctcgtcgactcggaggacgagtcgtagtattacgttactcggctaacgcttactatttaaccgaactcccacccgttccttaccttcctactaacgtccgtacgggacggtaacgaacgtaaccgg

SEQ ID NO: 318797 - DNA, 504 bp, Homo sapiens
  misc_feature: GZ8MTXP01ADFHN.52.75.G09.1.454.CMB.2.raw
  modified_base (239)..(239): a, c, t, g, unknown or other
  misc_feature (239)..(239): n is a, c, g, or t
  modified_base (244)..(244): a, c, t, g, unknown or other
  misc_feature (244)..(244): n is a, c, g, or t
  modified_base (338)..(338): a, c, t, g, unknown or other
  misc_feature (338)..(338): n is a, c, g, or t
  modified_base (383)..(383): a, c, t, g, unknown or other
  misc_feature (383)..(383): n is a, c, g, or t
  modified_base (426)..(426): a, c, t, g, unknown or other
  misc_feature (426)..(426): n is a, c, g, or t
tcagcgcagtacgacacgaccggtgctcgatttagtatagacatcagggggggtctcaggaggcagcgctctcgggacgtctccaccatggcctgggctctgctattcctcaccctcctcactctgggcacaggatcccgggccagtctgccctgactcagcctgcctccgtgtctgggtctcctggacagtcgatcaccatctcctgcactggaaccagcagtgactattggtcttanaactntgtctcctggtaccgacaacaccccggcaaacgcccccaaaactcatgatttatgctgtcacttatcggccgcagggatttctcatcgcttccnctggctccaagtctggcacacggcctccctcacatctctggctcngactgaggacgaggctgattagtactgcagctcatttacaacncaccactctctatactcgtcggcggacggacacgcgtcgaccgttcgagcacgccgacgccttccgtcccgttcgtcc

SEQ ID NO: 318798 - DNA, 628 bp, Homo sapiens
  misc_feature: GZ8MTXP01EIT6A.52.75.G09.1.454.CMB.2.raw
  modified_base (226)..(226): a, c, t, g, unknown or other
  misc_feature (226)..(226): n is a, c, g, or t
  modified_base (318)..(318): a, c, t, g, unknown or other
  misc_feature (318)..(318): n is a, c, g, or t
  modified_base (376)..(376): a, c, t, g, unknown or other
  misc_feature (376)..(376): n is a, c, g, or t
tcagcgcagtacgacacgaccggtgctcgatttagtatagacatcagggtggggtctcaggaggcagcgctctcgggacgtctccaccatggcctgggctctgctattcctcaccctcctcactctgggcacaggactcccgggcccagtctgccctgactcagcctgcctcgtgtctgggtctcctggacagtcgatcaccatctctgcactggaaccagcagtnactattggtcttaataactatgtctctggtaccgacaacaccccggcaaaacgcccccaaatcatgatttatgctgtcacttatcggcccgnaggtatttcgcatcgtccttctctggctccaaagtctggacaacgaccggccctcccncactatcctcgtcggctctgacgtagacggacgagggtctagtaattacttacgtcgggctaacggtccttactaactttaacgaacgtacccaaacccgtaccctaaccttaccccgttagttaaaccgttcggtttaccggggacgggaaaccggggttaaccaaacggtcccgttacggttacccgttaccgttaacggtacccgaacggaccccgaacggcccgttcccgttcccccgtttaacccgg

SEQ ID NO: 318799 - DNA, 539 bp, Homo sapiens
  misc_feature: GZ8MTXP01EQADV.52.75.G09.1.454.CMB.2.raw
  modified_base (335)..(335): a, c, t, g, unknown or other
  misc_feature (335)..(335): n is a, c, g, or t
  modified_base (472)..(472): a, c, t, g, unknown or other
  misc_feature (472)..(472): n is a, c, g, or t
  modified_base (484)..(484): a, c, t, g, unknown or other
  misc_feature (484)..(484): n is a, c, g, or t
tcagcgcagtacgacacgaccggtgctcgatttagtatagacatcagggcacgaccggtgctcgatttagtatagacatcaggggggggtctcaggaggcagcgctctcgggacgtctccaccatggcctgggctctgctattcctcaccctcctcactctgggcacaggactcccgggccagtctgccctgactcagcctgcctccgtgtctgggtctcctggacagtcgatcaccatctcctgcactggaaccagcaagtgacattggtcttataactatgtctcctggtaccgacaaccaccccggacaaacgcccccaaatcatgacttangctcgtcacttagtccggcccgacgagggtctttcacatccgtcttctctcgctccaagtctggcaaacgccggcctccctcaccatctcgtcggctcctgacctgaggcgaggctgattatactgccaagtccttntacttacgaacncaaccaccttctaactcgtaactccggttacggacgggtaacgggaaccctaagg

SEQ ID NO: 318800 - DNA, 583 bp, Homo sapiens
  misc_feature: GZ8MTXP01C36M8.52.75.G09.1.454.CMB.2.raw
  modified_base (224)..(224): a, c, t, g, unknown or other
  misc_feature (224)..(224): n is a, c, g, or t
  modified_base (226)..(226): a, c, t, g, unknown or other
  misc_feature (226)..(226): n is a, c, g, or t
  modified_base (243)..(243): a, c, t, g, unknown or other
  misc_feature (243)..(243): n is a, c, g, or t
  modified_base (268)..(268): a, c, t, g, unknown or other
  misc_feature (268)..(268): n is a, c, g, or t
  modified_base (277)..(277): a, c, t, g, unknown or other
  misc_feature (277)..(277): n is a, c, g, or t
  modified_base (279)..(279): a, c, t, g, unknown or other
  misc_feature (279)..(279): n is a, c, g, or t
  modified_base (285)..(286): a, c, t, g, unknown or other
  misc_feature (285)..(286): n is a, c, g, or t
  modified_base (288)..(288): a, c, t, g, unknown or other
  misc_feature (288)..(288): n is a, c, g, or t
  modified_base (435)..(435): a, c, t, g, unknown or other
  misc_feature (435)..(435): n is a, c, g, or t
  modified_base (440)..(440): a, c, t, g, unknown or other
  misc_feature (440)..(440): n is a, c, g, or t
  modified_base (465)..(465): a, c, t, g, unknown or other
  misc_feature (465)..(465): n is a, c, g, or t
tcagcgcagtacgacacgaccggtgctcgatttagtatagacatcagggggctggggtctcaggaggcagcgctctcgggacgtctccaccatggcctgggctctgctattcctcaccctcctcactctgggcacaggatcccgggccagtctgccctgactcagcctgcctccgtgtctgggtctcctggacagtcgatcaccatctcctgcactggaaccangngacatgtgtataatatntctctcgtacgacaacaccgccaanacccaccantntatatnntnttacttatcggccgcctagagtttctcactgtccttcttcctgtcgtaccctaacgtaacgttcgccgaaaccaacccgggtccctcccctccacactctccgtggaccgtctacggagtcgagggacggtgctgtattaactttanccggngacgtattactaacttaacgaaccnccaccctaaccgtcctcgttacgtaacgttcggtccggggcgggaacgtaaccgacgtaccgtccgttaaccgttcccgttagcgaccgccgtacgtccgttcccctccccgttcgtg

SEQ ID NO: 318801 - DNA, 690 bp, Homo sapiens
  misc_feature: GZ8MTXP01BYQ6B.52.75.G09.1.454.CMB.2.raw
tcagcgcagtacgacacgaccggtgctcgatttagtatagacatcagggggctggggtctcaggaggcagcgctctcgggacgtctccaccatggcctgggctctgctattcctcaccctcctcactctgggcacaggactcccgggccagtctgccctgactcagcctgcctccgtgtctgggtctcctggacagtcatcaccatctcctgcatggaaccagcagtgactagttggtacttaataactatgtctctggtaccgacaaccgaccccgacaaacgcccccaaactcatgtatttatgctgtctacttagtccggcccgcgtagggtactttcgtctactcccgtcttctcgtcggcctaccgaacgtcgtacggaccaaaccgacccggtccctccccttaccaaccctacttcgttcccgttcggggtcccttccgtcggtaacccgttagggacgggtaccggaaggtccgttaaggttaactttaacgtttacggtcgtacgtacgtacttacctaacgtttaaccgaacgaccctaaaccctacccttacctaccgttagtaaacttccggttacgggaccgggaacgggaaccgtaacggttcccggttacgttaccccggttcgttaccggtccgtacccggaccgaaccggtcccgttcccggttcccccccgg

SEQ ID NO: 318802 - DNA, 624 bp, Homo sapiens
  misc_feature: GZ8MTXP01BYTDX.52.75.G09.1.454.CMB.2.raw
  modified_base (224)..(224): a, c, t, g, unknown or other
  misc_feature (224)..(224): n is a, c, g, or t
  modified_base (401)..(401): a, c, t, g, unknown or other
  misc_feature (401)..(401): n is a, c, g, or t
tcagcgcagtacgacacgaccggtgctcgatttagtatagacatcagggggctggggtctcaggaggcagcgctctcgggacgtctccaccatggcctgggctctgctattcctcaccctcctcactctgggcacaggatcccgggcccagtctgccctgactcagcctgcctccgtgtctgggtctcctggacagtcgatcaccatctcctgcactggaaccngcagtgactatttgggtacttaataactatgtctcctggtaccgacaacaccccggacaaacgcccccaaatcatcgatttatgctgtacacttatccggcccgcagggatttcgcatccgctttctctggctaccaagtctggcaacaccggcctccctcaccatctctgggctcngactgaggacgaggctagatttattacgtgtcaagtcctataatttaccaaagtccaaccctaccctaaccttcccgtgttaaacttccgtttacggggaccgggttaacgggggaacccaaacgggttcccgttcgggttaaccccgttaacccggttaacgggttaacccgtaaccggtacccccgaaacggggtccccttaacccggttccccccccggg

SEQ ID NO: 318803 - DNA, 557 bp, Homo sapiens
  misc_feature: GZ8MTXP01E49HX.52.75.G09.1.454.CMB.2.raw
  modified_base (300)..(300): a, c, t, g, unknown or other
  misc_feature (300)..(300): n is a, c, g, or t
  modified_base (329)..(329): a, c, t, g, unknown or other
  misc_feature (329)..(329): n is a, c, g, or t
tcagcgcagtacgacacgaccggtgctcgatttagtatagacatcaggggggggtctcaggaggcagcgctctcgggacgtctccaccatggcctgggctctgctattcctcaccctcctcactctgggcacaggatcccgggcccagtctgccctgactcagcctgcctccgtgtctgggtctcctggacagtcgatcaccatctcctgcactggaaccagcagtgactattgggtcttaataactatgtctcctggtaccgacaacaccccggcaaacgcccccaaatcatgatttangctgtcactatcggcccgcagggatttcncatcgcttcctctggctccaagtctggcaacacggccctccctcaccatctctggctcctgactgagacgaggctgattatactgacagctctatttaacgaacgccaaccaccctactcctagtaactcgttcggacgggacggaccaaaggccttcgacccgttccttaacggggtcaccggaacccgttaaacgggccttccggccccccgttcgggttaacccc

SEQ ID NO: 318804 - DNA, 700 bp, Homo sapiens
  misc_feature: GZ8MTXP01BMZJE.52.75.G09.1.454.CMB.2.raw
tcagcgcagtacgacacgaccggtgctcgatttagtatagacatcagggggctggggtctcaggaggcagcgctctcgggacgtctccaccatggcctgggctctgctattcctcaccctcctcactctgggcacaggatcccgggcccagtctgccctgactcagcctgcctccgtgtctgggtctcctggacagtcgatcaccatctcctgcactggaacccagcaagtgactagttggtacttaataactatgtctcctggtaccgacaaccaccccggacaaacgcccccaaactcatgatttatgacttgtactacttactcccgggcccgacgtagggtactttctctactccgtcttctcgtcggcctaccgaagtctggaccaaacgccggtccctccctcaccctacttcctcgtcgggtcctccgttagaaccgttggaacgggacgaaggtccgttagtaagtttactttaacgtcggtacgtacgtacttaccttaactttaaaccgaacgtaacccaaccctaacccaacccggttaccttacgttaaacgttcccggtttaccggggtaacgggttaccggtaaacccgaaacggttaccgttaccggttaaccccggttaaccgttaaaccggggtccaacccgggtacccggaaaccggggtcccttccccggttcccccccgg

SEQ ID NO: 318805 - DNA, 646 bp, Homo sapiens
  misc_feature: GZ8MTXP01ETPKJ.52.75.G09.1.454.CMB.2.raw
  modified_base (191)..(191): a, c, t, g, unknown or other
  misc_feature (191)..(191): n is a, c, g, or t
  modified_base (201)..(201): a, c, t, g, unknown or other
  misc_feature (201)..(201): n is a, c, g, or t
  modified_base (206)..(206): a, c, t, g, unknown or other
  misc_feature (206)..(206): n is a, c, g, or t
  modified_base (216)..(216): a, c, t, g, unknown or other
  misc_feature (216)..(216): n is a, c, g, or t
  modified_base (222)..(222): a, c, t, g, unknown or other
  misc_feature (222)..(222): n is a, c, g, or t
  modified_base (237)..(237): a, c, t, g, unknown or other
  misc_feature (237)..(237): n is a, c, g, or t
  modified_base (241)..(241): a, c, t, g, unknown or other
  misc_feature (241)..(241): n is a, c, g, or t
  modified_base (262)..(262): a, c, t, g, unknown or other
  misc_feature (262)..(262): n is a, c, g, or t
  modified_base (294)..(294): a, c, t, g, unknown or other
  misc_feature (294)..(294): n is a, c, g, or t
  modified_base (333)..(333): a, c, t, g, unknown or other
  misc_feature (333)..(333): n is a, c, g, or t
tcagcgcagtacgacacgaccggtgctcgatttagtatagacatcaggggggggtctcaggaggcagcgctctcgggacgtctccaccatggcctgggctctgctattcctcaccctcctcactctgggcacaggactcccgggccagtctgccctgactcagcctgcctcgtgtctgggtctcctggacngtcgatcacntctcngcactgaccngcagtnactgttggtcttaanactntgtctctggtaccgacaaccncccggacaaacgaccccaaatcatgtatttangctgtctacttacgtccggccgcgagggtacttctactntccgtctttccctcgtacggcctaccgacgtcgttcgggcctaaacgcccgtccctcccctacaccctacttccttccgtcgggtcctcccgtagtaccgtaggaacgggaccggtaagggtcctaggttaacctttagtttaaccgtcgtacgtacgtacttaacgttaacttaaccgacctacccaaccctacctaccgttccttaacgttaacgttccgggtaacgggaacggaccggtacgacgtaccgtaccggttaccgttcgttacggtccacgtccgtacgtccgttcccgtcccgttcgtaacc

SEQ ID NO: 318806 - DNA, 515 bp, Homo sapiens
  misc_feature: GZ8MTXP01B0RQT.52.75.G09.1.454.CMB.2.raw
  modified_base (392)..(392): a, c, t, g, unknown or other
  misc_feature (392)..(392): n is a, c, g, or t
  modified_base (448)..(448): a, c, t, g, unknown or other
  misc_feature (448)..(448): n is a, c, g, or t
  modified_base (474)..(474): a, c, t, g, unknown or other
  misc_feature (474)..(474): n is a, c, g, or t
tcagcgcagtacgacacgaccggtgctcgatttagtatagacatcagggggctggggtctcaggaggcagcgctctcgggacgtctccaccatggcctgggctctgctattcctcaccctcctcactctgggcacaggactcccgggcccagtctgccctgactcagcctgcctccgtgtctgggtctcctggacagtcgatcaccatctctgcactggaaccagcagtgactattgggtcttaataactatgtctctggtaccgacaacaccccggacaaacgcccccaaactcatcgatttatgctgtctactttatccggcccgcgagggtatttctcattcccgctttctctggctaccaagtctggacaacgacgccctcctcaccntctctcgggctcctagactgagacgtggctgtattattactgcagctcattacgancaccacactctgtaatcttcgggcgngggacaaggcttcgaccgtctggcagccaggcttcgccccg

SEQ ID NO: 318807 - DNA, 614 bp, Homo sapiens
  misc_feature: GZ8MTXP01EGQ05.52.75.G09.1.454.CMB.2.raw
  modified_base (192)..(192): a, c, t, g, unknown or other
  misc_feature (192)..(192): n is a, c, g, or t
  modified_base (218)..(218): a, c, t, g, unknown or other
  misc_feature (218)..(218): n is a, c, g, or t
  modified_base (224)..(224): a, c, t, g, unknown or other
  misc_feature (224)..(224): n is a, c, g, or t
  modified_base (241)..(241): a, c, t, g, unknown or other
  misc_feature (241)..(241): n is a, c, g, or t
tcagcgcagtacgacacgaccggtgctcgatttagtatagacatcagggggctggggtctcaggaggcagcgctctcgggacgtctccaccatggcctgggctctgctattcctcaccctcctcactctgggcacaggactcccgggccagtctgccctgactcagcctgcctcgtgtctggtctctggacngtcatcacatctctgcactggaaccngcagtnactagttggtacttaanacgtatgtctctgaccacaaccacccggacaaacgaccccaaatcatagtatttatgctgtactacttagtcccggccgcgaggtactttcacgtacttccgtcctttcgtcgtcggtccctaaccgtaagttccgtcgggaacctaaccgacccgtcccctccctctaacctactcgtcgtcgggtcttccgtagaccgtggacggaacgggaggtcttagttactttacgtacgtcgtacgtactctaacttaacttaacaactaccacctaacctacctacgtataacgttcggttacgggacggacgactacgccgttacgttaccgtaacggtacgaaccgaccgaccgacgtcccgttcccgtcccg

SEQ ID NO: 318808 - DNA, 621 bp, Homo sapiens
  misc_feature: GZ8MTXP01AR5AL.52.75.G09.1.454.CMB.2.raw
  modified_base (274)..(274): a, c, t, g, unknown or other
  misc_feature (274)..(274): n is a, c, g, or t
  modified_base (300)..(300): a, c, t, g, unknown or other
  misc_feature (300)..(300): n is a, c, g, or t
  modified_base (332)..(332): a, c, t, g, unknown or other
  misc_feature (332)..(332): n is a, c, g, or t
tcagcgcagtacgacacgaccggtgctcgatttagtatagacatcagggggctggggtctcaggaggcagcgctctcgggacgtctccaccatggcctgggctctgctattcctcaccctcctcactctgggcacaggatcccgggccagtctgccctgactcagcctgcctcgtgtctgggtctcctggacagtcgatcaccatctctgcactggaaccagcagtgactagttggtacttataactatgtctctgtaccgacaacacccgganaaacgcccccaaactcatgactttangctgtcacttatccggcccgcagggtatttcnctactccgtctttctctggtcctaccaacgtctgggacaacacggcctccctcaccacgtctctcgggcctccgtgaacgtggacggaccgaggaccttgatttaacttacgttggacctaggtacttactaacgtttaacaacgttaccaaccctaacctacggttacccctaggttaaacttccggtttccgggaccgggacggggtaccaaacgccgttacggttacccgttaaccgtacgggttaaccacgggacccttaaacgggcccgttccgggtccccccg

SEQ ID NO: 318809 - DNA, 560 bp, Homo sapiens
  misc_feature: GZ8MTXP01C50OP.52.75.G09.1.454.CMB.2.raw
  modified_base (323)..(323): a, c, t, g, unknown or other
  misc_feature (323)..(323): n is a, c, g, or t
  modified_base (477)..(477): a, c, t, g, unknown or other
  misc_feature (477)..(477): n is a, c, g, or t
  modified_base (539)..(539): a, c, t, g, unknown or other
  misc_feature (539)..(539): n is a, c, g, or t
tcagcgcagtacgacacgaccggtgctcgatttagtatagacatcagggtggggtctcaggaggcagcgctctcgggacgtctccaccatggcctgggctctgctattcctcaccctcctcactctgggcacaggatcccgggcccagtctgccctgactcagcctgcctcgtgtctgggtctcctggacagtcgatcaccatctcctgcactggaaccagcagtgactagttggtacttataaactatgtctctggtaccgacaacacccggacaaacgccccaaactcatgtatttatgctgtctacttagtccggcccgngagggtatttctcatccgtccttctcgtggtcctaccaaagttctcggacaaaccgccggtcccctccctactacccattcctcgtcgggtctccgtgacgtaggacggacgtaggctagtattaattacgtggacatactactattaacaacncaaccacctactcctataatcgtcggacggacgaccgtaagcttacgccgttactaacgtcncgccgagcctccgccccgtcg

SEQ ID NO: 318810 - DNA, 885 bp, Homo sapiens
  misc_feature: GZ8MTXP01AD1BP.52.75.G09.1.454.CMB.2.raw
  modified_base (224)..(224): a, c, t, g, unknown or other
  misc_feature (224)..(224): n is a, c, g, or t
  modified_base (344)..(344): a, c, t, g, unknown or other
  misc_feature (344)..(344): n is a, c, g, or t
tcagcgcagtacgacacgaccggtgctcgatttagtatagacatcagggggctggggtctcaggaggcagcgctctcgggacgtctccaccatggcctgggctctgctattcctcaccctcctcactctgggcacaggactcccgggccagtctgccctgactcagcctgcctccgtgtctgggtctccgtggacagtcatccacatctcctgcactggaaccngcagtgactattggtacttataactatgtctctggaccgacaaccaccccggacaaacgtcccccaaatcgatcgtatttatgctgtctactttacgccggcccgcgtagggtatttccnctacgtccccgtcctttcgtccgttcggtaccctaacccgaaagtttcccgtagggacctaaacccgacccggtcccctttccccactaaacccctacggttccttccggttcgggggaccctttccgtacgggaaacccgttgggaacggggtaaacccggggtacgggttacgttaacggttaaacttttaacgttaccggggtacggtaaccgtaaccgttaccgttaaaccgtttaaacgtttaaaccccgaaaccgggtaccccgtaaaacccccgttaaaccccgttaaaccccggttttacccggtttaaaccgggtttaaacccggtttccccggggtttaaacccggggggtaaacccgggggttaaacccgggggtaaaccccgttaaacccgggtttaccccgggttaaccccgggtttaaccccgggttaacccgggtttaacccggggtaaccccgtaaccccggggttaaacccccgggttaacccggggttaaccccccgttaaccccccggggtaaccccccggg

SEQ ID NO: 318811 - DNA, 673 bp, Homo sapiens
  misc_feature: GZ8MTXP01DCCGX.52.75.G09.1.454.CMB.2.raw
  modified_base (238)..(238): a, c, t, g, unknown or other
  misc_feature (238)..(238): n is a, c, g, or t
tcagcgcagtacgacacgaccggtgctcgatttagtatagacatcagggcacgaccggtgctcgatttagtatagacatcaggggggggtctcaggaggcagcgctctcgggacgtctccaccatggcctgggctctgctattcctcaccctcctcactctgggcacaggactcccgggcccagtctgccctgactcagcctgcctcgtgtctgggtctcctggacagtcgatcaccntctctgcactggaaccagcagtgactagttggtcttaataactatgtctccgtggtaaccacaaccaccccggacaaaccgcccctaaaactcaatgtatttatcgactcgtacctactttacgcccggcccgaacgtaaggggttaactttcctactaacttcccgtcctttacctcgtcgggtcccttaccgtaaacggttccgtacgggacctaaaacccggaccggtccccctacccttccaacccctacggttccttcggtaccgggtccttacccgtaggtacccgttagggaacgggtaacggaaccgggttcttacgttaacttaacgttacgtcgtacgtaacgtacttacttaacttaacgtaacctaccacccacccttacctaactacgtaacgtcggtacgggacggtaacggaacgtaacg

SEQ ID NO: 318812 - DNA, 577 bp, Homo sapiens
  misc_feature: GZ8MTXP01EMCGN.52.75.G09.1.454.CMB.2.raw
  modified_base (328)..(328): a, c, t, g, unknown or other
  misc_feature (328)..(328): n is a, c, g, or t
  modified_base (405)..(405): a, c, t, g, unknown or other
  misc_feature (405)..(405): n is a, c, g, or t
  modified_base (454)..(454): a, c, t, g, unknown or other
  misc_feature (454)..(454): n is a, c, g, or t
tcagcgcagtacgacacgaccggtgctcgatttagtatagacatcagggggctggggtctcaggaggcagcgctctcgggacgtctccaccatggcctgggctctgctattcctcaccctcctcactctgggcacaggatcccgggcccagtctgccctgactcagcctgcctccgtgtctggtctcctggacagtcgatcaccatctcctgcactggaaccagcagtgactatttgggtacttaataactatgtctctggtaccacaaccacccggacaaacgcccccaaatcatgtatttatgctgtctacttacgtccggcccgngtagggtatttcgctacttccgcttctcgtcgcctaacccaagttctgggaccaacgaccgtccctaccctcacctntctcgtcggtctaccgtgacgtgacggacgagctagtattacttacgtnctacgtctactaattacaagccaaccctctaccttcgtataactcggttacggacgggttaacgggaccaagttccgttcgacccggtcgtaacgcgacgccgaacgggtccttcgtcccccg

SEQ ID NO: 318813 - DNA, 695 bp, Homo sapiens
  misc_feature: GZ8MTXP01AFAIL.52.75.G09.1.454.CMB.2.raw
  modified_base (207)..(207): a, c, t, g, unknown or other
  misc_feature (207)..(207): n is a, c, g, or t
  modified_base (219)..(219): a, c, t, g, unknown or other
  misc_feature (219)..(219): n is a, c, g, or t
  modified_base (297)..(297): a, c, t, g, unknown or other
  misc_feature (297)..(297): n is a, c, g, or t
tcagcgcagtacgacacgaccggtgctcgatttagtatagacatcagggtggggtctcaggaggcagcgctctcgggacgtctccaccatggcctgggctctgctattcctcaccctcctcactctgggcacaggactcccgggccagtctgccctgactcagcctgcctcgtgtcgtggtctcctggacagtcgatcacatctccngcactggaaccngcagtgactattggtacttaatactatgtctcgtggtaccacaacacccggacaacgaccccaaactcatgtattatnctgtcacttactcggcccgcgaggtactttctacatccgtacctttctcgtcggccttccgaaaagttccgttcggggaaccaaaccgacccgggtcccctcccttccaaccctacgttccgtcgtcgggtcctccgttagaccgtagggacggtaccggagggtacctacgtaatttaacttaaccgttcggggactacgggtaccttaccgtaacgtttaaccgaaccgtaccaaacccctaccggtaacccttaccttaaccgtaaacttcccggtttacgggttacccggggtaacggaacccgtaacggtaccgttaccggttacccgttaccgtttaacggtaccgtaacgaccccggtaacggttacccgttcccgcccccggtttcccgg

SEQ ID NO: 318814 - DNA, 642 bp, Homo sapiens
  misc_feature: GZ8MTXP01E2AVM.52.75.G09.1.454.CMB.2.raw
  modified_base (209)..(209): a, c, t, g, unknown or other
  misc_feature (209)..(209): n is a, c, g, or t
  modified_base (223)..(223): a, c, t, g, unknown or other
  misc_feature (223)..(223): n is a, c, g, or t
  modified_base (275)..(275): a, c, t, g, unknown or other
  misc_feature (275)..(275): n is a, c, g, or t
  modified_base (300)..(300): a, c, t, g, unknown or other
  misc_feature (300)..(300): n is a, c, g, or t
  modified_base (322)..(322): a, c, t, g, unknown or other
  misc_feature (322)..(322): n is a, c, g, or t
  modified_base (333)..(333): a, c, t, g, unknown or other
  misc_feature (333)..(333): n is a, c, g, or t
  modified_base (376)..(376): a, c, t, g, unknown or other
  misc_feature (376)..(376): n is a, c, g, or t
  modified_base (396)..(396): a, c, t, g, unknown or other
  misc_feature (396)..(396): n is a, c, g, or t
  modified_base (419)..(419): a, c, t, g, unknown or other
  misc_feature (419)..(419): n is a, c, g, or t
tcagcgcagtacgacacgaccggtgctcgatttagtatagacatcagggggctggggtctcaggaggcagcgctctcgggacgtctccaccatggcctgggctctgctattcctcaccctcctcactctgggcacaggatcccgggcccagtctgccctgactcagcctgcctccgtgtctgggtctcctggacagtcgatcaccatcnctgcactggaaccngcagtgactattggtacttaataactatgtctctggaccacaacaccccganaaacgcccccaaactcatgatttangctgtctacttatccggcccgngaggtatttcncattcccgcttctcgtcggctaaccaagtctagggacaaaccnccggccctccctacaccctntcgtcgtcgggtctacctgaccnggaggaccgagtcgtatatttaaacttacgggtcgacgaactctacttaaacgtttaacgaaaccgtaccaaccctaaccctaaccttccccggtaaagttaaactttccggttaccggggacgggttaaaccggggaacttaacggaccgttccggttacccgtttaaccgtaaacggggtccaaccgggtacccaaacgggtcccttcccgttccccccgg

SEQ ID NO: 318815 - DNA, 563 bp, Homo sapiens
  misc_feature: GZ8MTXP01BLZ4C.52.75.G09.1.454.CMB.2.raw
tcagcgcagtacgacacgaccggtgctcgatttagtatagacatcaggggggggtctcaggaggcagcgctctcgggacgtctccaccatggcctgggctctgctattcctcaccctcctcactctgggcacaggatcccgggcccagtctgccctgactcagcctgcctccgtgtctgggtctcctggacagtcgatcaccatctcctgcactggaaccagcagtgactagttggtacgttataactatgtctccgtggtaccacaacaccccggcaaacgcccccaaactcatgatttatgctgtcacttatccggcccgcagggtatttcgtcatcgtctttcctcgtggcctccaagtctggcaaccgaccggccctcccctcaccatcctcgtgggcctccgtgactggacggacgagggtcctgtacttattactgcagtctactaactttaacaacgcaacccacctacctcctagtaactcgttcggacgggttacggaccagctcgaccgttcttaggtccacgccaacggccttaccgtccccgttcggtccc

SEQ ID NO: 318816 - DNA, 677 bp, Homo sapiens
  misc_feature: GZ8MTXP01ECY9A.52.75.G09.1.454.CMB.2.raw
  modified_base (404)..(404): a, c, t, g, unknown or other
  misc_feature (404)..(404): n is a, c, g, or t
  modified_base (433)..(433): a, c, t, g, unknown or other
  misc_feature (433)..(433): n is a, c, g, or t
  modified_base (441)..(441): a, c, t, g, unknown or other
  misc_feature (441)..(441): n is a, c, g, or t
  modified_base (643)..(643): a, c, t, g, unknown or other
  misc_feature (643)..(643): n is a, c, g, or t
tcagcgcagtacgacacgaccggtgctcgatttagtatagacatcagggggctggggtctcaggaggcagcgctctcgggacgtctccaccatggcctgggctctgctattcctcaccctcctcctctgggcacaggactcccgggccagtctcgccctgactcagcctgcctccgtgtcgttgggtcctccgtggacagtcgatcaccatctctcgcacgtacggaaccagctagtcgactagtttcggtacttaaataacttatcgtcctacgtacggaaccaacaacccgaccccggactaaaacccgaccccctaaactctatagttatttagcgtactcgtactaacgtttacgcccgggtccgtacggtaggttactttccgactcgtcccgtcttcncgtcgcctaacagtcagaccaacggtccnccttaccnacctactcgtgtcggtctcgtcgtacgtgggacgtacggtcgtagtaagttacttacgtacgtcgtaaacgtctaccttacttaaaccttacgaacgtaccctaaccctaaccgtaccttaccggtaagttaacgttaacgggttccgggaacgggttaaaccggacgtaaacgccgttaccgacccgttaacgtcggaacncccggtaccgacggtccccttaacccggtccccg

SEQ ID NO: 318817 - DNA, 628 bp, Homo sapiens
  misc_feature: GZ8MTXP01CVB5G.52.75.G09.1.454.CMB.2.raw
  modified_base (225)..(225): a, c, t, g, unknown or other
  misc_feature (225)..(225): n is a, c, g, or t
  modified_base (410)..(410): a, c, t, g, unknown or other
  misc_feature (410)..(410): n is a, c, g, or t
tcagcgcagtacgacacgaccggtgctcgatttagtatagacatcagggggctggggtctcaggaggcagcgctctcgggacgtctccaccatggcctgggctctgctattcctcaccctcctcactctgggcacaggactcccgggcccagtctgccctgactcagcctgcctccttgtctgggtctcctggacagtcatcaccatcctcctgcactggaaccngcagtgactattgggtacttaataactatcgtctcctggtacccgacaacccgaccccggacaaaccgacccccaaactcatgtatttatgcttagtactacttacgcccgggcccgacgtaggtactttctctatccccgttcttctcgtcgtcctaacagtcgtcgacaacgtccgccctccncaccatctcgtcggctccgagacgtgaggcgagtctagtattactacgttgcgtagctattacttacactaccacctaccgtacctcgttattaacgttccggttacgggacgggaacggtaaccgaacggttcccggttacgttaaccccggtttccgtaacggtccgacccgggtaacccggaccgggtccccgttccccgggtttcccccccggg

SEQ ID NO: 318818 - DNA, 597 bp, Homo sapiens
  misc_feature: GZ8MTXP01B1NEN.52.75.G09.1.454.CMB.2.raw
  modified_base (208)..(208): a, c, t, g, unknown or other
  misc_feature (208)..(208): n is a, c, g, or t
  modified_base (226)..(226): a, c, t, g, unknown or other
  misc_feature (226)..(226): n is a, c, g, or t
  modified_base (253)..(253): a, c, t, g, unknown or other
  misc_feature (253)..(253): n is a, c, g, or t
  modified_base (294)..(294): a, c, t, g, unknown or other
  misc_feature (294)..(294): n is a, c, g, or t
  modified_base (304)..(305): a, c, t, g, unknown or other
  misc_feature (304)..(305): n is a, c, g, or t
  modified_base (327)..(327): a, c, t, g, unknown or other
  misc_feature (327)..(327): n is a, c, g, or t
tcagcgcagtacgacacgaccggtgctcgatttagtatagacatcaggggggctgggggtctcaggaggcagcgctctcgggacgtctccaccatggcctgggctctgctattcctcaccctcctcactctgggcacaggactcccgggccagtctgccctgactcagcctgcctccgtgtctgggtctccgtggacagtcatcaccntctcctgcactggaaccngcagtgactagttggtacttaatactntctctcgtacgaccacaaccgaccgaacaaccacccaactntatagtattnntctgtactacgttcgccgccgngtagttcttctctctcctcttctcgtcgtcctaacagtcgacgaccaccgtccgtccctcctctactctccgtcgtcggtctcgtacgtacgtaggacgtacgacgtcttagttacttacgttacggcgtactctacttacttaacttaaccgacacccacctacctaccttcgtacgtaacgtcggttacgggacggacggtacctacggttccgttcgttaccggtcgtacgtaaccgaccgaccgttaccgtccgttccccgtcccg

SEQ ID NO: 318819 - DNA, 488 bp, Homo sapiens
  misc_feature: GZ8MTXP02GPBC9.52.75.G09.1.454.CMB.2.raw
tcagcgcagtacgacacgaccggtgctcgatttagtatagacatcagggtgggtctcaggaggcagcgctctcgggacgtctccaccatggcctgggctctgctattcctcaccctcctcactctgggcacaggatcccgggcccagtctgccctgactcagcctgcctccgtgtctgggtctcctggacagtcgatcaccatctcctgcactggaaccagcagtgacattggtcttataactatgtctcctggtaccgacaacaccccggcaaagcccccaaactcatgatttatgctgtcacttatcggcccgcagggatttctcatcgccttctctggctccaagtctggcaacacggcctcctcaccatctctggctcctgactgagcgagctgattatactgcagctcattacaagcacacactcctgtaatctacggcgacggaccagctcgaccgtcaagtcacgccaggctcgccctcgg

SEQ ID NO: 318820 - DNA, 599 bp, Homo sapiens
  misc_feature: GZ8MTXP02IK05N.52.75.G09.1.454.CMB.2.raw
  modified_base (311)..(311): a, c, t, g, unknown or other
  misc_feature (311)..(311): n is a, c, g, or t
  modified_base (336)..(336): a, c, t, g, unknown or other
  misc_feature (336)..(336): n is a, c, g, or t
  modified_base (373)..(373): a, c, t, g, unknown or other
  misc_feature (373)..(373): n is a, c, g, or t
tcagcgcagtacgacacgaccggtgctcgatttagtatagacatcagggcacgaccggtgctcgatttagtatagacatcaggggggggtctcaggaggcagcgctctcgggacgtctccaccatggcctgggctctgctattcctcaccctcctcactctgggcacaggatcccgggcccagtctgccctgactcagcctgcctccgtgtcctgggtctcctggacagtcgatcaccatctcctgcactggaaccagcagtgacattggtcgttaataactatgtctcctgggtaccacaacaccccggnaaacgcccccaaaatcatgatttangctcgtcacttatccggcccgcgaggggtattttccnctactccgtcttctcgtacgtcctaccgaacgtcgtggacaaccgccgtccctcctaccacctatccgtcgtcggtccttaccgtcgacgtgggaacggacggacggtcgtacgtacttacttactcgtcgtacgtacttactaacttaactaaacgacctaaccctaaccctacctaaccgttacgttaacgttacgttacggtaccgggtacgggaacgtaacg

SEQ ID NO: 318821 - DNA, 626 bp, Homo sapiens
  misc_feature: GZ8MTXP02HFATH.52.75.G09.1.454.CMB.2.raw
  modified_base (223)..(223): a, c, t, g, unknown or other
  misc_feature (223)..(223): n is a, c, g, or t
  modified_base (301)..(301): a, c, t, g, unknown or other
  misc_feature (301)..(301): n is a, c, g, or t
  modified_base (322)..(322): a, c, t, g, unknown or other
  misc_feature (322)..(322): n is a, c, g, or t
  modified_base (336)..(336): a, c, t, g, unknown or other
  misc_feature (336)..(336): n is a, c, g, or t
  modified_base (480)..(480): a, c, t, g, unknown or other
  misc_feature (480)..(480): n is a, c, g, or t
tcagcgcagtacgacacgaccggtgctcgatttagtatagacatcagggggctggggtctcaggaggcagcgctctcgggacgtctccaccatggcctgggctctgctattcctcaccctcctcactctgggcacaggatcccgggccagtctgccctgactcagcctgcctccgtgtctgggtctcctggacagtcgatcaccatctcctgcactggaaccngcagtgacattggtcttataactatgtctctggtaccgacaaccaccccggcaaacgcccccaaactcatgactttangctgtctacttatccggcccncgacgggtatttcnctactccgtcttctcgtcggcctaccgaagttccgtgggccaaaccgccggccccttcccctaccaaccctacttcctcccgtcgggtcccttcctcgaccttcggaacggacggtaacgggccttaggtaacttacgtttacncggtccaagtcctactactttaaccgaagtcccaacctacccacttccgtagttaactccgttacgggccgggtaagggaacccacggtccgtacgtaacccggtcgttaacgggccacggacccgaacggtcctccgtcccccgg

SEQ ID NO: 318822 - DNA, 511 bp, Homo sapiens
  misc_feature: GZ8MTXP02JL75G.52.75.G09.1.454.CMB.2.raw
  modified_base (239)..(239): a, c, t, g, unknown or other
  misc_feature (239)..(239): n is a, c, g, or t
  modified_base (376)..(376): a, c, t, g, unknown or other
  misc_feature (376)..(376): n is a, c, g, or t
  modified_base (418)..(418): a, c, t, g, unknown or other
  misc_feature (418)..(418): n is a, c, g, or t
  modified_base (427)..(427): a, c, t, g, unknown or other
  misc_feature (427)..(427): n is a, c, g, or t
tcagcgcagtacgacacgaccggtgctcgatttagtatagacatcagggggggtctcaggaggcagcgctctcgggacgtctccaccatggcctgggctctgctattcctcaccctcctcactctgggcacaggatcccgggcccagtctgccctgactcagcctgcctccgtgtctgggtctcctggacagtcgatcaccatctcctgcactggaaccagcagtgacattggtcttanaactatgtctctggtaccgacaacaccccggcaaacgcccccaaactcatgatttatgctgtcacttatcggcccgcagggtatttcgtcatcgtcttcctctggctcaagtctgcaacgacggcctccctcaaccntctctggcctccgtgactgagacgaggctgattatactgcanctcatttanaacgcaccacactccgtataatcgttacggcggaggaccaaaggcacgaccgttacaggcacgccaacggctcgccctcggtcc

SEQ ID NO: 318823 - DNA, 529 bp, Homo sapiens
  misc_feature: GZ8MTXP02JYL2J.52.75.G09.1.454.CMB.2.raw
  modified_base (331)..(331): a, c, t, g, unknown or other
  misc_feature (331)..(331): n is a, c, g, or t
  modified_base (520)..(520): a, c, t, g, unknown or other
  misc_feature (520)..(520): n is a, c, g, or t
tcagcgcagtacgacacgaccggtgctcgatttagtatagacatcagggggctggggtctcaggaggcagcgctctcgggacgtctccaccatggcctgggctctgctattcctcaccctcctcactctgggcacaggatcccgggcccagtctgccctgactcagcctgcctccgtgtctgggtctcctggacagtcgatcaccatctcctgcactggaaccagcagtgacattggtcttataactatgtctctggtaccgacaacaccccggcaaacgcccccaaactcatgatttatgctgtcacttactcggcccgcagggatttcncatccgcttctctcggctccaagtctgggcaacaccggcctccctcacccatcctcgtcgggctccgtgactggaggacgaggctgatttattactgcagctatatttacagcaccaccactccagttactcttcgggcggacggaccaacgctacgaccgtcgtaggtaccacgacccgaacggtccncgtcccccg

SEQ ID NO: 318824 - DNA, 649 bp, Homo sapiens
  misc_feature: GZ8MTXP02HXMDJ.52.75.G09.1.454.CMB.2.raw
  modified_base (301)..(302): a, c, t, g, unknown or other
  misc_feature (301)..(302): n is a, c, g, or t
tcagcgcagtacgacacgaccggtgctcgatttagtatagacatcagggggctggggtctcaggaggcagcgctctcgggacgtctccaccatggcctgggctctgctattcctcaccctcctcactctgggcacaggactcccgggcccagtctgccctgactcagcctgcctccgtgtctgggtctcctggacagtcgatcaccatctcctgcactggaaccagcagtgacattgggcttataactatgtctctggtaccgacaacaccccggcaaagcccccaaactcatgattttannctgtctacttacgccggccgtcgtaggtctttctctactcccgtcttcctcgtcgtacctaccgtaagtccgtacgaccaaacccgtacccgtcccctccctaccaccctactccgtcgtcggtcctcgtacgtacgtaggacggacggtacggtcttagttatttacttacgttacgtacgtacgtactactacttaactaacgtacctaaccctaaccctacctaccgttaacgttaacgttaccggttaccgggtaccgggtaaccgggaaccgtaacgtaccgtaccgtacccgtaaccggtacgtaccgtaccgtaccgtaccggtaccgtacccgtccccg

SEQ ID NO: 318825 - DNA, 539 bp, Homo sapiens
  misc_feature: GZ8MTXP02F3MDA.52.75.G09.1.454.CMB.2.raw
  modified_base (205)..(205): a, c, t, g, unknown or other
  misc_feature (205)..(205): n is a, c, g, or t
  modified_base (223)..(223): a, c, t, g, unknown or other
  misc_feature (223)..(223): n is a, c, g, or t
  modified_base (320)..(320): a, c, t, g, unknown or other
  misc_feature (320)..(320): n is a, c, g, or t
  modified_base (331)..(331): a, c, t, g, unknown or other
  misc_feature (331)..(331): n is a, c, g, or t
  modified_base (417)..(417): a, c, t, g, unknown or other
  misc_feature (417)..(417): n is a, c, g, or t
  modified_base (419)..(419): a, c, t, g, unknown or other
  misc_feature (419)..(419): n is a, c, g, or t
  modified_base (432)..(432): a, c, t, g, unknown or other
  misc_feature (432)..(432): n is a, c, g, or t
tcagcgcagtacgacacgaccggtgctcgatttagtatagacatcagggggctggggtctcaggaggcagcgctctcgggacgtctccaccatggcctgggctctgctattcctcaccctcctcactctgggcacaggatcccgggccagtctgccctgactcagcctgcctccgtgtctgggtctcctggacagtcgatcaccntctcctgcactggaaccngcagtgacatttggtcttaataactatgtctctggtaccgacaacaccccggcaaacgcccccaaatcatgatttatgctgtcacttatcggcccgnagggtatttcnctatccgtctttctctcggctccaagtctggcaacaccgcctcctcacatctcgtcggctcctgactgagcgagctgattatatgnanctatacttacaancaaccaccactctattaaactcgttcggcggaaggggaccaaacggtcctacggtacccgtaaccgttacggtaccgacgacccgaacggccgtacccgtcccccgg

SEQ ID NO: 318826 - DNA, 515 bp, Homo sapiens
  misc_feature: GZ8MTXP02JVEZW.52.75.G09.1.454.CMB.2.raw
  modified_base (236)..(236): a, c, t, g, unknown or other
  misc_feature (236)..(236): n is a, c, g, or t
  modified_base (308)..(308): a, c, t, g, unknown or other
  misc_feature (308)..(308): n is a, c, g, or t
  modified_base (332)..(332): a, c, t, g, unknown or other
  misc_feature (332)..(332): n is a, c, g, or t
  modified_base (359)..(359): a, c, t, g, unknown or other
  misc_feature (359)..(359): n is a, c, g, or t
tcagcgcagtacgacacgaccggtgctcgatttagtatagacatcagggcacgaccggtgctcgatttagtatagacatcagggggggtctcaggaggcagcgctctcgggacgtctccaccatggcctgggctctgctattcctcaccctcctcactctgggcacaggatcccgggccagtctgccctgactcagcctgcctccgtgtctgggtctcctggacagtcgatcaccntctcctgcactggaaccagcagtgacattggtcgttataactatgtctcctggtacccgacaacaccccggnaaacgcccccaaatcatgatttangctcgtcacttatcggcccgcagggtntttctcattcgcttctctggctccaagtctggcacacgccctccctcaccatctctgggtctcctgactggaggacgaggctagatttagtactgcacgctacactttacacgccaccacctactcctagtaactcttcggcggacgggacaacgg

SEQ ID NO: 318827 - DNA, 517 bp, Homo sapiens
  misc_feature: GZ8MTXP02I7QK0.52.75.G09.1.454.CMB.2.raw
  modified_base (223)..(223): a, c, t, g, unknown or other
  misc_feature (223)..(223): n is a, c, g, or t
  modified_base (300)..(300): a, c, t, g, unknown or other
  misc_feature (300)..(300): n is a, c, g, or t
  modified_base (380)..(380): a, c, t, g, unknown or other
  misc_feature (380)..(380): n is a, c, g, or t
  modified_base (431)..(431): a, c, t, g, unknown or other
  misc_feature (431)..(431): n is a, c, g, or t
tcagcgcagtacgacacgaccggtgctcgatttagtatagacatcagggggctggggtctcaggaggcagcgctctcgggacgtctccaccatggcctgggctctgctattcctcaccctcctcactctgggcacaggatcccgggccagtctgccctgactcagcctgcctccgtgtctgggtctcctggacagtcgatcaccatctcctgcactggaaccngcagtgacattggtcttataactatgtctcctggtaccgacaacaccccggcaaacgcccccaaactcatgatttangctgtcacttatcggcccgcagggatttctcatccgcttctctggctccaagtctggcaacacgcctcctcaccatctcnggctcctgactgagacgaggctgtattattactgcagctactattacgaancaaccaccactcctagtaactcgttcggcggaacgggacaacgctcgaaccgtccgttaaggccacgcccaaggccttcggccccc

SEQ ID NO: 318828 - DNA, 525 bp, Homo sapiens
  misc_feature: GZ8MTXP02IDWBV.52.75.G09.1.454.CMB.2.raw
  modified_base (255)..(255): a, c, t, g, unknown or other
  misc_feature (255)..(255): n is a, c, g, or t
  modified_base (336)..(336): a, c, t, g, unknown or other
  misc_feature (336)..(336): n is a, c, g, or t
  modified_base (351)..(351): a, c, t, g, unknown or other
  misc_feature (351)..(351): n is a, c, g, or t
  modified_base (422)..(422): a, c, t, g, unknown or other
  misc_feature (422)..(422): n is a, c, g, or t
  modified_base (487)..(487): a, c, t, g, unknown or other
  misc_feature (487)..(487): n is a, c, g, or t
tcagcgcagtacgacacgaccggtgctcgatttagtatagacatcagggcacgaccggtgctcgatttagtatagacatcaggggggggtctcaggaggcagcgctctcgggacgtctccaccatggcctgggctctgctattcctcaccctcctcactctgggcacaggatcccgggcccagtctgccctgactcagcctgcctccgtgtctgggtctcctggacagtcgatcaccatctctgcactggaaccngcagtgacattggtcgttataactatgtctcctggtaccacaaaccaccccggcaaaacgccccccaaaatcatgatttangctgtccactttacnccggcccgcaggggtcttttccacacttccgcttctctcgccttccatcgtggaccacgaccgccttcccncacctctctcgtcggtcctctgactgacgcgaggctgtattatctagcacgctctatttacaacnccaccaccactcgtctacgtcgtcggacggacgacacg

SEQ ID NO: 318829 - DNA, 526 bp, Homo sapiens
  misc_feature: GZ8MTXP02HPFJ0.52.75.G09.1.454.CMB.2.raw
  modified_base (239)..(239): a, c, t, g, unknown or other
  misc_feature (239)..(239): n is a, c, g, or t
  modified_base (244)..(244): a, c, t, g, unknown or other
  misc_feature (244)..(244): n is a, c, g, or t
  modified_base (412)..(412): a, c, t, g, unknown or other
  misc_feature (412)..(412): n is a, c, g, or t
tcagcgcagtacgacacgaccggtgctcgatttagtatagacatcagggggggtctcaggaggcagcgctctcgggacgtctccaccatggcctgggctctgctattcctcaccctcctcactctgggcacaggatcccgggcccagtctgccctgactcagcctgcctccgtgtctgggtctcctggacagtcgatcaccatctcctgcactggaaccagcagtgacattggtcttanaactntgtctcctggtaccgacaacaccccggcaaacgcccccaaactccatgatttatgctgtcacttatcggcccgcagggatttctcatcgcttcctctgctcaagtctggcaacacggcctccctcaccatctctgggcctcctgactgagacgagctgacttattacngcagctcatttacagctacaccactcctgtaactcgttacggcggtaggaccaaagtcgtacgaccgttaccgtacggtcgacgacccaagggcctccggccccttcggtaccc

SEQ ID NO: 318830 - DNA, 635 bp, Homo sapiens
  misc_feature: GZ8MTXP02GA3JZ.52.75.G09.1.454.CMB.2.raw
  modified_base (225)..(225): a, c, t, g, unknown or other
  misc_feature (225)..(225): n is a, c, g, or t
  modified_base (231)..(231): a, c, t, g, unknown or other
  misc_feature (231)..(231): n is a, c, g, or t
tcagcgcagtacgacacgaccggtgctcgatttagtatagacatcagggggctggggtctcaggaggcagcgctctcgggacgtctccaccatggcctgggctctgctattcttcaccctcctcactctgggcacaggatcccgggccagtctgccctgactcagcctgcctccgtgtctgggtctcctggacagtcgatcaccatctcctgcactgggaaaccngcagtnactagttggtacttaataactatgtctcgtcgtaaccgacaaccgaccccgacaaaccgaccccaaactcatatatttatcgtctgtactacttacgtccggccgcgtaggtactttctctactcccgtcttctcgtcgtacctaccgtaagtcgtcggaccaaaccgcccgtccctccctacctacctactcctcgtcggtcctccgtacgtacgtcggacggacggacggtacgtagttaattacttactacgtacgtacgtactactaacttaactaaacaccaacccaaccctaacctaccttaacgttaacgttacggttaccgggtacgggaacgggaaccgtaacgaccgtacgtaccgtaaccgtacgtacgacgaccgacgtaccgtccgtcccg

SEQ ID NO: 318831 - DNA, 536 bp, Homo sapiens
  misc_feature: GZ8MTXP02ISCHM.52.75.G09.1.454.CMB.2.raw
  modified_base (225)..(225): a, c, t, g, unknown or other
  misc_feature (225)..(225): n is a, c, g, or t
  modified_base (308)..(308): a, c, t, g, unknown or other
  misc_feature (308)..(308): n is a, c, g, or t
  modified_base (329)..(329): a, c, t, g, unknown or other
  misc_feature (329)..(329): n is a, c, g, or t
  modified_base (339)..(339): a, c, t, g, unknown or other
  misc_feature (339)..(339): n is a, c, g, or t
  modified_base (350)..(350): a, c, t, g, unknown or other
  misc_feature (350)..(350): n is a, c, g, or t
  modified_base (372)..(372): a, c, t, g, unknown or other
  misc_feature (372)..(372): n is a, c, g, or t
tcagcgcagtacgacacgaccggtgctcgatttagtatagacatcagggggctggggtctcaggaggcagcgctctcgggacgtctccaccatggcctgggctctgctattcctcaccctcctcactctgggcacaggatcccgggcccagtctgccctgactcagcctgcctccgtgtctgggtctcctggacagtcgatcaccatctcctgcactggaaaccngcagtgacattggtcttaataactatgtctcctggtaccgacaacacccccggcaaaacgcccccaaactccatcgattttangctgtcacttatccggcccgnagggatttcncatccgcttcnctggctccaagtctggcaaacnccggccctccctcacccatctcgtggctcctgactgagacgaggctgattattactgacagtctacatttacgaacaccaccaccactccctagttaactcgttcgggacggacggaccaacgctacgaccgtccgttagcacgaccgaacgctccgtcccccg

SEQ ID NO: 318832 - DNA, 500 bp, Homo sapiens
  misc_feature: GZ8MTXP02GMYLR.52.75.G09.1.454.CMB.2.raw
  modified_base (299)..(299): a, c, t, g, unknown or other
  misc_feature (299)..(299): n is a, c, g, or t
tcagcgcagtacgacacgaccggtgctcgatttagtatagacatcagggggctggggtctcaggaggcagcgctctcgggacgtctccaccatggcctgggctctgctattcctcaccctcctcactctgggcacaggatcccgggccagtctgccctgactcagcctgcctccgtgtctgggtctcctggacagtcgatcaccatctcctgcactggaaccagcagtgacattggtcttataactatgtctctggtaccgacaacaccccggcaaacgcccccaaactcatgatttangctgtcacttatcggcccgcagggatttctcatccgcttctctcggctccaagtctgcaacacgcctccctcaccatctctggctctgactgagacgaggctgattagtactgcagctcatttacaagcaccacactctgtaactcgttcggcggtaggactacgctacgacgtcgtagtcacgccaagcctcgtcccccg

SEQ ID NO: 318833 - DNA, 515 bp, Homo sapiens
  misc_feature: GZ8MTXP02I2Q57.52.75.G09.1.454.CMB.2.raw
  modified_base (218)..(218): a, c, t, g, unknown or other
  misc_feature (218)..(218): n is a, c, g, or t
  modified_base (239)..(239): a, c, t, g, unknown or other
  misc_feature (239)..(239): n is a, c, g, or t
  modified_base (358)..(358): a, c, t, g, unknown or other
  misc_feature (358)..(358): n is a, c, g, or t
  modified_base (398)..(398): a, c, t, g, unknown or other
  misc_feature (398)..(398): n is a, c, g, or t
  modified_base (402)..(402): a, c, t, g, unknown or other
  misc_feature (402)..(402): n is a, c, g, or t
  modified_base (414)..(415): a, c, t, g, unknown or other
  misc_feature (414)..(415): n is a, c, g, or t
tcagcgcagtacgacacgaccggtgctcgatttagtatagacatcaggggggtctcaggaggcagcgctctcgggacgtctccaccatggcctgggctctgctattcctcaccctcctcactctgggcacaggatcccgggccagtctgccctgactaagcctgcctccgtgtctgggtctcctggacagtcgatcaccatctcctgcactggaaccngcagtgacatttggtcgttanaactatgtctcctggtaccgacaacaccccggcaaacgcccccaaaactccaatgatttatgctgtcacttatcggccgcagggatttctcatcgcttctcctgctccagtctggcacncggcctccctcaccatctctgggctccctgactgagacgnggcngattatactgcnnctctatacacacacacactctactactcgtcggacggacggacgacgtacgcgaccgtacgtacgtacgaacgacgacgcgtccgcccgtccgtacgtcg

SEQ ID NO: 318834 - DNA, 574 bp, Homo sapiens
  misc_feature: GZ8MTXP02JGVTI.52.75.G09.1.454.CMB.2.raw
  modified_base (230)..(230): a, c, t, g, unknown or other
  misc_feature (230)..(230): n is a, c, g, or t
  modified_base (234)..(234): a, c, t, g, unknown or other
  misc_feature (234)..(234): n is a, c, g, or t
  modified_base (243)..(243): a, c, t, g, unknown or other
  misc_feature (243)..(243): n is a, c, g, or t
  modified_base (256)..(256): a, c, t, g, unknown or other
  misc_feature (256)..(256): n is a, c, g, or t
  modified_base (264)..(264): a, c, t, g, unknown or other
  misc_feature (264)..(264): n is a, c, g, or t
  modified_base (268)..(268): a, c, t, g, unknown or other
  misc_feature (268)..(268): n is a, c, g, or t
  modified_base (275)..(275): a, c, t, g, unknown or other
  misc_feature (275)..(275): n is a, c, g, or t
  modified_base (302)..(302): a, c, t, g, unknown or other
  misc_feature (302)..(302): n is a, c, g, or t
  modified_base (304)..(304): a, c, t, g, unknown or other
  misc_feature (304)..(304): n is a, c, g, or t
  modified_base (306)..(306): a, c, t, g, unknown or other
  misc_feature (306)..(306): n is a, c, g, or t
  modified_base (324)..(324): a, c, t, g, unknown or other
  misc_feature (324)..(324): n is a, c, g, or t
tcagcgcagtacgacacgaccggtgctcgatttagtatagacatcagggggctggggtctcaggaggcagcgctctcgggacgtctccaccatggcctgggctctgctattcctcaccctcctcactctgggcacaggactcccgggccagtctgccctgactcagcctgcctccgtgtctgggtctcctggacagtcgatcaccatctcctgcactggaaccagcagtnaacnttggcttanaactatgtctccnggtaccanaacnccccggnaaaagcccccaaatcaatggattttangntntctatactcgcgcgagtnttctctatcctctctctgtctcactcgtcgcaacaccgcctcctccacctactctcgtcggtctccgtcgtacgtacggacggacggacggtcgtacgttaagtttaactttacgtacgtacgtacgtactacttaacttaactaacgaccaaccacctacctactactacttacgtacggtacgggacggaaccgacgacgtacgtaccgtaaccgtacgtacgacgaccgacggtaccgtccgtcccg

SEQ ID NO: 318835 - DNA, 635 bp, Homo sapiens
  misc_feature: GZ8MTXP02F23AI.52.75.G09.1.454.CMB.2.raw
  modified_base (189)..(189): a, c, t, g, unknown or other
  misc_feature (189)..(189): n is a, c, g, or t
  modified_base (217)..(217): a, c, t, g, unknown or other
  misc_feature (217)..(217): n is a, c, g, or t
  modified_base (237)..(237): a, c, t, g, unknown or other
  misc_feature (237)..(237): n is a, c, g, or t
  modified_base (242)..(242): a, c, t, g, unknown or other
  misc_feature (242)..(242): n is a, c, g, or t
  modified_base (291)..(291): a, c, t, g, unknown or other
  misc_feature (291)..(291): n is a, c, g, or t
  modified_base (316)..(316): a, c, t, g, unknown or other
  misc_feature (316)..(316): n is a, c, g, or t
  modified_base (329)..(329): a, c, t, g, unknown or other
  misc_feature (329)..(329): n is a, c, g, or t
tcagcgcagtacgacacgaccggtgctcgatttagtatagacatcgagggggggtctcaggaggcagcgctctcgggactctccaccatggcctgggctctgctattcctcaccctcctcactctgggcacaggatcccgggccagtctgccctgactcagcctgcctcgtgtctgggtctcctggacngtcgatcacatctcctgcactggaaccngcagtgacatttggcttaanaactntgtctctggtaccgacaacacccggcaaagcccccaaatcatgatttangtctgtctacttacgtccggcccgngtaggtactttcncatcgtcttcctcgtcgctacgtaagtcgtacggccaacgaccgtccctcccactacctactcgtcgtacggcctccgtagtacgtggacggacgtacggtacgtaagtaactttaacgttaccgtgacctacgtcgttaccgttaacttaaaccgtaaaccgtaaccaaccctaaccctaaccttaccgttaacgttaaacgttaccgttaccgggtacgggaacgggtaaccgtaacgtacgtaccgtaccgtaccgtacgtaacgtacgaccgtacgtaccgtaccgtacccgtaccgtaccg

SEQ ID NO: 318836 - DNA, 623 bp, Homo sapiens
  misc_feature: GZ8MTXP02FGYGX.52.75.G09.1.454.CMB.2.raw
  modified_base (299)..(299): a, c, t, g, unknown or other
  misc_feature (299)..(299): n is a, c, g, or t
  modified_base (333)..(333): a, c, t, g, unknown or other
  misc_feature (333)..(333): n is a, c, g, or t
  modified_base (348)..(348): a, c, t, g, unknown or other
  misc_feature (348)..(348): n is a, c, g, or t
  modified_base (429)..(429): a, c, t, g, unknown or other
  misc_feature (429)..(429): n is a, c, g, or t
  modified_base (479)..(479): a, c, t, g, unknown or other
  misc_feature (479)..(479): n is a, c, g, or t
tcagcgcagtacgacacgaccggtgctcgatttagtatagacatcagggggctggggtctcaggaggcagcgctctcgggacgtctccaccatggcctgggctctgctattcctcaccctcctcactctgggcacaggatcccgggccagtctgccctgactcagcctgcctccgtgtctgggtctcctggacagtcgatcacatctcctgcactggaaccagcagtgacattggcttataactatgtctcctggtaccgacaacaccccggcaaacgcccccaaaactcatgatttangctgtcacttatccggcccgcgagggtactttcnctatcccgtcttccnctggctaccaagttctcgggacaaacaccggccctccctacaccactcgtccgtgggtctccttagacctggaaggaacgngggtctagtaattacttacgttgtccaaggtcctactaactttaacgaanaccaacccaaccaccgttccctaaggttaaaacttccgtttacgggacgggaacgggaacccgaaaacggtcctacggtacccgtaacccgttaaggtacccgaacggtaccccgaaaacggggccttacccggtcccccccgg

SEQ ID NO: 318837 - DNA, 530 bp, Homo sapiens
  misc_feature: GZ8MTXP02GXVU1.52.75.G09.1.454.CMB.2.raw
  modified_base (302)..(302): a, c, t, g, unknown or other
  misc_feature (302)..(302): n is a, c, g, or t
tcagcgcagtacgacacgaccggtgctcgatttagtatagacatcaggggggggtctcaggaggcagcgctctcgggacgtctccaccatggcctgggctctgctattcctcaccctcctcactctgggcacaggatcccgggcccagtctgccctgactcagcctgcctccgtgtctgggtctcctggacagtcgatcaccatctcctgcactggaaccagcagtgactattgggtcttaataactatgtctcctggtaccgacaacaccccggacaaacgcccccaaactcatgatttangctgtcacttatcggcccgcgagggatttctcatcgtcttcctctgctccaagtctggcaacacgcctccctcaccatctctggcctctgactgagacgaggctgtattattacgtgcagtctactatttaacaacgcaaccacctactccgtataactcgttacggcggaggaccagactacgaccgtcgtacgtcgacgtaccacggcctccgccccgtcgtcccg

SEQ ID NO: 318838 - DNA, 509 bp, Homo sapiens
  misc_feature: GZ8MTXP02IDVOJ.52.75.G09.1.454.CMB.2.raw
  modified_base (223)..(223): a, c, t, g, unknown or other
  misc_feature (223)..(223): n is a, c, g, or t
  modified_base (322)..(322): a, c, t, g, unknown or other
  misc_feature (322)..(322): n is a, c, g, or t
  modified_base (383)..(383): a, c, t, g, unknown or other
  misc_feature (383)..(383): n is a, c, g, or t
  modified_base (420)..(422): a, c, t, g, unknown or other
  misc_feature (420)..(422): n is a, c, g, or t
  modified_base (436)..(436): a, c, t, g, unknown or other
  misc_feature (436)..(436): n is a, c, g, or t
tcagcgcagtacgacacgaccggtgctcgatttagtatagacatcagggggctggggtctcaggaggcagcgctctcgggacgtctccaccatggcctgggctctgctattcctcaccctcctcactctggacacaggatcccgggccagtctgccctgactcagcctgcctccgtgtctgggtctcctggacagtcgatcaccatctcctgcactggaaccngcagtgacattggtcttataactatgtctcctggtaccgacaacaccccggcaaaacgcccccaaactcatcgatttatgctgtcacttatcggcccgnagggatttctcatccgcttctctggctccaagtcctggcaacacgccctccctcaccatcnctcgggctcctgactgagacgaggctgattagttacnnntctactattacacncaccacactcgtatactcgtcggacggacggacacgctcgaccgtcgtacgacacgaccgacgcctccgcccg

SEQ ID NO: 318839 - DNA, 489 bp, Homo sapiens
  misc_feature: GZ8MTXP02JP613.52.75.G09.1.454.CMB.2.raw
  modified_base (327)..(327): a, c, t, g, unknown or other
  misc_feature (327)..(327): n is a, c, g, or t
  modified_base (359)..(359): a, c, t, g, unknown or other
  misc_feature (359)..(359): n is a, c, g, or t
  modified_base (397)..(397): a, c, t, g, unknown or other
  misc_feature (397)..(397): n is a, c, g, or t
  modified_base (399)..(399): a, c, t, g, unknown or other
  misc_feature (399)..(399): n is a, c, g, or t
  modified_base (401)..(401): a, c, t, g, unknown or other
  misc_feature (401)..(401): n is a, c, g, or t
  modified_base (404)..(404): a, c, t, g, unknown or other
  misc_feature (404)..(404): n is a, c, g, or t
  modified_base (406)..(411): a, c, t, g, unknown or other
  misc_feature (406)..(411): n is a, c, g, or t
  modified_base (415)..(415): a, c, t, g, unknown or other
  misc_feature (415)..(415): n is a, c, g, or t
  modified_base (417)..(417): a, c, t, g, unknown or other
  misc_feature (417)..(417): n is a, c, g, or t
tcagcgcagtacgacacgaccggtgctcgatttagtatagacatcaggggctggggtctcaggaggcagcgctctcgggacgtctccaccatggcctgggctctgctattcctcaccctcctcactctgggcacaggatcccgggccagtctgccctgactcagcctgcctccgtgtctgggtctcctggacagtcgatcaccatctcctgcactggaaccagcagtgacattgggtcttataactatgtctcctggtaccgacaacaccccggcaaagcccccaaactcatgatttatgctgtcacttatcgccgcagggatttcncatccgcttctctggctcaagtctggcaaacncgcctccctcacccatctctggctcctgactgagacgngntnatntnnnnnnatanancacacactctctactcgtcgcggacggacgacgacgtcgacgtcgtacgtacgacgaccgacgcgtcgcccg

SEQ ID NO: 318840 - DNA, 556 bp, Homo sapiens
  misc_feature: GZ8MTXP02JRP4F.52.75.G09.1.454.CMB.2.raw
  modified_base (300)..(300): a, c, t, g, unknown or other
  misc_feature (300)..(300): n is a, c, g, or t
tcagcgcagtacgacacgaccggtgctcgatttagtatagacatcaggggggggtctcaggaggcagcgctctcgggacgtctccaccatggcctgggctctgctattcctcaccctcctcactctgggcacaggatcccgggcccagtctgccctgactcagcctgcctccgtgtctgggtctcctggacagtcgatcaccatctcctgcactggaaccagcagtgactattggtcttaataactatgtctcctggtaccgacaacaccccggcaaacgcccccaaactcatgatttangctgtcacttatcggcccgcgagggtatttctctatcgtcttcctctggctacaagtctggcaacacggccctccctcaccatcctctgggcctccgtgactggaggaccgaggtctgtattattactgacagtctactatttaacaagccacctaccactacctagtaaactcgttacgggacggaacggggacaacgcgtacgaccgttccgtaggtccgacgacccgaacggcctacccgccccgtcggtccc

SEQ ID NO: 318841 - DNA, 587 bp, Homo sapiens
  misc_feature: GZ8MTXP02G370C.52.75.G09.1.454.CMB.2.raw
  modified_base (250)..(250): a, c, t, g, unknown or other
  misc_feature (250)..(250): n is a, c, g, or t
  modified_base (267)..(267): a, c, t, g, unknown or other
  misc_feature (267)..(267): n is a, c, g, or t
  modified_base (278)..(278): a, c, t, g, unknown or other
  misc_feature (278)..(278): n is a, c, g, or t
  modified_base (303)..(304): a, c, t, g, unknown or other
  misc_feature (303)..(304): n is a, c, g, or t
  modified_base (307)..(307): a, c, t, g, unknown or other
  misc_feature (307)..(307): n is a, c, g, or t
  modified_base (320)..(320): a, c, t, g, unknown or other
  misc_feature (320)..(320): n is a, c, g, or t
  modified_base (326)..(326): a, c, t, g, unknown or other
  misc_feature (326)..(326): n is a, c, g, or t
tcagcgcagtacgacacgaccggtgctcgatttagtatagacatcaggggggggtctcaggaggcagcgctctcgggactctccaccatggcctgggctctgctattcctcaccctcctcactctgggcacaggactcccgggcccagtctgccctgactcagcctgcctccgtgtctgggtctcctggacagtcgatcaccatcctcctgcacgtggaaccagcagtgaactattggtacttataactntgtctcctggtaccganaacaccccggnaaacgcccccaaaatcatgatttannctntctatcgcgccgngaggtnttctcactctcttcctcgtcgtactactagtcgtcgaccaccgaccgtccctccctaccacctactcctcgtcggtcctcgtacgtacgtggacggacgagtctagtacttacttacgtcgactactactacttaacttaactaacgaccaacccacctacctaccgtacgtacgttaccgttacgggtacggacggacgacgtacgtacgtaccgtacgtacgtaacgacgaccgacgtaccgtccgtcccgtaccgtcg

SEQ ID NO: 318842 - DNA, 603 bp, Homo sapiens
  misc_feature: GZ8MTXP02IN8F6.52.75.G09.1.454.CMB.2.raw
tcagcgcagtacgacacgaccggtgctcgatttagtatagacatcaggggggggtctcaggaggcagcgctctcgggacgtctccaccatggcctgggctctgctattcctcaccctcctcactctgggcacaggatcccgggcccagtctgccctgactcagcctgcctcgtgtctgggtctcctggacagtcgatcaccatcctctgcactggaaccagcagtgactattggtcttaatactatgtctcgtggtaccacaacaccccggcaaacgcccccaaactcatagatttatgtctcgtctaacttagtccggccccgacgagggtactttctctactcgtctttcctctcggtcctccaagttctgggccaacgacccggccctcccctccaccacttcctcgtcgggccttccgtcgtacgtagacggacggacggtctagttattaattacgtgcactcttactatttaaccaagaccaaccctacctaacctctacgttaacgttccgttacggggacggaacgggaccaaacgccgtacgtaccgtcgtacgtaacgaccgaccgaacggcctcccgtccccgtcggtaccc

SEQ ID NO: 318843 - DNA, 557 bp, Homo sapiens
  misc_feature: GZ8MTXP02GRGMZ.52.75.G09.1.454.CMB.2.raw
  modified_base (275)..(275): a, c, t, g, unknown or other
  misc_feature (275)..(275): n is a, c, g, or t
  modified_base (301)..(301): a, c, t, g, unknown or other
  misc_feature (301)..(301): n is a, c, g, or t
  modified_base (321)..(321): a, c, t, g, unknown or other
  misc_feature (321)..(321): n is a, c, g, or t
  modified_base (333)..(333): a, c, t, g, unknown or other
  misc_feature (333)..(333): n is a, c, g, or t
  modified_base (364)..(364): a, c, t, g, unknown or other
  misc_feature (364)..(364): n is a, c, g, or t
  modified_base (372)..(372): a, c, t, g, unknown or other
  misc_feature (372)..(372): n is a, c, g, or t
  modified_base (386)..(386): a, c, t, g, unknown or other
  misc_feature (386)..(386): n is a, c, g, or t
  modified_base (401)..(401): a, c, t, g, unknown or other
  misc_feature (401)..(401): n is a, c, g, or t
  modified_base (419)..(419): a, c, t, g, unknown or other
  misc_feature (419)..(419): n is a, c, g, or t
tcagcgcagtacgacacgaccggtgctcgatttagtatagacatcagggtggggtctcaggaggcagcgctctcgggacgtctccaccatggcctgggctctgctattcctcaccctcctcactctgggcacaggatcccgggcccagtctgccctgactcagcctgcctccgtgtctgggtctcctggacagtcgatcaccatctcctgcatggaaccagcagtgacattggtcgttataactatgtctcctggtaccgacaaccaccccgganaaacgcccccaaaactcatgatttangctgtcacttatcggcccgngagggtatttcntactcgtccttctcgtagcttaccaagttcnggcaaacncgccctcctcaccntctctggtcctcctnacgagacggacgtacggngtagtattattactacgactagtactactaactacacacaccacctacctactactacgtacgtacggacggacggaacgaacgtacgtacgaccgtaccgtaacgacgacgaccgaccgaccgtcccgtcccgtccg

SEQ ID NO: 318844 - DNA, 597 bp, Homo sapiens
  misc_feature: GZ8MTXP02GLR7J.52.75.G09.1.454.CMB.2.raw
  modified_base (340)..(340): a, c, t, g, unknown or other
  misc_feature (340)..(340): n is a, c, g, or t
  modified_base (363)..(363): a, c, t, g, unknown or other
  misc_feature (363)..(363): n is a, c, g, or t
  modified_base (369)..(369): a, c, t, g, unknown or other
  misc_feature (369)..(369): n is a, c, g, or t
  modified_base (374)..(374): a, c, t, g, unknown or other
  misc_feature (374)..(374): n is a, c, g, or t
  modified_base (423)..(423): a, c, t, g, unknown or other
  misc_feature (423)..(423): n is a, c, g, or t
tcagcgcagtacgacacgaccggtgctcgatttagtatagacatcagggcacgaccggtgctcgatttagtatagacatcaggggggggtctcaggaggcagcgctctcgggacgtctccaccatggcctgggctctgctattcctcaccctcctcactctgggcacaggactcccgggccagtctgccctgactcagcctgcctcgtgtctgggtctccgtggacagtcgatcacatctcctgcactggaaccagcagtgacattggtcgttataactatgtctcctggtaccgacaaccaccccggacaaaacgacccccaaaatccatgtaatttangtctgtctacttatccggcccgnagggtntttcncatcgtcttctctcggctcccaaggtctggacaaaccgcggcccttccnccaccacttcctcgtcgggtccttccgttcgacgttagggacggaaccgtagggtcctaggtaaatttcttactggcctaaggtcctactaacgtttaacaacgtaccaacccaccttaccgtccgttaactaaacttccggttacggggacgggtaacggggacctaaacggg

SEQ ID NO: 318845 - DNA, 548 bp, Homo sapiens
  misc_feature: GZ8MTXP02IR4Q4.52.75.G09.1.454.CMB.2.raw
  modified_base (305)..(305): a, c, t, g, unknown or other
  misc_feature (305)..(305): n is a, c, g, or t
  modified_base (442)..(442): a, c, t, g, unknown or other
  misc_feature (442)..(442): n is a, c, g, or t
tcagcgcagtacgacacgaccggtgctcgatttagtatagacatcagggggctggggtctcaggaggcagcgctctcgggacgtctccaccatggcctgggctctgctattcctcaccctcctcactctgggcacaggactcccgggccagtctgccctgactcagcctgcctccgtgtctgggtctccgtggacagtcgatcaccatctcctgcactggaaccagcagtgactattggtcttaataactatgtctcctggtaccgacaacaccccggacaaacgcccccaaactcatgatttangctgtctacttatccggcccgcagggtatttcacatcccgtcttctctggtctccaagtcgtggaccaaacgccgtccctcctcacctctctcgtcgggctccgtgactggaggacgagctagtattattactgcanctacagttacaactcaacccactacctctacgttaactcgttcgggacggaacgggaccacgtactcgaccgtaacgtacggcacgaccaacggcctcgtcccccg

SEQ ID NO: 318846 - DNA, 651 bp, Homo sapiens
  misc_feature: GZ8MTXP02FZRPW.52.75.G09.1.454.CMB.2.raw
tcagcgcagtacgacacgaccggtgctcgatttagtatagacatcagggtggggtctcaggaggcagcgctctcgggacgtctccaccatggcctgggctctgctattcctcaccctcctcactctgggcacaggatcccgggccagtctgccctgactcagcctgcctcgtgtctgggtctcctggacagtcgatcaccatctcctgcactggaaccagcagtgactattggtcttataactatgtctctggtaccgacaacacccggacaaacgaccccaaactcatgtactttatgtctgtcacttagtccggcccgcagggtatttcgtctactcgtccttctctggtcctcgaacgttcgtcggcaaacgaccggtccctccctacacctactcctcgtcggtctccgtgtacgtgacggacggagtcgttagtaatttacttaaccgtgtacgtacgtaccttacttaaactttaaccgaaaccgttacccaacccctaaaccctccttaccgttaacgttaaacgttccggtttaccggggaccggggttaaccgggtaaccgaaacggtccgtaaccggtacccgttaccgttaacgggtaccaccggtacccgaacggtccgtcccgtaccccgtttcccgg

SEQ ID NO: 318847 - DNA, 589 bp, Homo sapiens
  misc_feature: GZ8MTXP02GPZXE.52.75.G09.1.454.CMB.2.raw
  modified_base (471)..(471): a, c, t, g, unknown or other
  misc_feature (471)..(471): n is a, c, g, or t
tcagcgcagtacgacacgaccggtgctcgatttagtatagacatcagggtggggtctcaggaggcagcgctctcgggacgtctccaccatggcctgggctctgctattcctcaccctcctcactctgggcacaggatcccgggcccagtctgccctgactcagcctgcctccgtgtctgggtctcctggacagtcgatcaccatctcctgcactggaaccagcagtgactagttggtcttaatactatgtctctcggtaccgacaaccaccccggacaaaccgaccccaaactcatcgtatttatgctcgtactacgttacgtccggcccgacgtacgggtactttcctactacttcgtccctttctcgtacggtcctactagtctcggacctaaccgaccgtccctcccacaacctctcgtcgtcggtactcgtgacgtgacggacgagtctagtatttatactgcctanactactaattaacacacaccactacgtctagtaacttcggtacgggacggacgaaccgaacgcctacgtaccgtcgttaacgaccacgaaccgacgtcccgtcccgtccccgttccgg

SEQ ID NO: 318848 - DNA, 536 bp, Homo sapiens
  misc_feature: GZ8MTXP02I1X03.52.75.G09.1.454.CMB.2.raw
  modified_base (374)..(374): a, c, t, g, unknown or other
  misc_feature (374)..(374): n is a, c, g, or t
tcagcgcagtacgacacgaccggtgctcgatttagtatagacatcagggggctggggtctcaggaggcagcgctctcgggacgtctccaccatggcctgggctctgctattcctcaccctcctcactctgggcacaggatcccgggccagtctgccctgactcagcctgcctccgtgtctgggtctcctggacagtcgatcaccatctcctgcactggaaccagcagtgacattggtacttataactatgtctctggtaccgacaacaccccggcaaacgcccccaaactcatgactttatgctgtctacttatccggcccgcagggatttcgctatccgcttctctggctccaagtctgcacaccgccctccncaccatctcgtcgggctcctgacgtgaggtacgaggctgtattattactgcacgcttacaatttacaagtccaaccaccactcctagtaacttcgttacggcggaacggtaccaacgccgtcgacccgtcgtacgtccacgccgaacggcctccgtcccccg

SEQ ID NO: 318849 - DNA, 646 bp, Homo sapiens
  misc_feature: GZ8MTXP02JZ52R.52.75.G09.1.454.CMB.2.raw
  modified_base (224)..(224): a, c, t, g, unknown or other
  misc_feature (224)..(224): n is a, c, g, or t
tcagcgcagtacgacacgaccggtgctcgatttagtatagacatcagggggctggggtctcaggaggcagcactctcgggacgtctccaccatggcctgggctctgctattcctcaccctcctcactctgggcacaggatcccgggccagtctgccctgactcagcctgcctccgtgtctgggtctccgtggacagtcgatcaccatctcctgcactggaaccngcagtgactattggtacttaataactatgtctccgtggtaccgacaaccaccccggacaaaccgcccccaaatcatagtatttatgctgtcctacgttacgtcccggccgcgtagggtacttttcgctactcccgtctttctacgtcggcctactaacgtctgggacaaaccgccgtccctccctccacctacttccgtcgtcgggccttccgtgaccgtaggacggtacgacggtcttaggtaactttacgtacgtcggctagtaccttacgtactttaaccgaacgcctaacccacctaccttaccgtaacgttaacgttcccggttacgggaccgggaaacgggtaccaacggtaccgtaccggtaaccgtccgttaacgggaccacccggacccgacggtcccgtcccgtacccccgg

SEQ ID NO: 318850 - DNA, 639 bp, Homo sapiens
  misc_feature: GZ8MTXP02FQ7J7.52.75.G09.1.454.CMB.2.raw
  modified_base (324)..(324): a, c, t, g, unknown or other
  misc_feature (324)..(324): n is a, c, g, or t
  modified_base (335)..(335): a, c, t, g, unknown or other
  misc_feature (335)..(335): n is a, c, g, or t
  modified_base (443)..(443): a, c, t, g, unknown or other
  misc_feature (443)..(443): n is a, c, g, or t
tcagcgcagtacgacacgaccggtgctcgatttagtatagacatcagggtggggtctcaggaggcagcgctctcgggacgtctccaccatggcctgggctctgctattcctcaccctcctcactctgggcacaggatcccgggcccagtctgccctgactcagcctgcctccgtgtctgggtctcctggacagtcgatcaccatctcctgcactggaaccagcagtgactattggtcttataactatgtctctggtaccgacaacaccccggcaaacgacccccaaactcaatgtactttatgctgtcacttactccggcccgnagggtatttcnctactcgtccttctctgctacaagtctggcaaacgacggtccctcctcacctatctcgtcggtctacgtgacgtgacggaccgaagggcctaggtaatttacttaccncgtactacgtacttacgttaaacttaaccgaaccgtaaccctaaccctaaccgtaccttaccgtaacgttaaccgttccggtaccggggaacgggtaaccggaaaccgtaacggtacccgtaccggtacccgttaccgtaaccggtaccgaaccggtacccggtaaccggtcccgtaccccggtccccgttaccgg

SEQ ID NO: 318851 - DNA, 576 bp, Homo sapiens
  misc_feature: GZ8MTXP02F6GUS.52.75.G09.1.454.CMB.2.raw
  modified_base (322)..(322): a, c, t, g, unknown or other
  misc_feature (322)..(322): n is a, c, g, or t
  modified_base (336)..(336): a, c, t, g, unknown or other
  misc_feature (336)..(336): n is a, c, g, or t
  modified_base (387)..(387): a, c, t, g, unknown or other
  misc_feature (387)..(387): n is a, c, g, or t
  modified_base (395)..(395): a, c, t, g, unknown or other
  misc_feature (395)..(395): n is a, c, g, or t
  modified_base (444)..(444): a, c, t, g, unknown or other
  misc_feature (444)..(444): n is a, c, g, or t
tcagcgcagtacgacacgaccggtgctcgatttagtatagacatcagggggctggggtctcaggaggcagcgctctcgggacgtctccaccatggcctgggctctgctattcctcaccctcctcactctgggcacaggatcccgggcccagtctgccctgactcagcctgcctccgtgtctgggtctcctggacagtcgatcaccatctcctgcactggaaccagcagtgacattggtcttataactatgtctctggtaccacaacaccccggcaaacgacccccaaactcatgatttatgctgtctacttactccggcccncgtagggtatttcncgtactccgtcttctctggctcctaagtcgtgacaacaccggcccttcccncaaccctntctcgtgggctctgactggaggacgaggctgtatttattacgtgactancttacctatttaaccagaccacccacctaaccttccgtattaaccgtacgtttcgggacgggtaaacgggacccaaagtccgtacggtaccgtccgttaaggcccacggcccgaaggccctccggtcccccg

SEQ ID NO: 318852 - DNA, 525 bp, Homo sapiens
  misc_feature: GZ8MTXP02GGDZG.52.75.G09.1.454.CMB.2.raw
  modified_base (221)..(221): a, c, t, g, unknown or other
  misc_feature (221)..(221): n is a, c, g, or t
  modified_base (240)..(240): a, c, t, g, unknown or other
  misc_feature (240)..(240): n is a, c, g, or t
  modified_base (298)..(298): a, c, t, g, unknown or other
  misc_feature (298)..(298): n is a, c, g, or t
  modified_base (368)..(368): a, c, t, g, unknown or other
  misc_feature (368)..(368): n is a, c, g, or t
  modified_base (424)..(424): a, c, t, g, unknown or other
  misc_feature (424)..(424): n is a, c, g, or t
  modified_base (433)..(433): a, c, t, g, unknown or other
  misc_feature (433)..(433): n is a, c, g, or t
tcagcgcagtacgacacgaccggtgctcgatttagtatagacatcaggggggggtctcaggaggcagcgctctcgggacgtctccaccatggcctgggctctgctattcctcaccctcctcactctgggcacaggatcccgggcccagtccgccctgactcagcctgcctccgtgtctgggtctcctggacagtcgatcaccatctcctgcactggaaccngcagtgacattggtcttanaactatgtctcctggtaccgacaacacccggcaaacgcccccaaactcatcgatttangctgtcacttatccggccgcagggtactttcgcatcgcttctctggctcaagtctggcacgcggcctccncaccactctctgggctacctgactgaggacgaggtctgtacttagtctagcagctnatttacganccacacctacgtcctgtaactcgttcggacggacgggaccaagcttcgaccgtcgtagtacaacgacccaaggcctcgcccctcggactccg

SEQ ID NO: 318853 - DNA, 791 bp, Homo sapiens
  misc_feature: GZ8MTXP02HNQ7Z.52.75.G09.1.454.CMB.2.raw
  modified_base (209)..(209): a, c, t, g, unknown or other
  misc_feature (209)..(209): n is a, c, g, or t
  modified_base (227)..(227): a, c, t, g, unknown or other
  misc_feature (227)..(227): n is a, c, g, or t
  modified_base (307)..(307): a, c, t, g, unknown or other
  misc_feature (307)..(307): n is a, c, g, or t
tcagcgcagtacgacacgaccggtgctcgatttagtatagacatcagggggctggggtctcaggaggcagcgctctcgggacgtctccaccatggcctgggctctgctattcctcaccctcctcactctgggcacaggactcccgggccagtctcgccctgactcagcctgcctccgtgtctgggtcctcgtggacagtcgatccaccntcctctgcactggaaccngcagtcgactagttggtacttaataactatgtctcgtgtaccacaaccacccggacaaacgaccccaactcatgatttangtctgtctacttacgtccggcccgagtaggtaactttctactactcccgtccttcgtcgtacggtctaccctaagttccgtacgggtactaaaccgaccccggtccccttaccccgtaccctaaaccccacgttcccgttccggttcccgggggacccttacccgttgggtaaccgttacggggtaacggggaccggtacggggttaccttaaggttaacttttaacgtttacgtaacggtcggtacgtacccgttacttaaacgtttaaaccgaaacgttaccccgaaaccctacccgtaacctttacccgtaaacggtttaaaaccgtcccggtttaaccggggaccgggggaaccgggttaaaccgaaccgggttacccgtttaacggaacccccgttaacccggttaacggggttaccccgaaccccggggttaacccgaaaacccgggggtacctttacccccgggtttaccccccggg

SEQ ID NO: 318854 - DNA, 505 bp, Homo sapiens
  misc_feature: GZ8MTXP02I0P6Z.52.75.G09.1.454.CMB.2.raw
  modified_base (216)..(216): a, c, t, g, unknown or other
  misc_feature (216)..(216): n is a, c, g, or t
  modified_base (241)..(241): a, c, t, g, unknown or other
  misc_feature (241)..(241): n is a, c, g, or t
  modified_base (291)..(291): a, c, t, g, unknown or other
  misc_feature (291)..(291): n is a, c, g, or t
  modified_base (312)..(312): a, c, t, g, unknown or other
  misc_feature (312)..(312): n is a, c, g, or t
  modified_base (360)..(360): a, c, t, g, unknown or other
  misc_feature (360)..(360): n is a, c, g, or t
  modified_base (375)..(375): a, c, t, g, unknown or other
  misc_feature (375)..(375): n is a, c, g, or t
tcagcgcagtacgacacgaccggtgctcgatttagtatagacatcaggggggggtctcaggaggcagcgctctcgggacgtctccaccatggcctgggctctgctattcctcaccctcctcactctgggcacaggactcccgggccagtctgccctgactcagcctgcctcgtgtctgggtctcctggacagtcatcacatctctgcatggaaccngcagtgactattggtcttataactntgtctctggtaccacaacacccggcaaacgcccccaaactcatgatttangctgtcacttatcggcccgcngggatttctctatcgtcttcctctgctcaatctgcacacggcctcccncacatctctggctcngctgaggacgagctagacttattacgtgcagtctactatttacaacgcaccaccactcctataacttcgttacggcggaggacaagctacgaccgtctaggtcacgaccacggctaccgcccgtacgtcc

SEQ ID NO: 318855 - DNA, 534 bp, Homo sapiens
  misc_feature: GZ8MTXP02HTDJU.52.75.G09.1.454.CMB.2.raw
  modified_base (269)..(269): a, c, t, g, unknown or other
  misc_feature (269)..(269): n is a, c, g, or t
  modified_base (305)..(305): a, c, t, g, unknown or other
  misc_feature (305)..(305): n is a, c, g, or t
  modified_base (313)..(313): a, c, t, g, unknown or other
  misc_feature (313)..(313): n is a, c, g, or t
  modified_base (378)..(378): a, c, t, g, unknown or other
  misc_feature (378)..(378): n is a, c, g, or t
  modified_base (436)..(439): a, c, t, g, unknown or other
  misc_feature (436)..(439): n is a, c, g, or t
tcagcgcagtacgacacgaccggtgctcgatttagtatagacatcagggtggggtctcaggaggcagcgctctcgggacgtctccaccatggcctgggctctgctattcctcaccctcctcactctgggcacaggactcccggccagtctgccctgactcagcctgcctccgtgtctgggtctcctggacagtcgatcaccatctctgcatggaaccagcagtgactattggtcttaatactatgtctctggtaccacaacaccccggnaaacgccccaaatcatgatttatgctgtcaactttnccggccgntagggatttctccatcgcccttctcctggaccttcaacgttgtcggacaaacgccgtcccttccnccaaacctgtcctgtcgggtctccgtagaccgtgaaggtcgaggcttgtatattactnnnntctatacacacaccacactctactactcgtcggcggacgacgacgacgtcgtaccgtacgtaacgtacgacgaccgacgccgtccgtcccgtccg

SEQ ID NO: 318856 - DNA, 556 bp, Homo sapiens
  misc_feature: GZ8MTXP02JQB8S.52.75.G09.1.454.CMB.2.raw
  modified_base (226)..(226): a, c, t, g, unknown or other
  misc_feature (226)..(226): n is a, c, g, or t
  modified_base (307)..(307): a, c, t, g, unknown or other
  misc_feature (307)..(307): n is a, c, g, or t
  modified_base (327)..(327): a, c, t, g, unknown or other
  misc_feature (327)..(327): n is a, c, g, or t
  modified_base (370)..(370): a, c, t, g, unknown or other
  misc_feature (370)..(370): n is a, c, g, or t
  modified_base (389)..(389): a, c, t, g, unknown or other
  misc_feature (389)..(389): n is a, c, g, or t
  modified_base (426)..(426): a, c, t, g, unknown or other
  misc_feature (426)..(426): n is a, c, g, or t
tcagcgcagtacgacacgaccggtgctcgatttagtatagacatcagggggctggggtctcaggaggcagcgctctcgggacgtctccaccatggcctgggctctgctattcctcaccctcctcactctgggcacaggactcccgggcccagtctgccctgactcagcctgcctccgtgtctgggtctcctggacagtcgatcaccatcctcctgcactggaaccngcagtgacagtttggacttataactatgtctcctggtaccgacaaccaccccggcaaacgcccccaaatccatgactttangctgtcacttatccggcccngagggtactttctcatcccggtcttctctggctaccaagttcnggccaacaccggcctcccncacccatcctcgttgggctcctagactcgaggacggngctagtacttatatcgcacgtctatacgtacaacgaccacctacctacctactacgttacgtcggtacgggacggaacggaaccacgtccgtacgaccgtcgtacgccacgaccgacggccgtccgcccg

SEQ ID NO: 318857 - DNA, 592 bp, Homo sapiens
  misc_feature: GZ8MTXP02IQDJ8.52.75.G09.1.454.CMB.2.raw
  modified_base (222)..(222): a, c, t, g, unknown or other
  misc_feature (222)..(222): n is a, c, g, or t
  modified_base (242)..(242): a, c, t, g, unknown or other
  misc_feature (242)..(242): n is a, c, g, or t
  modified_base (320)..(320): a, c, t, g, unknown or other
  misc_feature (320)..(320): n is a, c, g, or t
  modified_base (487)..(487): a, c, t, g, unknown or other
  misc_feature (487)..(487): n is a, c, g, or t
tcagcgcagtacgacacgaccggtgctcgatttagtatagacatcagggtggggtctcaggaggcagcgctctcgggacgtctccaccatggcctgggctctgctattccctcacccctcctcactctgggcacaggatcccgggccagtctgccctgactcagcctgcctccgtgtctgggtctcctggacagtcgatcaccatctcctgcactggaaccngcagtgacattggtcgttanaactatgtctctgtaccgacaacacccggcaaagcccccaaatcatgtattatgtctgtctacttactccggccccgngtagggtactttctctactcgtccttctctcggtcctactaacgttcctggaccaaccgaccggtccctccccctacaccctacgtcctcgtcggtcctctagaccgtaggacggtacgaggctagtattattaccgtgctagtcctatacttaacaacgccaaccncctactacctagtaacttcgtacggacggacggtaacccaggtcctacggaccccgttacgtaacggtccacgtacccgaacgtccgttaccccgccccgtccgg

SEQ ID NO: 318858 - DNA, 615 bp, Homo sapiens
  misc_feature: GZ8MTXP02JAJ8I.52.75.G09.1.454.CMB.2.raw
  modified_base (204)..(204): a, c, t, g, unknown or other
  misc_feature (204)..(204): n is a, c, g, or t
  modified_base (220)..(220): a, c, t, g, unknown or other
  misc_feature (220)..(220): n is a, c, g, or t
  modified_base (249)..(249): a, c, t, g, unknown or other
  misc_feature (249)..(249): n is a, c, g, or t
  modified_base (277)..(277): a, c, t, g, unknown or other
  misc_feature (277)..(277): n is a, c, g, or t
  modified_base (306)..(306): a, c, t, g, unknown or other
  misc_feature (306)..(306): n is a, c, g, or t
  modified_base (328)..(328): a, c, t, g, unknown or other
  misc_feature (328)..(328): n is a, c, g, or t
tcagcgcagtacgacacgaccggtgctcgatttagtatagacatcaggggggggtctcaggaggcagcgctctcgggacgtctccaccatggcctgggctctgctattcctcaccctcctcactctgggcacaggactcccgggccagtctgccctgactcagcctgcctccgtgtcgtgggtctccgtggacagtcgatcacntctctgcatggaaccngcagtgactagtttggtacttaataactntgtctctggtaccgacaaccaccccggnaaacgcccccaaaactcgactgattttangtctgtcacttatccggcccgngtagggtatttcgctatcgctttcctcgtcgctccaagttctggctaaccgaccggtccctcccctacacctactccgtcgtgggtccctaccgtacggtacgttaggacggacggtaacggtccgttagtaactttaacttaacgttcgcgtacgtctactactttaaacaacgaccaacacctactctataacgtcggttacggacggacggtaaccgaacgtcgtacgtacccgtacttacgggccacgacccaacggtcccgtccgacccccggttggtaccc

SEQ ID NO: 318859 - DNA, 692 bp, Homo sapiens
  misc_feature: GZ8MTXP02G4CA6.52.75.G09.1.454.CMB.2.raw
  modified_base (220)..(220): a, c, t, g, unknown or other
  misc_feature (220)..(220): n is a, c, g, or t
  modified_base (248)..(248): a, c, t, g, unknown or other
  misc_feature (248)..(248): n is a, c, g, or t
  modified_base (303)..(303): a, c, t, g, unknown or other
  misc_feature (303)..(303): n is a, c, g, or t
tcagcgcagtacgacacgaccggtgctcgatttagtatagacatcaggggggggtctcaggaggcagcgctctcgggacgtctccaccatggcctgggctctgctattcctcaccctcctcactctgggcacaggactcccgggccagtctgccctgactcagcctgcctccgtgtctgggtctcctggacagtcgatcaccatctctgcactggaaccngcagtgactagttggtacttaataactntgtctcctggtaccgacaaccaccccggcaaacgcccccaaatccatgtatttangtactgtctacttacgtccggcccgacgagggtatttctctactcgtcttcctcgtggtcctacctaagttccgttacggacctaaaccgacccggtccccttcccctccaaccctacgttccctccgttcggggtccttcccgttacggtacttcggggaacgggaccgggacggtccgttaggtaactttacttaacgtcgactacgtaccttactaactttaaaccgaaacgtacccaaaccctaccgtaccttacccttaggttaaaccttcccggtttaccggggaccggggaaaccgggtaccgtaaagcccgtacggtacccgtccgttaacggaaccgaccggaccctaacgggcctacccggtcccccgtacggtacccc

SEQ ID NO: 318860 - DNA, 620 bp, Homo sapiens
  misc_feature: GZ8MTXP02JQIIW.52.75.G09.1.454.CMB.2.raw
  modified_base (203)..(203): a, c, t, g, unknown or other
  misc_feature (203)..(203): n is a, c, g, or t
  modified_base (220)..(220): a, c, t, g, unknown or other
  misc_feature (220)..(220): n is a, c, g, or t
  modified_base (248)..(248): a, c, t, g, unknown or other
  misc_feature (248)..(248): n is a, c, g, or t
  modified_base (304)..(304): a, c, t, g, unknown or other
  misc_feature (304)..(304): n is a, c, g, or t
  modified_base (328)..(328): a, c, t, g, unknown or other
  misc_feature (328)..(328): n is a, c, g, or t
tcagcgcagtacgacacgaccggtgctcgatttagtatagacatcaggggggggtctcaggaggcagcgctctcgggacgtctccaccatggcctgggctctgctattcctcaccctcctcactctgggcacaggactcccgggccagtctgccctgactcagcctgcctccgtgtctgggtctcctggacagtcgatcaccntctctgcactggaaccngcagtgactagttggtacttaataactntgtctcctggtaccacaaccaccccggacaaacgcccccaaactcatcgtatttangtctgctacttacgtccggcccgngagggtactttctcctatcgtcttccctcgtcggtctaccaagtctacggccaaaaccgccggtcccctccctacaaccctctcccttcgtcggggtacccttccgttacggacgttacgggagggacggtacgggtaccttaggttaatttacttaccgtgacgtacgacttctaacttacaacgaccaaccctacaccttctacgttaaactcggttacgggacggacggaccaaggctacgaccgttcgtagaaccgacgaccgacggcctcccgtcccgtcggtaccc

SEQ ID NO: 318861 - DNA, 607 bp, Homo sapiens
  misc_feature: GZ8MTXP02HEBMD.52.75.G09.1.454.CMB.2.raw
  modified_base (194)..(194): a, c, t, g, unknown or other
  misc_feature (194)..(194): n is a, c, g, or t
  modified_base (203)..(203): a, c, t, g, unknown or other
  misc_feature (203)..(203): n is a, c, g, or t
  modified_base (299)..(299): a, c, t, g, unknown or other
  misc_feature (299)..(299): n is a, c, g, or t
tcagcgcagtacgacacgaccggtgctcgatttagtatagacatcagggggctggggtctcaggaggcagcgctctcgggacgtctccaccatggcctgggctctgctattcctcaccctcctcactctgggcacaggactcccgggccagtctgccctgactcagcctgcctccgtgtctggtctcctggacngtcatcacntctcctgcactaggaaccagcagtgactagttggtacttataactatgtctctgtaccgacaaccacccggacaacgccccaaactcatgatttangtctgtctacttacgtccggcccgtcaagggtctttcctactatccccgtcttcctccgtggcctaccgaaagttccgtagggacctaaaccgccggtcccccttcccaccctacctacttccgtcgttcgggtcctccgtacgtacgtcggaagggaacgtacgggtcctagttaacttacgttactcgtactacgtctactaatttaccgactaccacctacctacgtctagttaactcgtcggtacgggacgaccgacgacctcgaccgtaacgtacgactacgaccgacggtcctcccgtcccg

SEQ ID NO: 318862 - DNA, 664 bp, Homo sapiens
  misc_feature: GZ8MTXP02JGYE7.52.75.G09.1.454.CMB.2.raw
  modified_base (222)..(222): a, c, t, g, unknown or other
  misc_feature (222)..(222): n is a, c, g, or t
  modified_base (630)..(630): a, c, t, g, unknown or other
  misc_feature (630)..(630): n is a, c, g, or t
  modified_base (640)..(640): a, c, t, g, unknown or other
  misc_feature (640)..(640): n is a, c, g, or t
tcagcgcagtacgacacgaccggtgctcgatttagtatagacatcagggtggggtctcaggaggcagcgctctcgggacgtctccaccatggcctgggctctgctattcctcaccctcctcactctgggcacaggactcccgggcccagtctgccctgactcagcctgcctccgtgtctgggtctccgtggacagtcgatcaccatctctgcatcggaaccngcagtgactagtttggtacgttaataactatcgtctccgttaggtaccgaacaaccgaccccggacaaaccgacccccaaatcactgtatttatgtctcgtctacttagtccggcccgacgtagggtactttccactagtccgtccttcctcgtcggaccttccgtaacggttctcgggaccaacgtacccggtccctccccttacacctactcccgtcgtccgggtccttccgtcgaccgtacgaacgggcgtacgtactagttaacttacgttacgaggaccgtagtaccgtttactaaacgttaacccaccgaaaccccctaacctaacccgtaccttaccgtacgtaacgtttcggtaccgggaccggaaacgacgtaccgtcgaccgttcgtaccgtgaaccnccggtaaccnccgtccgacccgtcccgtaacccg

SEQ ID NO: 318863 - DNA, 531 bp, Homo sapiens
  misc_feature: GZ8MTXP02FEXDE.52.75.G09.1.454.CMB.2.raw
  modified_base (320)..(320): a, c, t, g, unknown or other
  misc_feature (320)..(320): n is a, c, g, or t
  modified_base (342)..(342): a, c, t, g, unknown or other
  misc_feature (342)..(342): n is a, c, g, or t
  modified_base (357)..(357): a, c, t, g, unknown or other
  misc_feature (357)..(357): n is a, c, g, or t
  modified_base (373)..(373): a, c, t, g, unknown or other
  misc_feature (373)..(373): n is a, c, g, or t
  modified_base (391)..(391): a, c, t, g, unknown or other
  misc_feature (391)..(391): n is a, c, g, or t
  modified_base (405)..(405): a, c, t, g, unknown or other
  misc_feature (405)..(405): n is a, c, g, or t
  modified_base (420)..(420): a, c, t, g, unknown or other
  misc_feature (420)..(420): n is a, c, g, or t
  modified_base (426)..(426): a, c, t, g, unknown or other
  misc_feature (426)..(426): n is a, c, g, or t
tcagcgcagtacgacacgaccggtgctcgatttagtatagacatcagggggctggggtctcaggaggcagcgctctcgggacgtctccaccatggcctgggctctgctattcctcaccctcctcactctgggcacaggatcccgggcccagtctgccctgactcagcctgcctccgtgtctgggtctcctggacagtcgatcaccatctcctgcactggaaccagcagtgacattggtcttataactatgtctcctggtaccgacaacaccccggcaaagcccccaaactcatgatttatgactgtcacttatcggcccncagggattctctatccgcttcnctggctccaagttcnggcaacgacgcctccncactatctctcggctccngactgagacgagcngatatactgcagctnacttanaagcaccaaccactcctagtaactcttaccgggacggacggggaccaaacgtccgtcgaacccgttccgaacggttccacgccctaaacgggcttccgccccccg

SEQ ID NO: 318864 - DNA, 614 bp, Homo sapiens
  misc_feature: GZ8MTXP02JZHWT.52.75.G09.1.454.CMB.2.raw
  modified_base (221)..(221): a, c, t, g, unknown or other
  misc_feature (221)..(221): n is a, c, g, or t
  modified_base (298)..(298): a, c, t, g, unknown or other
  misc_feature (298)..(298): n is a, c, g, or t
tcagcgcagtacgacacgaccggtgctcgatttagtatagacatcaggggggggtctcaggaggcagcgctctcgggacgtctccaccatggcctgggctctgctattcctcaccctcctcactctgggcacaggatcccgggcccagtctgccctgactcagcctgcctccgtgtctgggtctcctggacagtcgatcaccatctcctgcactggaaccngcagtgacattggtcgttaataactatgtctctggtaccgacaacaccccggcaaacgccccaaactcatgatttangctgtcacttatcggcccgcagggtatttcgtctatcgctttcctcgtgctaccaagtctggccaaacgccggccctcccctcacccattcccgtcgtcggggtcccttccgtcgacgttgacggaccggaggtaccgttagtaatttacttaacgttcggacacggtcttactatttaacaaacgtccaacccacctaaccttcccttagtaaacgttccgtttcgggaccgggtaacgggacccaaaggtccgtcgaacccgttccgttaacggccgacggacccgacggtacctccggcccccgttcggtccc

SEQ ID NO: 318865 - DNA, 559 bp, Homo sapiens
  misc_feature: GZ8MTXP02FOAP7.52.75.G09.1.454.CMB.2.raw
  modified_base (428)..(428): a, c, t, g, unknown or other
  misc_feature (428)..(428): n is a, c, g, or t
tcagcgcagtacgacacgaccggtgctcgatttagtatagacatcagggggctggggtctcaggaggcagcgctctcgggacgtctccaccatggcctgggctctgctattcctcaccctcctcactctgggcacaggatcccgggcccagtctgccctgactcagcctgcctccgtgtctgggtctcctggacagtcgatcaccatctcctgcactggaaaccagcagtgacattggtcttataactatgtctcctggtaccgacaacacccccggcaaagccccccaaactcatgatttatgctgtcacttatccggcccgcagggtatttctcatccgctttctctggctccaagtctgggcaacaccggcctccctcaccatctctgggctcctgactggaggacgaggctgtattattactgnagctactatttaacaacgaccaccaccacctcctagttaaactcgtttcggccgggtaggggaaccctaaagccgtagacccgtaaccgtacgggtccaacgccccgaaacggtcccgtccgtcccccccg

SEQ ID NO: 318866 - DNA, 688 bp, Homo sapiens
  misc_feature: GZ8MTXP02JQYB9.52.75.G09.1.454.CMB.2.raw
  modified_base (232)..(232): a, c, t, g, unknown or other
  misc_feature (232)..(232): n is a, c, g, or t
  modified_base (252)..(252): a, c, t, g, unknown or other
  misc_feature (252)..(252): n is a, c, g, or t
  modified_base (282)..(282): a, c, t, g, unknown or other
  misc_feature (282)..(282): n is a, c, g, or t
tcagcgcagtacgacacgaccggtgctcgatttagtatagacatcagggtggggtctcaggaggcagcgctctcgggacgtctccaccatggcctgggctctgctattcctcaccctcctcactctgggcacaggactcccgggcccagtcctgccctgactcacgcctgcctccgtgtctgggtcctccgtggacagtcgatcaccatctcctgcacgtgaaccagcagtnacatttggtcttaataactntgtcctcgtgtaccgacaaaccgcccgganaaaccgccccaaatcatgtatttagcgactgtacctacgtttacgtcccgggaccccgtagtaaggtttactttccctactaactttccggtacccctttccgttacgtcgggtaccctttacccgaaaggttcctcggggacccaaaaccggtccccggtcccccttccccctaccaaccctacggttcccttcgtaccggggtcccttcccgtacgaccgttagggaacgggacgttacgggaccttaggtactttaaacgtgtacgcaacgtcctactaaccttaacgaactacccgaaccacctacggtacctagttaaacctccggtcgggacggaacggaactacggtcctacggtaccctacggtaacgacacggaccgacggtcctcccgccgtaccg

SEQ ID NO: 318867 - DNA, 728 bp, Homo sapiens
  misc_feature: GZ8MTXP02G6P9U.52.75.G09.1.454.CMB.2.raw
  modified_base (224)..(224): a, c, t, g, unknown or other
  misc_feature (224)..(224): n is a, c, g, or t
tcagcgcagtacgacacgaccggtgctcgatttagtatagacatcagggggctggggtctcaggaggcagcgctctcgggacgtctccaccatggcctgggctctgctattcctcaccctcctcactctgggcacaggatcccgggcccagtctgccctgactcagcctgcctccgtgtctgggtctcctggacagtcgatcaccatctcctgcactggaaccngcagtgacattggtcttaataactatgtctcctggtaccgacaaccaccccggcaaacgcccccaaactcatgatttatgctgtactacttatccggcccgcgagggtactttctctagtccctcctttctcgtcggtctaccgaacgtcgtacgggacaaaccgaccggtcccctccctaccaaaccctacttccgttcccgtgggtccttaccctggaaacccttggggaacggacccgggagggtaccttaggtaattttaacttaaccggttggtacaaacgggtccttacctaaacgttttaaaccgaaacgtacccaaacccaaaccccgtaaacctttcccgttaaactttaaaaccgttcccgtttacgggggtaccgggtaaacgggggaaaccaaaacggttccgaaccgggttaacccggtttaacccggaaacggggttcccaaacggtacccccgaaaacgggggttcccttaccccggtccccccccggg

SEQ ID NO: 318868 - DNA, 552 bp, Homo sapiens
  misc_feature: GZ8MTXP02IND1W.52.75.G09.1.454.CMB.2.raw
  modified_base (303)..(303): a, c, t, g, unknown or other
  misc_feature (303)..(303): n is a, c, g, or t
  modified_base (401)..(401): a, c, t, g, unknown or other
  misc_feature (401)..(401): n is a, c, g, or t
  modified_base (441)..(441): a, c, t, g, unknown or other
  misc_feature (441)..(441): n is a, c, g, or t
tcagcgcagtacgacacgaccggtgctcgatttagtatagacatcagggggctggggtctcaggaggcagcgctctcgggacgtctccaccatggcctgggctctgctattcctcaccctcctcactctgggcacaggatcccgggccagtctgccctgactcagcctgcctccgtgtctgggtctcctggacagtcgatcaccatctcctgcactggaaccagcagtcgactattggtcttataactatgtctctggtaccgacaacaccccggacaaacgcccccaaactccatgatttangctgtacacttatccggccgcagggtactttcgtctatcccgtcttctctcggctccgaatcgtgacctaacgacccgtccctccctacaccattccncgtcggctcctgactgacgtacgagctagtattacgtacngcagtctatacttacaagccacactactctataactcttacggcggtaacgaacctacgactacgtaccgtaacgtacgtaccacgacccaaggtccctccgtacccccgg

SEQ ID NO: 318869 - DNA, 548 bp, Homo sapiens
  misc_feature: GZ8MTXP02FID6P.52.75.G09.1.454.CMB.2.raw
  modified_base (223)..(223): a, c, t, g, unknown or other
  misc_feature (223)..(223): n is a, c, g, or t
  modified_base (241)..(241): a, c, t, g, unknown or other
  misc_feature (241)..(241): n is a, c, g, or t
  modified_base (300)..(300): a, c, t, g, unknown or other
  misc_feature (300)..(300): n is a, c, g, or t
  modified_base (321)..(321): a, c, t, g, unknown or other
  misc_feature (321)..(321): n is a, c, g, or t
  modified_base (345)..(345): a, c, t, g, unknown or other
  misc_feature (345)..(345): n is a, c, g, or t
  modified_base (371)..(371): a, c, t, g, unknown or other
  misc_feature (371)..(371): n is a, c, g, or t
  modified_base (382)..(382): a, c, t, g, unknown or other
  misc_feature (382)..(382): n is a, c, g, or t
  modified_base (408)..(408): a, c, t, g, unknown or other
  misc_feature (408)..(408): n is a, c, g, or t
tcagcgcagtacgacacgaccggtgctcgatttagtatagacatcagggggctgggggtctcaggaggcagcgctctcgggacgtctccaccatggcctgggctctgctattcctcaccctcctcactctgggcacaggatcccgggcccagtctgccctgactcagcctgcctcgtgtctgggtctctggacagtcgatcaccatctcctgcactggaaccngcagtgacattggcttanaactatgtctcctgtaccgacaaccaccccggcaaacgcccccaaactcatgactttangctgtcacttagccggcccgnagggtatttctcatcccgctttcncgttggcttccaagtcgtggcaaacnccggccttccncacctactctctgggcctcctgacgnggacggacgacgtctagtattacgtacgtcgcgtacgtctactacttacgaacaccaccacctactctagtactcgtacggacggacggaccacgtcgtacgtaccgtcgtacgtacgacgaccgacgtcctccgtcccg

SEQ ID NO: 318870 - DNA, 734 bp, Homo sapiens
  misc_feature: GZ8MTXP02GD9SQ.52.75.G09.1.454.CMB.2.raw
  modified_base (225)..(225): a, c, t, g, unknown or other
  misc_feature (225)..(225): n is a, c, g, or t
  modified_base (280)..(280): a, c, t, g, unknown or other
  misc_feature (280)..(280): n is a, c, g, or t
tcagcgcagtacgacacgaccggtgctcgatttagtatagacatcagggggctggggtctcaggaggcagcgctctcgggacgtctccaccatggcctgggctctgctattcctcaccctcctcactctgggcacaggactcccgggccagtctgccctgactcagcctgcctccgtgtctgggtctcctggacagtcgatcaccatctcctgcactggaaaccngcagtgaactagttggtacttaataactatgtctctggtaccacaacaccccggnaaacgcccccaaactcatgatttatgactgtactacttactccgggtcccgcgtacgggtactttctactacgtcccgtcttcctcgtcggtcctaccgtaacgttccgtagggaccaaaccgtaccggtcccccttccctaccaccctaacttccttccggtcggggtccttcccgtcggtacgtacggggtaacggaaacccggggtaggtaccgttagggttaactttaacttaaacgttcggtacaacgttaccggttacttaactttaaaccgaaacggttcccaaacccctaacctaaccctttacgttaacgtttaaaaccgttccggtttaccgggggaccgggtaaaccggggaaaccgtacgtacccgtacggtaacccgttaaccggtaacggttaccgtaaccggtaccccgaacggtccccgtacccgtttaccccccggg

SEQ ID NO: 318871 - DNA, 626 bp, Homo sapiens
  misc_feature: GZ8MTXP02GULY8.52.75.G09.1.454.CMB.2.raw
  modified_base (255)..(255): a, c, t, g, unknown or other
  misc_feature (255)..(255): n is a, c, g, or t
  modified_base (277)..(277): a, c, t, g, unknown or other
  misc_feature (277)..(277): n is a, c, g, or t
  modified_base (345)..(345): a, c, t, g, unknown or other
  misc_feature (345)..(345): n is a, c, g, or t
  modified_base (372)..(372): a, c, t, g, unknown or other
  misc_feature (372)..(372): n is a, c, g, or t
  modified_base (386)..(386): a, c, t, g, unknown or other
  misc_feature (386)..(386): n is a, c, g, or t
tcagcgcagtacgacacgaccggtgctcgatttagtatagacatcagggcacgaccggtgctcgatttagtatagacatcaggggggggtctcaggaggcagcgctctcgggacgtctccaccatggcctgggctctgctatcctcaccctcctcactctgggcacaggactcccgggcccagtctgccctgactcagcctgcctccgtgtctgggtctcctggacagtcgatcacatctcctgcactggaaccngcagtcgactattggtcttaanaactatgtcctccgtggtaacccacaaccgaccccggacaaaacgcccccaaaatccgattgatttangtctcgtactacttacgcccggcccgntaagggtctttccnctactcctcttctcgtacgtctacgtacgtcgtacgaccaccgtcccgtccctaccgtacctacctacgttcgtcgtcggtcctcgtacgacgtacgggacgacgaggtacgtagttaacttacgtacgtcgtactacgtaccttacttaacttaaccgaaccgtaccctaaccctacccgttaaccttaaccgtacgtaaccggtttcggtaccgggtaccggtacggtaaccgtacgg

SEQ ID NO: 318872 - DNA, 654 bp, Homo sapiens
  misc_feature: GZ8MTXP02F62XT.52.75.G09.1.454.CMB.2.raw
  modified_base (207)..(207): a, c, t, g, unknown or other
  misc_feature (207)..(207): n is a, c, g, or t
  modified_base (260)..(260): a, c, t, g, unknown or other
  misc_feature (260)..(260): n is a, c, g, or t
  modified_base (274)..(274): a, c, t, g, unknown or other
  misc_feature (274)..(274): n is a, c, g, or t
  modified_base (281)..(281): a, c, t, g, unknown or other
  misc_feature (281)..(281): n is a, c, g, or t
tcagcgcagtacgacacgaccggtgctcgatttagtatagacatcagggcacgaccggtgctcgatttagtatagacatcaggggggggtctcaggaggcagcgctctcgggacgtctccaccatggcctgggctctgctatcctcaccctcctcactctgggcacaggatcccgggccagtctgccctgactcagcctgcctcgtntctgggtcctcctggacagtcatcacctatctctgcacgtggaaccagcagtnctattgggtcttanaaacttntcgtctcgtacgtacccaacaacccgacccgaacaaacccgtaacccccaaatctagttagtattagtcgtctcgtactacgttacgtccggacccgtacgtaggttctttcactacgttccgtcttctcgtacgtccttaccgtaagtccgtacggaccaaccgtcccgtccccttaccccaccgtacctactccgttaccggtccggtccttccgtagacgtacgggaaccggtacggtacggtactaagttaactttacgtactcgtacgtacgtacttaccttacttaactaacctaccctaaccctaaccctacctaaccgtacgttaacgttacggttacgggtaccgggtaaccggaaccggtacg

SEQ ID NO: 318873 - DNA, 728 bp, Homo sapiens
  misc_feature: GZ8MTXP02GS5OZ.52.75.G09.1.454.CMB.2.raw
  modified_base (224)..(224): a, c, t, g, unknown or other
  misc_feature (224)..(224): n is a, c, g, or t
  modified_base (278)..(278): a, c, t, g, unknown or other
  misc_feature (278)..(278): n is a, c, g, or t
  modified_base (302)..(302): a, c, t, g, unknown or other
  misc_feature (302)..(302): n is a, c, g, or t
tcagcgcagtacgacacgaccggtgctcgatttagtatagacatcagggggctggggtctcaggaggcagcgctctcgggactctccaccatggcctgggctctgctattcctcaccctcctcactctgggcacaggatcccgggcccagtctgccctgactcagcctgcctccgtgtctgggtctcctggacagtcgatcaccatcctcctgcactggaaccngcagtgactattggtacttataactatgtctccgtgtaccacaccaccccgganaaacgcccccaaatcatgatttangtctgtactacttacgtcccggacccgacgtagggtactttctctaattccccgtcctttcgtcgtacggtctacccgtaaagtccgtacggacctaaaccgcccggccccttacccctacaacccctatcccgtccgtcgggtcccttcccgttagacgttacgggaacggtaccggagggtaccttaggttaaatttacgtttaacgcggtactaacggtccttaataaacgtttaacaaaccggcctaaaccccgtaaccctaacgttaccctaaggtttaaacccgttaccgggtttaaccggggacgggtaaaccggggaaccctaaaacgtccgttaaccgggtaaccccgttaaccggtaaccggttaccgtaaccggtaaccccgaaacgggtacccccgttacccgttcccccccgg

SEQ ID NO: 318874 - DNA, 572 bp, Homo sapiens
  misc_feature: GZ8MTXP02F3WVE.52.75.G09.1.454.CMB.2.raw
  modified_base (210)..(210): a, c, t, g, unknown or other
  misc_feature (210)..(210): n is a, c, g, or t
  modified_base (237)..(237): a, c, t, g, unknown or other
  misc_feature (237)..(237): n is a, c, g, or t
  modified_base (258)..(258): a, c, t, g, unknown or other
  misc_feature (258)..(258): n is a, c, g, or t
  modified_base (261)..(261): a, c, t, g, unknown or other
  misc_feature (261)..(261): n is a, c, g, or t
  modified_base (288)..(288): a, c, t, g, unknown or other
  misc_feature (288)..(288): n is a, c, g, or t
  modified_base (301)..(301): a, c, t, g, unknown or other
  misc_feature (301)..(301): n is a, c, g, or t
  modified_base (335)..(335): a, c, t, g, unknown or other
  misc_feature (335)..(335): n is a, c, g, or t
  modified_base (355)..(355): a, c, t, g, unknown or other
  misc_feature (355)..(355): n is a, c, g, or t
  modified_base (361)..(361): a, c, t, g, unknown or other
  misc_feature (361)..(361): n is a, c, g, or t
  modified_base (364)..(364): a, c, t, g, unknown or other
  misc_feature (364)..(364): n is a, c, g, or t
tcagcgcagtacgacacgaccggtgctcgatttagtatagacatcagggcacgaccggtgctcgatttagtatagacatcagggggggtctcaggaggcagcgctctcgggacgtctccaccatcggcctgggctctgctatcctcaccctcctcactctgggcacgaggactcccgggccagtctcgccctgactcagcctgcctccgntctgggtctcctggacagtcgatcacntctcctgcatcggaaccagcngtnacagttggtacttaatactatgtctcnggtaccacaaccncccggaaaaccgcccctaaaatcagtctaatttncgtctcgtctactcgccgcngtagtntcntactcgtcttcgtctcgtacctactacgtcgtacgacaccgtccgtccctcctacacctactcgtcgtcgtcgtctcgtcgtacgacgacgtacgtacgtacgttacttactacgtcgtacgtacgtactactaactaacgtaaccgacctaccctacctacctaaccgtacgttacgttacggtaccggtacggtaacggacgtacg

SEQ ID NO: 318875 - DNA, 597 bp, Homo sapiens
  misc_feature: GZ8MTXP02HIEMU.52.75.G09.1.454.CMB.2.raw
  modified_base (310)..(310): a, c, t, g, unknown or other
  misc_feature (310)..(310): n is a, c, g, or t
  modified_base (397)..(397): a, c, t, g, unknown or other
  misc_feature (397)..(397): n is a, c, g, or t
tcagcgcagtacgacacgaccggtgctcgatttagtatagacatcagggtggggtctcaggaggcagcgctctcgggacgtctccaccatggcctgggctctgctattcctcaccctcctcactctgggcacaggactcccgggcccagtcctgccctgactcagcctgcctcgtgtctgggtctcgtggacagtcgatcaccatcctcctgcacgtaggaaccagcagtgactattggtattataactatctctcgtacggaccgaacaaccgaccccggaacaaaccgaccccctaaaactcaacgtnttaatttactgcgtctactacttacgtccggcccgtaggacgggtacttctcattccgtcccttctcgtcgtactaccaagttccgngaccaacgccgtccctcccttacacctcgtccgtcgtcggtccctacgtcggaacgtcggacgacggagtaccgtagtattacttagcgctaatcttaactaaactacgactacaacctcctaactccgtatacgttcggacggcgacgacacgcctacgcctcgaacgtcgaccgtacgcggtccgtccgtccgtaccg

SEQ ID NO: 318876 - DNA, 545 bp, Homo sapiens
  misc_feature: GZ8MTXP02GCDQ5.52.75.G09.1.454.CMB.2.raw
  modified_base (257)..(257): a, c, t, g, unknown or other
  misc_feature (257)..(257): n is a, c, g, or t
  modified_base (278)..(278): a, c, t, g, unknown or other
  misc_feature (278)..(278): n is a, c, g, or t
  modified_base (283)..(283): a, c, t, g, unknown or other
  misc_feature (283)..(283): n is a, c, g, or t
  modified_base (288)..(288): a, c, t, g, unknown or other
  misc_feature (288)..(288): n is a, c, g, or t
  modified_base (339)..(339): a, c, t, g, unknown or other
  misc_feature (339)..(339): n is a, c, g, or t
  modified_base (381)..(381): a, c, t, g, unknown or other
  misc_feature (381)..(381): n is a, c, g, or t
tcagcgcagtacgacacgaccggtgctcgatttagtatagacatcagggcacgaccggtgctcgatttagtatagacatcaggggggggtctcaggaggcagcgctctcgggacgtctccaccatggcctgggctctgctattcctcaccctcctcactctgggcacaggactcccgggccagtctgccctgactcagcctgcctcgtgtctggtctcgtggacagtcgatcacctatctcctgcacgtcggaaccngcagtgactgttggtacttanaactntgtcnctggtaccacaaccaccccggaaaaaccgccccaaaatcagtctatttacntctctactacgtcgccggcgagtagtcttcactctctcttcncgtcactacagtcacgacaccgcctccctccacacgtctccgtcgtcggtctacgtagacgtaggacggacgacgtacttagtacttactacgcactactactactactacaacaccaccacctacctaacgtacgtacgtacgtacggacggacggacgtacg

SEQ ID NO: 318877 - DNA, 635 bp, Homo sapiens
  misc_feature: GZ8MTXP02HV3AO.52.75.G09.1.454.CMB.2.raw
  modified_base (206)..(206): a, c, t, g, unknown or other
  misc_feature (206)..(206): n is a, c, g, or t
  modified_base (219)..(219): a, c, t, g, unknown or other
  misc_feature (219)..(219): n is a, c, g, or t
  modified_base (236)..(236): a, c, t, g, unknown or other
  misc_feature (236)..(236): n is a, c, g, or t
  modified_base (332)..(332): a, c, t, g, unknown or other
  misc_feature (332)..(332): n is a, c, g, or t
  modified_base (345)..(345): a, c, t, g, unknown or other
  misc_feature (345)..(345): n is a, c, g, or t
  modified_base (354)..(354): a, c, t, g, unknown or other
  misc_feature (354)..(354): n is a, c, g, or t
  modified_base (397)..(397): a, c, t, g, unknown or other
  misc_feature (397)..(397): n is a, c, g, or t
  modified_base (403)..(403): a, c, t, g, unknown or other
  misc_feature (403)..(403): n is a, c, g, or t
  modified_base (456)..(456): a, c, t, g, unknown or other
  misc_feature (456)..(456): n is a, c, g, or t
tcagcgcagtacgacacgaccggtgctcgatttagtatagacatcaggggggggtctcaggaggcagcgctctcgggacgtctccaccatggcctgggctctgctattcctcaccctcctcactctgggcacaggactcccgggcccagtctgccctgactcagcctgcctcgtgtctgggtctcctggacagtcgatcaccatcnctgcatggaaccngcagtgactattgggtnttaataactatgtctctggtacaccaaacaccccggacaaaacgcccccaaactcaactgtaactttagtcgctcgtcaactttacgcggccccgngaggttactttcnctatccgtntttcctcgtgcctagtaagtcaggccaaacgccgcccttcccnaacctntccgtcgtcggtctccgtgactggaggtacgacggctaggtatttattaccgngtacacgtacttactaaacgttaaccaacgacccaaccctaccgttaccgtaccgttaagttaacgttccggtacggggtaccggggtaacggaacgtaacggtccgtaaccgtacccgtacgtaccggaaccgaccggacccggtacgtccccgtcccggtaccccgttacggtaccc

SEQ ID NO: 318878 - DNA, 589 bp, Homo sapiens
  misc_feature: GZ8MTXP02IIL8Z.52.75.G09.1.454.CMB.2.raw
  modified_base (210)..(210): a, c, t, g, unknown or other
  misc_feature (210)..(210): n is a, c, g, or t
  modified_base (223)..(223): a, c, t, g, unknown or other
  misc_feature (223)..(223): n is a, c, g, or t
  modified_base (330)..(330): a, c, t, g, unknown or other
  misc_feature (330)..(330): n is a, c, g, or t
  modified_base (430)..(430): a, c, t, g, unknown or other
  misc_feature (430)..(430): n is a, c, g, or t
  modified_base (458)..(458): a, c, t, g, unknown or other
  misc_feature (458)..(458): n is a, c, g, or t
tcagcgcagtacgacacgaccggtgctcgatttagtatagacatcagggggctggggtctcaggaggcagcgctctcgggacgtctccaccatggcctgggctctgctattcctcacccctcctcactctgggcacaggactcccgggccagtctgccctgactcagcctgcctccgtgtcgtggtctcctggacagtcgatcaccatcncctgcatggaacngcagtgactattggtacttaataactatgtctctggtaccaacaacaccccggacaaaaccgcccccaaaatccaatacgatttagatctgctatactcccggtccngaggtattccgtacatccgtcttactctgactcgaagtctggacaaacgaccgcccctcccacaccactcgtacgtcggctccgtagtacaggagaacgngtagctagtaatttaacttacgttaacnctatctaactaacgttaacaacgtacccaaccacctacgttactaacgttacgttacggtacggacggaaccggaactaaacgtcgtaaccgtaaccgtacgtacgtaccaaccgaccgacgtccctcccg

SEQ ID NO: 318879 - DNA, 473 bp, Homo sapiens
  misc_feature: GZ8MTXP01DIUX0.9.9.A09.1.454.CMB.2.raw
  modified_base (323)..(323): a, c, t, g, unknown or other
  misc_feature (323)..(323): n is a, c, g, or t
  modified_base (467)..(467): a, c, t, g, unknown or other
  misc_feature (467)..(467): n is a, c, g, or t
  modified_base (470)..(473): a, c, t, g, unknown or other
  misc_feature (470)..(473): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaaccctcatctatggtaatagtaatcggccctcaggggtccctgaccgattctctggctccaagtctggcacctcagcctccctggccatcactgggcttcaggctgagatgagctgattattacngccactcctatgacagcagcctgagaagtgtggtattcgggcggaggaccaagctgaccgtctaggtcagcccaaggctcgcccctcggtcactctcgttccccgccctcctcagacgtatcactgagcggcttggcaaggcgnagnnnn

SEQ ID NO: 318880 - DNA, 500 bp, Homo sapiens
  misc_feature: GZ8MTXP01B8VZS.9.9.A09.1.454.CMB.2.raw
  modified_base (205)..(205): a, c, t, g, unknown or other
  misc_feature (205)..(205): n is a, c, g, or t
  modified_base (231)..(231): a, c, t, g, unknown or other
  misc_feature (231)..(231): n is a, c, g, or t
  modified_base (310)..(310): a, c, t, g, unknown or other
  misc_feature (310)..(310): n is a, c, g, or t
  modified_base (403)..(403): a, c, t, g, unknown or other
  misc_feature (403)..(403): n is a, c, g, or t
  modified_base (490)..(500): a, c, t, g, unknown or other
  misc_feature (490)..(500): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaacccctnatctatggtaatagtaatcggccctnaggggtccctgaccgattctctggctccaagtctggcacctcagccctccctggccatcactgggcttcaggctgaggntgagcttatattactgccactccccatgacagcaagcctgataagtgtgtattcgggcggaggaccaagctgaccgtcaggtcagccaaggcncgcccctggtccacgtccttcgttccccgccctcctccgacgacgtactccacgtgacggcgggaactcggcaacggcgacattagnnnnnnnnnnn

SEQ ID NO: 318881 - DNA, 512 bp, Homo sapiens
  misc_feature: GZ8MTXP01AYV9Y.9.9.A09.1.454.CMB.2.raw
  modified_base (316)..(316): a, c, t, g, unknown or other
  misc_feature (316)..(316): n is a, c, g, or t
  modified_base (348)..(348): a, c, t, g, unknown or other
  misc_feature (348)..(348): n is a, c, g, or t
  modified_base (373)..(373): a, c, t, g, unknown or other
  misc_feature (373)..(373): n is a, c, g, or t
  modified_base (503)..(512): a, c, t, g, unknown or other
  misc_feature (503)..(512): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacacgtcccccaaacccctcatctatggtaatagtaatcggccctcgaggggtccctgaccgattctctggctccaagtctggccacctcacgccctccctggccatcacgtgggcttcaggctgaggntgaggctgatttatactgccacctctatgacngcagctgagagtgtggtagtcgggnggaggacaagctgccgtcgtaggcacgcccaaggcctcgcccctcggcactcgttccgtccccaccctccctcagtaccgtactccaacgtcggaggccgggcgttcgggaccaaacgggcacgagttgnnnnnnnnnn

SEQ ID NO: 318882 - DNA, 495 bp, Homo sapiens
  misc_feature: GZ8MTXP01BZSS9.9.9.A09.1.454.CMB.2.raw
  modified_base (422)..(422): a, c, t, g, unknown or other
  misc_feature (422)..(422): n is a, c, g, or t
  modified_base (486)..(495): a, c, t, g, unknown or other
  misc_feature (486)..(495): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaacccctcatctatggtaatagtaatcggccctcaggggtccctgaccgattctctggctccaagtctggcacctcagccctccctggccatcactgggcttcaggctgaggatgaggctgattattactgcctacctcctatgacagcagcctgagagtgtggtatcgggcgagggacaagctgaccgtcgtaggtcacgcccgaaggcctcgcccctcggtcnctctccgttccccgccctcctcacgacgtctcacgtgcgcggggcttggcgaaggcgcagttgnnnnnnnnnn

SEQ ID NO: 318883 - DNA, 548 bp, Homo sapiens
  misc_feature: GZ8MTXP01CQIF3.9.9.A09.1.454.CMB.2.raw
  modified_base (540)..(548): a, c, t, g, unknown or other
  misc_feature (540)..(548): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaaccagtcccccaaacccctcatctatggtaatagtaatcggccctcgaggggtccctgaccgattctctggctccaagtctggcacctcacgccctccctggcccatcacgtgggccttcgaggctggaggatggaggctgtattattactgccacctcctatgacagcagcctagagagtgtaggtatcgggcgggagggacaaggcgtagaccgtcgaggtcacgcccgaacggcctccgcccccgtcggtcctaccgttccgttccgttccccgccccgtccctccgacgaccgtactccgacgtcggcggccggggcgttcgggaccgaacgggccgcgaacgttgcgnnnnnnnnn

SEQ ID NO: 318884 - DNA, 496 bp, Homo sapiens
  misc_feature: GZ8MTXP01BIO1C.9.9.A09.1.454.CMB.2.raw
  modified_base (444)..(444): a, c, t, g, unknown or other
  misc_feature (444)..(444): n is a, c, g, or t
  modified_base (487)..(496): a, c, t, g, unknown or other
  misc_feature (487)..(496): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaaccctcatctatggtaatagtaatcggccctcgaggggtccctgaccgattctctggctccaagtctggcacctcagcctccctggccatcactgggcttcaggctgagatgaggctgattatactgccactcctatgacagcagcctgagaagtgtggtatcgggcggagggacaagctgaccgtctaggtcacgcccgaaggcctcgcccccgtcggtccacttccgtcgttccccacctcccncacgactatcactgaggcgggcttgggccagggccgcagttgnnnnnnnnnn

SEQ ID NO: 318885 - DNA, 541 bp, Homo sapiens
  misc_feature: GZ8MTXP01D8DO0.9.9.A09.1.454.CMB.2.raw
  modified_base (204)..(204): a, c, t, g, unknown or other
  misc_feature (204)..(204): n is a, c, g, or t
  modified_base (230)..(230): a, c, t, g, unknown or other
  misc_feature (230)..(230): n is a, c, g, or t
  modified_base (314)..(314): a, c, t, g, unknown or other
  misc_feature (314)..(314): n is a, c, g, or t
  modified_base (324)..(324): a, c, t, g, unknown or other
  misc_feature (324)..(324): n is a, c, g, or t
  modified_base (339)..(339): a, c, t, g, unknown or other
  misc_feature (339)..(339): n is a, c, g, or t
  modified_base (531)..(531): a, c, t, g, unknown or other
  misc_feature (531)..(531): n is a, c, g, or t
  modified_base (533)..(541): a, c, t, g, unknown or other
  misc_feature (533)..(541): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaaccctnatctatggtaatagtaatcggccctnaggggtccctgaccgattctctggctccaagtctggcacctcagccctccctggccatcactgggcttcaggctgaggatgagntgattatacngccactcctatgacngacagtcctgaagtagtgtagggtacgttcggggacggtaggggaccaaggctggacccgtccgtaggtcacgacccgaaggcccgtcgcccccgttcgggtcctacttccgttccgttccccgcccttcctacgacgtacgtctccgacgtggaacggcgggtcttgggaccgaaggccggacaagttggngnnnnnnnnn

SEQ ID NO: 318886 - DNA, 816 bp, Homo sapiens
  misc_feature: GZ8MTXP01BOV08.9.9.A09.1.454.CMB.2.raw
  modified_base (807)..(816): a, c, t, g, unknown or other
  misc_feature (807)..(816): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacacgtaccccaaaccctcatctatggtaatagtaatcggccctgaggggtccctgaccgattctctggctccaagtctggcacctcacgtccctccctggcccatccacgtcgggtccttcgagggtcctaggaagggtacgttggaacggggtcttaggtaactttttaacgtttaaccgtcggtaccccctaaccccctttaccccgttaaagtacgggtaaacccaacgggtaacccgtaaccgggtcccgttaagggtaaaacggggttaaaaggggtttcggggtttaagggggtttaaccggtttacccggggggggaacccggggggtaaacgggggtaaaccccgaaaacgggtcccggttaccgggtaacccccggtttacccggtttaaacgggggttaccccgaaacccgggtaccccccggtaaaacggggtccccgttaccccgggtaccccccccggttcccggggttacccctaaccccgtttccccgtttaccccgtttacccccctaaccccgttcccctaccgtaacgtaacccgttactacccgtaacgttcgggacgggccgggtcgttcggggaccgaacgggccgtacgaagttcgnnnnnnnnnn

SEQ ID NO: 318887 - DNA, 490 bp, Homo sapiens
  misc_feature: GZ8MTXP01CBHCV.9.9.A09.1.454.CMB.2.raw
  modified_base (230)..(230): a, c, t, g, unknown or other
  misc_feature (230)..(230): n is a, c, g, or t
  modified_base (246)..(246): a, c, t, g, unknown or other
  misc_feature (246)..(246): n is a, c, g, or t
  modified_base (324)..(324): a, c, t, g, unknown or other
  misc_feature (324)..(324): n is a, c, g, or t
  modified_base (339)..(339): a, c, t, g, unknown or other
  misc_feature (339)..(339): n is a, c, g, or t
  modified_base (480)..(490): a, c, t, g, unknown or other
  misc_feature (480)..(490): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaaccctcatctatggtaatagtaatcggccctnaggggtccctgaccgnttctctggctccaagtctggcacctcagccctccctggcccatcatgggcttcaggctgagatgagtcttatattacngccactcccatgacngcaagcctgagaagtgtggtattcgggcggagggaccaagctgaccgtcaggtcagccagctcgcccctgtccacgtcttcgtccccgccctcctcacgacgtatcctactgacggcgggctggcaacggcgacattacgnnnnnnnnnnn

SEQ ID NO: 318888 - DNA, 537 bp, Homo sapiens
  misc_feature: GZ8MTXP01CR8KZ.9.9.A09.1.454.CMB.2.raw
  modified_base (528)..(537): a, c, t, g, unknown or other
  misc_feature (528)..(537): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacacgtcccccaaacccctcatctatggtaaatagtaatccggccctgacggggtccctgaccgattctctggctccaagtctggcacctcacgccctcctggccatccacgtgggcttcgaggctggaggatggaggctagtatttattactgccaccttctatgacagcagcctagagtagtgtggtatcggggaggaggacagcgtcgaccgtcgtacggtcacgacccgaaggcctccgcccccgtcggtcctaccgttcctcccgttccccaccccttcctccgtacgtaccgtactcacgtggcggcgggtcgcggaccgacggcgcaacgttgnnnnnnnnnn

SEQ ID NO: 318889 - DNA, 559 bp, Homo sapiens
  misc_feature: GZ8MTXP01CARWO.9.9.A09.1.454.CMB.2.raw
  modified_base (206)..(206): a, c, t, g, unknown or other
  misc_feature (206)..(206): n is a, c, g, or t
  modified_base (495)..(495): a, c, t, g, unknown or other
  misc_feature (495)..(495): n is a, c, g, or t
  modified_base (527)..(527): a, c, t, g, unknown or other
  misc_feature (527)..(527): n is a, c, g, or t
  modified_base (543)..(543): a, c, t, g, unknown or other
  misc_feature (543)..(543): n is a, c, g, or t
  modified_base (549)..(559): a, c, t, g, unknown or other
  misc_feature (549)..(559): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacacgtcccccaaaccctnatctatggtaatagtaatccggccctgaggggtccctgaccgtattctctggctccaagtctggcacctcacgtccctcccgtggcccatccacgtcgggcttcgaggctggaggatggagtctagtatttactactgaccctacgttcctatcgaacagcaacgcctaggaagtaaggtgtaggtacgtcggggacggacgggacaaggctcgtaccgtcgtagggtccagtcccgaaggcctaccgcccccgtggtccacttccgtcccgttcccccgccttcccgnaacgtaccgtatccgacgtcggacggccgggnttcgggacgacggccnttaagnnnnnnnnnnn

SEQ ID NO: 318890 - DNA, 487 bp, Homo sapiens
  misc_feature: GZ8MTXP02JJHXU.9.9.A09.1.454.CMB.2.raw
  modified_base (478)..(487): a, c, t, g, unknown or other
  misc_feature (478)..(487): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaacccctcatctatggtaatagtaatcggccctcaggggtccctgaccgattctctggctccaagtctggcacctcagcctccctggccatcactgggcttcaggctgaggatgaggctgattatactgccactcctatgacagcagcctgagaagtgtggtattcgggcggagggaccaaccgtgaccgtctaggtcacgccaaggctcgcccctggcactctcgtccccacctcctcagacgtactcactgagcgggctggcaaggccgacacgtacgnnnnnnnnnn

SEQ ID NO: 318891 - DNA, 480 bp, Homo sapiens
  misc_feature: GZ8MTXP02JUP8Y.9.9.A09.1.454.CMB.2.raw
  modified_base (324)..(324): a, c, t, g, unknown or other
  misc_feature (324)..(324): n is a, c, g, or t
  modified_base (339)..(339): a, c, t, g, unknown or other
  misc_feature (339)..(339): n is a, c, g, or t
  modified_base (471)..(480): a, c, t, g, unknown or other
  misc_feature (471)..(480): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaacccctcatctatggtaatagtaatcggccctcaggggtccctgaccgattctctggctccaagtctggcacctcagcctccctggccatcactggcttcaggctgaggatgaggctgattatacngccactcctatgacngcagcctgagagtgtggtattcgggcggagggaccaagctgaccgtctaggtcagcccaaggctgccccctggtcacgtctcgttccccacctcctcagacgtatcactgacgcggctggcaaggcgcatgnnnnnnnnnn

SEQ ID NO: 318892 - DNA, 478 bp, Homo sapiens
  misc_feature: GZ8MTXP02GZF8M.9.9.A09.1.454.CMB.2.raw
  modified_base (417)..(417): a, c, t, g, unknown or other
  misc_feature (417)..(417): n is a, c, g, or t
  modified_base (468)..(468): a, c, t, g, unknown or other
  misc_feature (468)..(468): n is a, c, g, or t
  modified_base (471)..(478): a, c, t, g, unknown or other
  misc_feature (471)..(478): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaaccctcatctatggtaatagtaatcggccctcaggggtccctgaccgattctctggctccaagtctggcacctcagccctccctggcccatcactggcttcaggctgagatgaggctgattatactgccactcctatgacagcagcctgagaagtgtgtattcggcggagggaccaagctgaccgtctaggcagcccaagctgccccctggtcacttcncgttccccgcctcctcacgacgtatcactgacgcgggctggcaaggcacanagnnnnnnnn

SEQ ID NO: 318893 - DNA, 484 bp, Homo sapiens
  misc_feature: GZ8MTXP02GUZX8.9.9.A09.1.454.CMB.2.raw
  modified_base (327)..(327): a, c, t, g, unknown or other
  misc_feature (327)..(327): n is a, c, g, or t
  modified_base (369)..(369): a, c, t, g, unknown or other
  misc_feature (369)..(369): n is a, c, g, or t
  modified_base (473)..(473): a, c, t, g, unknown or other
  misc_feature (473)..(473): n is a, c, g, or t
  modified_base (478)..(484): a, c, t, g, unknown or other
  misc_feature (478)..(484): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaacccctcatctatggtaatagtaatcggccctcgaggggtccctgaccgattctctggctccaagtctggcacctcagccctccctggccatcactgggcttcaggctgaggatgaggctgattatacngccactcctatgacagcagcctgagaagtgtggtattcgggnggagggaccaagctgaccgtctaggtcacgcccaaggctcgcccctggtcactctcgttccccaccctcctcacgacgtactcactgacgcgggctggcaggcncatgnnnnnnn

SEQ ID NO: 318894 - DNA, 522 bp, Homo sapiens
  misc_feature: GZ8MTXP02JVPNI.9.9.A09.1.454.CMB.2.raw
  modified_base (208)..(208): a, c, t, g, unknown or other
  misc_feature (208)..(208): n is a, c, g, or t
  modified_base (319)..(319): a, c, t, g, unknown or other
  misc_feature (319)..(319): n is a, c, g, or t
  modified_base (353)..(353): a, c, t, g, unknown or other
  misc_feature (353)..(353): n is a, c, g, or t
  modified_base (511)..(513): a, c, t, g, unknown or other
  misc_feature (511)..(513): n is a, c, g, or t
  modified_base (515)..(522): a, c, t, g, unknown or other
  misc_feature (515)..(522): n is a, c, g, or t
tcagtgatacgtctcacgaccggtgctcgatttagcgagacgcgcagggtcctgggcccagtctgtgctgacgcagccgccctcagtgtctggggcccccagggcagagggtcaccatctcctgcactgggagcagctccaacatcgggaatcgctatgttgtacactggtaccagcagcttccaggaacacgtcccccaaacccctnatctatggtaatagtaatcggccctcgacggggtccctgaccgattctctggctccaagtctggcacctcagccctccctggccatccacgtgggcttcgaggctggaggntggaggctgtattatactgccacctcctatgacngcagcctgagagtgtggtatcgggcggaggaccaagctcgaccgtccgtaggtcacgccccgaaggcctccgcccccgtcggtccaccgttctccgttcccccaccctcctaccacgtacgtactccacgtcgcggcggcgtggacgacggcgacagnnngnnnnnnnn

SEQ ID NO: 318895 - DNA, 486 bp, Homo sapiens
  misc_feature: GZ8MTXP02IDX95.9.9.A09.1.454.CMB.2.raw
  modified_base (326)..(326): a, c, t, g, unknown or other
  misc_feature (326)..(326): n is a, c, g, or t
  modified_base (352)..(352): a, c, t, g, unknown or other
  misc_feature (352)..(352): n is a, c, g, or t
  modified_base (393)..(393): a, c, t, g, unknown or other
  misc_feature (393)..(393): n is a, c, g, or t
  modified_base (445)..(445): a, c, t, g, unknown or other
  misc_feature (445)..(445): n is a, c, g, or t
  modified_base (478)..(479): a, c, t, g, unknown or other
  misc_feature (478)..(479): n is a, c, g, or t
  modified_base (481)..(486): a, c, t, g, unknown or other
  misc_feature (481)..(486): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaaccctcatctatggtaatagtaatcggccctcaggggtccctgaccgattctctggctccaagtctggcacctcagcctccctggccatcactgggctttcaggctgaggatgaggctgattattacngccacctcctatgacagcagcctganagtgtgtatcgggcggaggaccaagctgaccgtctaggtcngcccaaggctcgccccctcggtcactctcgttcccaccctcctcacgacgtntccactgacgtcgggctggcaaggcgacatagnngnnnnnn

SEQ ID NO: 318896 - DNA, 612 bp, Homo sapiens
  misc_feature: GZ8MTXP02G5QGF.9.9.A09.1.454.CMB.2.raw
  modified_base (202)..(202): a, c, t, g, unknown or other
  misc_feature (202)..(202): n is a, c, g, or t
  modified_base (370)..(370): a, c, t, g, unknown or other
  misc_feature (370)..(370): n is a, c, g, or t
  modified_base (488)..(488): a, c, t, g, unknown or other
  misc_feature (488)..(488): n is a, c, g, or t
  modified_base (597)..(597): a, c, t, g, unknown or other
  misc_feature (597)..(597): n is a, c, g, or t
  modified_base (599)..(599): a, c, t, g, unknown or other
  misc_feature (599)..(599): n is a, c, g, or t
  modified_base (601)..(601): a, c, t, g, unknown or other
  misc_feature (601)..(601): n is a, c, g, or t
  modified_base (604)..(604): a, c, t, g, unknown or other
  misc_feature (604)..(604): n is a, c, g, or t
  modified_base (606)..(609): a, c, t, g, unknown or other
  misc_feature (606)..(609): n is a, c, g, or t
  modified_base (611)..(612): a, c, t, g, unknown or other
  misc_feature (611)..(612): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggacagtcccaaaccctnatctatggtaatagtaatcggccctgacgggtcctgaccgtattctctggctaccaagtctggccacctcacgtcccctcccgtcggcctatccacgtgggcctttcgaggtcctggaggtatggagggtctagtatttaattacgtcgaccaccttcctatcgaacngcacgccgtagaaggtaagttgtagggttagttccggggacgggaacgggaccaaaggtcgtacggacccgtccgtaggtaccacgacccgaagggtcctccgcccccgtcggtaccncccgttccgttcccgtttcccccgccccttacccgtacgtaaccgtacgttaactccgtaacgtcggaacggtccggggcgtagggaccgaaacggggccgactaacgngngngcncnnnncnn

SEQ ID NO: 318897 - DNA, 477 bp, Homo sapiens
  misc_feature: GZ8MTXP02ILENN.9.9.A09.1.454.CMB.2.raw
  modified_base (468)..(468): a, c, t, g, unknown or other
  misc_feature (468)..(468): n is a, c, g, or t
  modified_base (470)..(477): a, c, t, g, unknown or other
  misc_feature (470)..(477): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaaccctcatctatggtaatagtaatcggcctcaggggtccctgaccgattctctggctccaagtctggcacctcagccctccctggccatcactgggcttcaggctgaggatgaggctgattatactgccactcctatgacagcagcctgagaagtgtgtatcgggcggaggacaagctgaccgtctaggtcagcccaagctcgcccctggtcactctcgttcccaccctcctccacgacgtactcactgacgcggctggacaaggcgcanannnnnnnn

SEQ ID NO: 318898 - DNA, 512 bp, Homo sapiens
  misc_feature: GZ8MTXP02GQPSO.9.9.A09.1.454.CMB.2.raw
  modified_base (332)..(332): a, c, t, g, unknown or other
  misc_feature (332)..(332): n is a, c, g, or t
  modified_base (351)..(351): a, c, t, g, unknown or other
  misc_feature (351)..(351): n is a, c, g, or t
  modified_base (503)..(512): a, c, t, g, unknown or other
  misc_feature (503)..(512): n is a, c, g, or t
tcagtgatacgtctcacgaccggtgctcgatttagcgagacgcgcagggtcctgggcccagtctgtgctgacgcagccgccctcagtgtctggggcccccagggcagagggtcaccatctcctgcactgggagcagctccaacatcgggaatcgctatgttgtacactggtaccagcagcttccaggaacacgtccccaaacccctcatctatggtaatagtaatcggccctgaggggtccctgaccgattctctggctccagtctggcacctcacgccctccctggccatccactgggcttcgaggctgaggatggaggctgattattacncgcctacctcctatcgacngcagcctgagtagtgtggtatcgggcgagggacaagctgaccgtctaggtcagacccgaggcctcgacccccgtcggtcctaccgttctccggttccccgcccctccgtcacgtacgtactcacgtgacggcggcgtggacaggccacatgnnnnnnnnnn

SEQ ID NO: 318899 - DNA, 502 bp, Homo sapiens
  misc_feature: GZ8MTXP02IAZ1C.9.9.A09.1.454.CMB.2.raw
  modified_base (206)..(206): a, c, t, g, unknown or other
  misc_feature (206)..(206): n is a, c, g, or t
  modified_base (494)..(502): a, c, t, g, unknown or other
  misc_feature (494)..(502): n is a, c, g, or t
tcagtgatacgtctcacgaccggtgctcgatttagcgagacgcgcagggtcctgggcccagtctgtgctgacgcagccgccctcagtgtctggggcccccagggcagagggtcaccatctcctgcactgggagcagctccaacatcgggaatcgctatgttgtacactggtaccagcagcttccaggaacagtccccaaacccctnatctatggtaatagtaatcggccctcgaggggtccctgaccgattctctggctccaagtctggcacctcagccctccctggccatccatgggcttcaggctgaggatgaggctgattattactgccacctcctatgacagcagcctgagaagtgtggtagttcggcggaggaccagctcgaccgtcgtagtcagcccaaggctcgcccctcggtccacttctcgttccccgcccctcctcacgtacgtactccacgtcgacggcgggtcgtcggcgaaggcgcatagnnnnnnnnn

SEQ ID NO: 318900 - DNA, 491 bp, Homo sapiens
  misc_feature: GZ8MTXP02I4H5H.9.9.A09.1.454.CMB.2.raw
  modified_base (204)..(204): a, c, t, g, unknown or other
  misc_feature (204)..(204): n is a, c, g, or t
  modified_base (322)..(322): a, c, t, g, unknown or other
  misc_feature (322)..(322): n is a, c, g, or t
  modified_base (441)..(441): a, c, t, g, unknown or other
  misc_feature (441)..(441): n is a, c, g, or t
  modified_base (483)..(491): a, c, t, g, unknown or other
  misc_feature (483)..(491): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaaccctnatctatggtaatagtaatcggccctcaggggtccctgacccgattctctggctccaagtctggcacctcagcctcctgccatcactggcttcaggctgaggatgaggctgattatacngccactcctatgacagcagcctgagagtgtgtattcgggaggaggaccaagctagacccgtcgtaggtcacgcccgaaggctcgccccctcggtcacttcctcgttccccgcccctccncacgacgtactccactgacgcgggctggcgaaggcgacatgnnnnnnnnn

SEQ ID NO: 318901 - DNA, 608 bp, Homo sapiens
  misc_feature: GZ8MTXP02HTXTY.9.9.A09.1.454.CMB.2.raw
  modified_base (593)..(593): a, c, t, g, unknown or other
  misc_feature (593)..(593): n is a, c, g, or t
  modified_base (595)..(595): a, c, t, g, unknown or other
  misc_feature (595)..(595): n is a, c, g, or t
  modified_base (601)..(601): a, c, t, g, unknown or other
  misc_feature (601)..(601): n is a, c, g, or t
  modified_base (603)..(604): a, c, t, g, unknown or other
  misc_feature (603)..(604): n is a, c, g, or t
  modified_base (606)..(608): a, c, t, g, unknown or other
  misc_feature (606)..(608): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacacgtaccccaaaccctcatctataggtaatagtaatccggccctcgacggggtccctgaccgtattctctcggctccaagtctggcacctcacgccctccctggccatccacgtgggctttcgaggtcgtggaggatggaggtctgtaattattacgcgacctaccctcctatgacagcagccgtagacgaagtgtggtagtcggcgggaggaccagcgtcgacccgtacgtacgtcacgccgaacggcctaccgccccgttccggtacctacccgtttcctacccggtttacccccaccccgttacctaccgtaacgggtaccgttaacctccgtaaaccgtcgggaacggggttcccgggaccggttacgggaaccgaaacgggcccggtaacgtacgtcgngngacacncnncnnn

SEQ ID NO: 318902 - DNA, 487 bp, Homo sapiens
  misc_feature: GZ8MTXP02G6ZQU.9.9.A09.1.454.CMB.2.raw
  modified_base (308)..(308): a, c, t, g, unknown or other
  misc_feature (308)..(308): n is a, c, g, or t
  modified_base (325)..(325): a, c, t, g, unknown or other
  misc_feature (325)..(325): n is a, c, g, or t
  modified_base (464)..(464): a, c, t, g, unknown or other
  misc_feature (464)..(464): n is a, c, g, or t
  modified_base (477)..(477): a, c, t, g, unknown or other
  misc_feature (477)..(477): n is a, c, g, or t
  modified_base (480)..(487): a, c, t, g, unknown or other
  misc_feature (480)..(487): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaacccctcatctatggtaatagtaatcggccctcgaggggtccctgaccgattctctggctccaagtctggcactcagcctcctggccatcactgggcttcaggctgaggntgaggctgattattacngccactcctatgacagcagcctagagagtgtggtatcgggcggaggacaagctgaccgtctaggtcacgcccaagcctcgccccctggtccactctcgttccccgccctccctcacgacgtactcactgacgcgggtcnggcaaggcgacanagnnnnnnnn

SEQ ID NO: 318903 - DNA, 488 bp, Homo sapiens
  misc_feature: GZ8MTXP02FLJH6.9.9.A09.1.454.CMB.2.raw
  modified_base (308)..(308): a, c, t, g, unknown or other
  misc_feature (308)..(308): n is a, c, g, or t
  modified_base (339)..(339): a, c, t, g, unknown or other
  misc_feature (339)..(339): n is a, c, g, or t
  modified_base (364)..(364): a, c, t, g, unknown or other
  misc_feature (364)..(364): n is a, c, g, or t
  modified_base (445)..(445): a, c, t, g, unknown or other
  misc_feature (445)..(445): n is a, c, g, or t
  modified_base (479)..(488): a, c, t, g, unknown or other
  misc_feature (479)..(488): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaaccctcatctatggtaatagtaatcggccctcaggggtccctgaccgattctctggctccaagtctggcacctcagcctccctggccatcactgggcttcaggctgaggntgaggctgattatactgccactcctatgacngcagcctgagaagtgtgtatcgggnggaggacaagctgaccgtctaggtcagcccaaggcctcgccccctcggtcactctcgttccccaccctccctcagacgtancactgacggcggcgtcggcgaacggcgcagtagnnnnnnnnnn

SEQ ID NO: 318904 - DNA, 541 bp, Homo sapiens
  misc_feature: GZ8MTXP02JWGXD.9.9.A09.1.454.CMB.2.raw
  modified_base (332)..(332): a, c, t, g, unknown or other
  misc_feature (332)..(332): n is a, c, g, or t
  modified_base (347)..(347): a, c, t, g, unknown or other
  misc_feature (347)..(347): n is a, c, g, or t
  modified_base (530)..(532): a, c, t, g, unknown or other
  misc_feature (530)..(532): n is a, c, g, or t
  modified_base (534)..(541): a, c, t, g, unknown or other
  misc_feature (534)..(541): n is a, c, g, or t
tcagtgatacgtctcacgaccggtgctcgatttagcgagacgcgcagggtcctgggcccagtctgtgctgacgcagccgccctcagtgtctggggcccccagggcagagggtcaccatctcctgcactgggagcagctccaacatcgggaatcgctatgttgtacactggtaccagcagcttccaggaacacgtccccaaacccctcatctatggtaatagtaatcggccctcgaggggtccctgaccgattctctggctccaagtctggcacctcacgccctccctggccatcacgtggcttcgaggctggaggatggagctgattatacngccactcctatgacngcagcctgagagtgtggtagtcgggacggaggacaagcgtagaccgtccgtagtcacgcccaaggccgtaccgcccccgtcggtacctaccttccgtccgttcccccgtaccccttcccgttacgtaccgttacgtcctacgtcgacggtcgggcgtacgggaccgaaggccgacacgtacgnnngnnnnnnnn

SEQ ID NO: 318905 - DNA, 518 bp, Homo sapiens
  misc_feature: GZ8MTXP02H0HKE.9.9.A09.1.454.CMB.2.raw
  modified_base (349)..(349): a, c, t, g, unknown or other
  misc_feature (349)..(349): n is a, c, g, or t
  modified_base (453)..(453): a, c, t, g, unknown or other
  misc_feature (453)..(453): n is a, c, g, or t
  modified_base (508)..(509): a, c, t, g, unknown or other
  misc_feature (508)..(509): n is a, c, g, or t
  modified_base (511)..(518): a, c, t, g, unknown or other
  misc_feature (511)..(518): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacacgtccccaaaccctcatctatggtaatagtaatccggccctcgaggggtccctgaccgtattctctggctccaagtctggcacctcagccctccctggccatcactcgggctttcaggctggaggatgaggctgattattactgcctactcctatgacngcagcctagaagtagtgtagtagttcgggcggacgggacaagctaggacccgtcgtagtcacgcccgaacggctcgcccccgtggtccacttcctcgttccccnccctcctcacgtacgtactcgacgtgacggcggcgtggacgaacggcgacgatgnngnnnnnnnn

SEQ ID NO: 318906 - DNA, 513 bp, Homo sapiens
  misc_feature: GZ8MTXP02HOGRA.9.9.A09.1.454.CMB.2.raw
  modified_base (206)..(206): a, c, t, g, unknown or other
  misc_feature (206)..(206): n is a, c, g, or t
  modified_base (232)..(232): a, c, t, g, unknown or other
  misc_feature (232)..(232): n is a, c, g, or t
  modified_base (450)..(450): a, c, t, g, unknown or other
  misc_feature (450)..(450): n is a, c, g, or t
  modified_base (461)..(461): a, c, t, g, unknown or other
  misc_feature (461)..(461): n is a, c, g, or t
  modified_base (504)..(513): a, c, t, g, unknown or other
  misc_feature (504)..(513): n is a, c, g, or t
tcagtgatacgtctcacgaccggtgctcgatttagcgagacgcgcagggtcctgggcccagtctgtgctgacgcagccgccctcagtgtctggggcccccagggcagagggtcaccatctcctgcactgggagcagctccaacatcgggaatcgctatgttgtacactggtaccagcagcttccaggaacagtccccaaacccctnatctatggtaatagtaatcggccctnaggggtccctgaccgattctcgtggctcccaagtctggcacctcacgccctcctggcccatccactgggcttcgaggctgaggatgaggtctgattatactgccacctcctatgacaggcagcctgagaagtgtgtattcgggcggaggaccaagctagccgtctaggtcacgcccaaggctcgccccctcggtctactcctcgttccccaccctccncacgaccgtanccacgtagcggtcgggcgtaggaccgaaggccgacgagtacgnnnnnnnnnn

SEQ ID NO: 318907 - DNA, 483 bp, Homo sapiens
  misc_feature: GZ8MTXP02GMWS5.9.9.A09.1.454.CMB.2.raw
  modified_base (204)..(204): a, c, t, g, unknown or other
  misc_feature (204)..(204): n is a, c, g, or t
  modified_base (323)..(323): a, c, t, g, unknown or other
  misc_feature (323)..(323): n is a, c, g, or t
  modified_base (338)..(338): a, c, t, g, unknown or other
  misc_feature (338)..(338): n is a, c, g, or t
  modified_base (365)..(365): a, c, t, g, unknown or other
  misc_feature (365)..(365): n is a, c, g, or t
  modified_base (436)..(436): a, c, t, g, unknown or other
  misc_feature (436)..(436): n is a, c, g, or t
  modified_base (445)..(445): a, c, t, g, unknown or other
  misc_feature (445)..(445): n is a, c, g, or t
  modified_base (471)..(471): a, c, t, g, unknown or other
  misc_feature (471)..(471): n is a, c, g, or t
  modified_base (474)..(483): a, c, t, g, unknown or other
  misc_feature (474)..(483): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaaccctnatctatggtaatagtaatcggcctcaggggtccctgaccgattctctggctccaagtctggcacctcagccctccctggccatcactgggcttcaggctgagatgaggctgattatacngccactcctatgacngcagcctgaagaagtgtggtatcgggnggaggaccaactgaccgtctaggtcacgacccgaagcctcgccccctggtccactctcgtcccacccttcncacgactcncactgacgcggctggcacggcgacanagnnnnnnnnnn

SEQ ID NO: 318908 - DNA, 726 bp, Homo sapiens
  misc_feature: GZ8MTXP02GAIXF.9.9.A09.1.454.CMB.2.raw
  modified_base (204)..(204): a, c, t, g, unknown or other
  misc_feature (204)..(204): n is a, c, g, or t
  modified_base (724)..(724): a, c, t, g, unknown or other
  misc_feature (724)..(724): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaaccctnatctatggtaatagtaatccggccctgacggggtccctgaccgtattctctggctccaagtctggcacctcacgccctcccgtggccatcgacgtgggcttcgaggctggaggactggacggtctagtatttacgtactacgcccaccttcctagttacgaaccaggccaggtccctaggaacgtaaagggttggttacgggttaagtttccggggacggggaacggggacctaaacggtccgtacggtacccggtacccgttaacgggtaccgaaccggtaccccgaaacgggtcccttacccggtcccccccggttaaccgggttaccctaacccctttcccgttacccggtttaccccccgaacccctttaccccgacccgtaacggttaacccggtttaaaacctcccgtaaccgggtacggtaaccgggggtaccggggtaccggtacggggtaaccggtaaacggggtacccgtaacgtaacggtacggacgtcgtacgactcgacgacgcgcncg

SEQ ID NO: 318909 - DNA, 533 bp, Homo sapiens
  misc_feature: GZ8MTXP02F6BK1.9.9.A09.1.454.CMB.2.raw
  modified_base (332)..(332): a, c, t, g, unknown or other
  misc_feature (332)..(332): n is a, c, g, or t
  modified_base (422)..(422): a, c, t, g, unknown or other
  misc_feature (422)..(422): n is a, c, g, or t
  modified_base (524)..(533): a, c, t, g, unknown or other
  misc_feature (524)..(533): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaacccctcatctatggtaatagtaatcggccctcgaggggtccctgaccgattctctggctccaagtctggcacctcacgccctccctggcccatccacgtggcttcgaggctgaggatgaggctgtattatacncgccacctcctatgacagcagcctagagtaagtgtaggtacgtcgggacgggaggacaagcgtacgaccgtcgtagtcacgcccgaagcnccgccccctcggtccaccttcctccgttcccctacccctccctacgacgtaccgtactccgtacgtcgacggcgggtcgtggaccgaacggcgacgagacgnnnnnnnnnn

SEQ ID NO: 318910 - DNA, 403 bp, Homo sapiens
  misc_feature: GZ8MTXP01EBGTU.3.67.G01.1.454.CMB.2.raw
  modified_base (391)..(391): a, c, t, g, unknown or other
  misc_feature (391)..(391): n is a, c, g, or t
  modified_base (397)..(403): a, c, t, g, unknown or other
  misc_feature (397)..(403): n is a, c, g, or t
tcagagacgcactccacgaccggtgctcgatttagagtatacatattgggttggccatataaaaagtaagactgctggtgagacaacagactacgctgctgccttcagaggcagattcaccatcttcagagatgaatcacagagcactctgtttctgcaaatgaacagcctggaagacgcggacacagccatgtattattgtacattaggacactatagtccctggggccagggaaccctcgtcaccgtctcctcagcctccaccaagggcccatccggtccttccccctggccgcccctgctccaggagccacctccgagagcacagcggccctgggctgccctggtcaaaggctcttccgagtgcgtctctgagcgggctggcaaggcncatagnnnnnnn

SEQ ID NO: 318911 - DNA, 515 bp, Homo sapiens
  misc_feature: GZ8MTXP01CDOY6.3.67.G01.1.454.CMB.2.raw
  modified_base (267)..(267): a, c, t, g, unknown or other
  misc_feature (267)..(267): n is a, c, g, or t
  modified_base (303)..(303): a, c, t, g, unknown or other
  misc_feature (303)..(303): n is a, c, g, or t
  modified_base (385)..(385): a, c, t, g, unknown or other
  misc_feature (385)..(385): n is a, c, g, or t
  modified_base (432)..(432): a, c, t, g, unknown or other
  misc_feature (432)..(432): n is a, c, g, or t
  modified_base (444)..(444): a, c, t, g, unknown or other
  misc_feature (444)..(444): n is a, c, g, or t
  modified_base (465)..(465): a, c, t, g, unknown or other
  misc_feature (465)..(465): n is a, c, g, or t
tcagagacgcactccacgaccggtgctcgatttagagtatacatattgggtttggggagctctgggagaggagccccagccttgggattcccaagtgttttcattcagtgatcaggactgaacacagacgactcaccatggactttgggctgaggtggattttccttgctgcctattttaaaaggttccactgtgagctgcgactggtggcgtcgtgggggaggcttggtgcaggccgggtggtccctgcgactctctgtgcattcngacgccccttcaatcagtgtggatgaattgggtccncaggctcgaggggagggctggagtgggttgccatataaaagtagactgctggtgagacaaacagaactacgctgctgccttnagagcagatcacatctcagagatgaatcacaggagcactctgtttcngacaaatgaacngcctgggaaacgcgcggaacncgagccagttgttattaattgtaacattaggactaacgttaagtaaccgg

SEQ ID NO: 318912 - DNA, 554 bp, Homo sapiens
  misc_feature: GZ8MTXP01EO8W5.3.67.G01.1.454.CMB.2.raw
  modified_base (271)..(271): a, c, t, g, unknown or other
  misc_feature (271)..(271): n is a, c, g, or t
  modified_base (293)..(293): a, c, t, g, unknown or other
  misc_feature (293)..(293): n is a, c, g, or t
  modified_base (308)..(308): a, c, t, g, unknown or other
  misc_feature (308)..(308): n is a, c, g, or t
  modified_base (340)..(340): a, c, t, g, unknown or other
  misc_feature (340)..(340): n is a, c, g, or t
  modified_base (355)..(355): a, c, t, g, unknown or other
  misc_feature (355)..(355): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttcctgctgcctattttaaaaggttccactgtgagctgcgactggtggcgtcgtgggggagcttgggtgcaggccggggtggtcccctgcgactctcctgtgcaatttcngaacgccccttcaatacagtgnggatgaattgggccncaggctcgagggaggctggagtgggtgcatanaaaagagctgctggngagacaaacagaactacgctgcctggccttcgagaggcagtacttcaccattcttacagagatagaatacacagggaacgctaacgttcttgtttcacgtaacaaaatcgaaacacgtaccgtaggaaacgacgacggaaccacgaacgccaagttgttattaatagtaacaagttaggactaacgttaagtaacccgg

SEQ ID NO: 318913 - DNA, 789 bp, Homo sapiens
  misc_feature: GZ8MTXP01EE655.3.67.G01.1.454.CMB.2.raw
tcagagacgcactccacgaccggtgctcgatttagagtatacatattgggtttggggagctctgggagaggagccccagccttgggattcccaagtgttttcattcagtgatcaggactgaacagagagaactcaccatggagtttgggctgagctggctttttcttgtggctattttaaaaggtgtccagtgtgaggtgcagctggtggagtcgtgggggaggcttggtacagccgtggggggtccctgagactctcctgtgcagcctctggattcacctttagtaattatgccatgagcgtgggtcccgccaggctccggaggggaggggctgggagtggggtctcgagtctagttacgtgtagtcggtaggtaggtaaaaaccactaacttaactacgccaacgtaccgtccgggtagggaaacggggtccctactttaccaaccctacttacccgtacccgaaaggaacgtaaacctaaacttaaccccgaaaaggaaacccaaccggtccttacggggaacctaacgtttccctaaggaaaccctaaaaagttcgggaaaaccaacggttaccccgtaagggaaaccggaaccgggtaccccgggaaacgggtaacccgttaaccccgggggttaccccctttttttaaaggttaaccccgttaggggttaacccgaaacccggttaaaaaaccccgtaaagttacccctaaaaccggtttaaaccgtaaaaccgggtttaaccggggtaaaaccggtttaaccggggttttaaaacggggggg

SEQ ID NO: 318914 - DNA, 531 bp, Homo sapiens
  misc_feature: GZ8MTXP01CIG9G.3.67.G01.1.454.CMB.2.raw
  modified_base (271)..(271): a, c, t, g, unknown or other
  misc_feature (271)..(271): n is a, c, g, or t
  modified_base (307)..(307): a, c, t, g, unknown or other
  misc_feature (307)..(307): n is a, c, g, or t
  modified_base (438)..(438): a, c, t, g, unknown or other
  misc_feature (438)..(438): n is a, c, g, or t
  modified_base (451)..(451): a, c, t, g, unknown or other
  misc_feature (451)..(451): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttcctgctgcctattttaaaggttccactgtgagctgcgactggtggcgtcgtggggggagcgttgggtgcaggccgggtgggtccctgcgactctcctgtgcaatttcngaagccccttcaatacagtgtgatgaattgggtccncaggctcgagggaagggctggagtgggttgccatataaaagtagatgctggtgagacaaaacagctacgctgctgccttcagagcagattcacatcttcagagatagaatcaacaggagcactctgttccngacaaatgaaacngccgtggaaacgacggcggaaccacgtaacgccagttgttattaattagtaacattaggactaagttaacgttaaccggg

SEQ ID NO: 318915 - DNA, 550 bp, Homo sapiens
  misc_feature: GZ8MTXP01C83U5.3.67.G01.1.454.CMB.2.raw
  modified_base (393)..(393): a, c, t, g, unknown or other
  misc_feature (393)..(393): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttctgctgcctattttaaaggttccactgtgagctgcgactgggtggcgtcgtgggggaggcttgggtgcaggccggggtgggtccctgcgactctcctgtgcaatttctgaagccccttcaatacagtgtggatgaattgggtccgccaggctccgaggggaagggctggagtgggttgcataataaaagtagactgctggtgagacaaacagaactacgctgctgccttnagagcagattcacatcttcagagatagaatcacaggacgctactcttgtttctgacaaatgaaactacgccgtaggaaacgaccggcggaacacgacgcccaagttgttaatttaacttagtaactaagttacggactaacgttaagttaacccggg

SEQ ID NO: 318916 - DNA, 637 bp, Homo sapiens
  misc_feature: GZ8MTXP01EHHKC.3.67.G01.1.454.CMB.2.raw
  modified_base (271)..(271): a, c, t, g, unknown or other
  misc_feature (271)..(271): n is a, c, g, or t
  modified_base (389)..(389): a, c, t, g, unknown or other
  misc_feature (389)..(389): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttcctgctgcctattttaaaaggttccatgtgagctgcgactgggtggcgtcgtggggggagcttgggtgcaggccggggtgggtccctgcgactctctgtgcaatttcngaacgccccttacaatacagtgtgatgaattcgggtccgccaggctaccgaggggaaggggctgggagtggggttgcctaataataaaaagtagactgctaggtagagacaaaacganaacgtacgctggactcgcccttagagagcagtatcacatacttacagagatagaatacaacaaggacgactaacttccgttagtttacctaggtaacctaaaagtacgaaaccgacgaccgtaagggaaaccgaacgggacccgggaacaaaccgaacggacccttaagtttcggttaacttttaagttacggtttaaactaaggttaaacgggttaacctaaccgtttaaacgtttaaaccccgggg

SEQ ID NO: 318917 - DNA, 528 bp, Homo sapiens
  misc_feature: GZ8MTXP01BRC2M.3.67.G01.1.454.CMB.2.raw
  modified_base (270)..(270): a, c, t, g, unknown or other
  misc_feature (270)..(270): n is a, c, g, or t
  modified_base (307)..(307): a, c, t, g, unknown or other
  misc_feature (307)..(307): n is a, c, g, or t
  modified_base (359)..(359): a, c, t, g, unknown or other
  misc_feature (359)..(359): n is a, c, g, or t
  modified_base (396)..(396): a, c, t, g, unknown or other
  misc_feature (396)..(396): n is a, c, g, or t
  modified_base (435)..(435): a, c, t, g, unknown or other
  misc_feature (435)..(435): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttcctgctgccattttaaaaggttccactgtgagctgcgactggtggcgtcgtgggggaggcttgggtgcaggccgggtgggtccctgcgactctcctgtgcaatttcngaacgccccttcaatacagtgtggatgaattgggccnccaggctccgagggagggctggagtgggtgcataataaaagagactgctggngagacaaacagaactacgctgctgccttcagagcagntcacatctcagagatgaatcacaggagcactcttgttcngacaaatcgaacagccctagggaaacgacgcggaacacgagccagttgttattaagttgtaactaagttacggactaacgttaagtaaccggg

SEQ ID NO: 318918 - DNA, 541 bp, Homo sapiens
  misc_feature: GZ8MTXP01B511M.3.67.G01.1.454.CMB.2.raw
  modified_base (263)..(263): a, c, t, g, unknown or other
  misc_feature (263)..(263): n is a, c, g, or t
  modified_base (299)..(299): a, c, t, g, unknown or other
  misc_feature (299)..(299): n is a, c, g, or t
  modified_base (420)..(420): a, c, t, g, unknown or other
  misc_feature (420)..(420): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttcctgctgccattttaaaaggttccactgtgagctgcgactggtggcgtctgggggagcttggtgcaggccgggtggtccctgcgactctctgtgcattcngacgccccttcaatcagtgtggatgaattgggtccnccaggctccgaggggaagggctgggagtgggttgccataataaaagtagactgctggtgagacaaacagaactacgctgctgccttcagaggcagattcaccatcttcagagatgaatcanagggacgcactcttgttcctgacaaatcgaaacagcccgtgggaaacacggcggaacacgacgcccagttcgttaatttaattgtaacctaagttaggacttaacgttaagttaacccggg

SEQ ID NO: 318919 - DNA, 548 bp, Homo sapiens
  misc_feature: GZ8MTXP01ACL1E.3.67.G01.1.454.CMB.2.raw
  modified_base (224)..(224): a, c, t, g, unknown or other
  misc_feature (224)..(224): n is a, c, g, or t
  modified_base (264)..(264): a, c, t, g, unknown or other
  misc_feature (264)..(264): n is a, c, g, or t
  modified_base (303)..(303): a, c, t, g, unknown or other
  misc_feature (303)..(303): n is a, c, g, or t
  modified_base (434)..(434): a, c, t, g, unknown or other
  misc_feature (434)..(434): n is a, c, g, or t
  modified_base (451)..(451): a, c, t, g, unknown or other
  misc_feature (451)..(451): n is a, c, g, or t
tcagagacgcactccacgaccggtgctcgatttagagtatacatattgggtttggggagctctgggagaggagccccagccttgggattcccaagtgttttcattcagtgatcaggactgaacacagacgactcaccatggactttgggctgaggtgatttcctgctgcctattttaaaggttccatgtgagctgcgactggtggcgtcgtgggggagcttggngcaggccgggtgggtccctgcgactctctgtgcaatttcngaacgccccttacaatacagtgtggatgaattgggtccnccaggctcgaggggagggctgggagtgggtggcataataaaaagtagactgctggtagagacaaacagaactacgctgctgccttgagaggcagattcacatcttcagagatagaaatcgaacaggggacnctacttcgttgtttccngaacctaaagtcgaaacacgtcccgagggaacgacggcggaacacgacgccagttgttattaagtgtaactataggactaacgttaagtaacccggg

SEQ ID NO: 318920 - DNA, 580 bp, Homo sapiens
  misc_feature: GZ8MTXP01ALD4T.3.67.G01.1.454.CMB.2.raw
  modified_base (279)..(279): a, c, t, g, unknown or other
  misc_feature (279)..(279): n is a, c, g, or t
  modified_base (425)..(425): a, c, t, g, unknown or other
  misc_feature (425)..(425): n is a, c, g, or t
  modified_base (457)..(457): a, c, t, g, unknown or other
  misc_feature (457)..(457): n is a, c, g, or t
  modified_base (482)..(482): a, c, t, g, unknown or other
  misc_feature (482)..(482): n is a, c, g, or t
  modified_base (545)..(545): a, c, t, g, unknown or other
  misc_feature (545)..(545): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttccttgctgcctattttaaaaggttccactgtgagctgcgactgggtggcgtcgtggggggagcttgggtgcgaggcccggggtgggtcccctgccgactctcctgtgctaatttcngaacgtccccttacaatacagtgtggatgaagttgggtcccgccaggctccggagggggaaggggctgggagtgggttggaccaagttaaataaaaaagtagactgcgtgggtagagaacaaacgagaactacgctgctgcccttnagagcaagatcacctatctacagagatagaancaacgaggacgctactcttgtttcngactaaagtcgaacagccgtaggaaacgaccgacggacacgacgacttagttgttattaagtntaacgtagttaacggactaacgttaacgtaaccgg

SEQ ID NO: 318921 - DNA, 541 bp, Homo sapiens
  misc_feature: GZ8MTXP01AW1YW.3.67.G01.1.454.CMB.2.raw
  modified_base (272)..(272): a, c, t, g, unknown or other
  misc_feature (272)..(272): n is a, c, g, or t
  modified_base (309)..(309): a, c, t, g, unknown or other
  misc_feature (309)..(309): n is a, c, g, or t
  modified_base (325)..(325): a, c, t, g, unknown or other
  misc_feature (325)..(325): n is a, c, g, or t
  modified_base (461)..(461): a, c, t, g, unknown or other
  misc_feature (461)..(461): n is a, c, g, or t
  modified_base (487)..(487): a, c, t, g, unknown or other
  misc_feature (487)..(487): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttccttgctgcctaattttaaaaggttccactgtgagctgcgactggtggcgtcgtgggggagcttggtgcaggccggggtgggtccctgcgactctcctgtgcaatttcngaacgccccttcaatacagtgtggatgaatgggtccncaggctcgaggagggntggagtgggtgcataataaaagagactgctggtgagacaaaacagaactacgctggctggccttcagagcagacttcaccatctcagtagattagaatcacaggacgctactcttgttcctgactaaatgaaaacngacccgtaggaaacgacgcgggaacncgagccgattgttattaattagtaactagttaggactaacgttcgtaacccggg

SEQ ID NO: 318922 - DNA, 535 bp, Homo sapiens
  misc_feature: GZ8MTXP01BLYDD.3.67.G01.1.454.CMB.2.raw
  modified_base (269)..(269): a, c, t, g, unknown or other
  misc_feature (269)..(269): n is a, c, g, or t
  modified_base (306)..(306): a, c, t, g, unknown or other
  misc_feature (306)..(306): n is a, c, g, or t
  modified_base (395)..(395): a, c, t, g, unknown or other
  misc_feature (395)..(395): n is a, c, g, or t
  modified_base (415)..(415): a, c, t, g, unknown or other
  misc_feature (415)..(415): n is a, c, g, or t
  modified_base (417)..(417): a, c, t, g, unknown or other
  misc_feature (417)..(417): n is a, c, g, or t
  modified_base (419)..(419): a, c, t, g, unknown or other
  misc_feature (419)..(419): n is a, c, g, or t
  modified_base (421)..(421): a, c, t, g, unknown or other
  misc_feature (421)..(421): n is a, c, g, or t
  modified_base (425)..(425): a, c, t, g, unknown or other
  misc_feature (425)..(425): n is a, c, g, or t
  modified_base (430)..(430): a, c, t, g, unknown or other
  misc_feature (430)..(430): n is a, c, g, or t
tcagagacgcactccacgaccggtgctcgatttagagtatacatattgggtttggggagctctgggagaggagccccagccttgggattcccaagtgttttcattcagtgatcaggactgaacacagacgactcaccatggactttgggctgaggtggattttcctgctgcctattttaaaaggttccactgtgagctgcgactggtggcgtcgtgggggagcttggtgcaggccgggtggtccctgcgactctcctgtgctaatttcngaacgtccccttacaatacagtgtgatgagttggccncgaggctcgaggggaggctgggagtgggtgcaataactaaaaagtagactgcgtggtgaacgacaaacaggctacgctgctgcctgagngcagatcactatcgtcagananananacanagacnctctcttcgttcgtagacaacacgtacgacgacgaggaacggacgacgacacgacgacagttgttattaatagtaactagtacgttacgtaacgttaacgtaacg

SEQ ID NO: 318923 - DNA, 584 bp, Homo sapiens
  misc_feature: GZ8MTXP01EUFX0.3.67.G01.1.454.CMB.2.raw
  modified_base (261)..(261): a, c, t, g, unknown or other
  misc_feature (261)..(261): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctgaggtgatttctgctgccatttaaagttccactgtgagctgcgactggtggcgtcgtgggggagcttgggtgcaggccgggtggtccctgcgactctcctgtgcaattcngaacgccccttcaatacagtgtaggatgaattgggtcccgccgaggctccgaggggaaggggctgggagtgggttggccagtaataaaaggtagactgctggtagagacaaaacagaactacgctgctgccttgagagcagattcacattctcagagatacgaatacaacaggacgtactactttcttttactagtacaaagtacgaaactagtacccgtaggaaacggaaccggacgggaaccaacgacgaccctaattagttatttagttaaggtaactaagttaagggaacttacgttaacgttaacgttaaccccgggg

SEQ ID NO: 318924 - DNA, 558 bp, Homo sapiens
  misc_feature: GZ8MTXP01B9SZV.3.67.G01.1.454.CMB.2.raw
  modified_base (273)..(273): a, c, t, g, unknown or other
  misc_feature (273)..(273): n is a, c, g, or t
  modified_base (310)..(310): a, c, t, g, unknown or other
  misc_feature (310)..(310): n is a, c, g, or t
  modified_base (388)..(388): a, c, t, g, unknown or other
  misc_feature (388)..(388): n is a, c, g, or t
  modified_base (393)..(393): a, c, t, g, unknown or other
  misc_feature (393)..(393): n is a, c, g, or t
  modified_base (396)..(396): a, c, t, g, unknown or other
  misc_feature (396)..(396): n is a, c, g, or t
  modified_base (406)..(406): a, c, t, g, unknown or other
  misc_feature (406)..(406): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttccttgctgcctaatttttaaaaggttccactgtgagctgcgactggtggcgtcgtgggggaggcttgggtgcaggccgggtggtccctgcgactctcctgtgcaatttcngaacgccccttacaatacagtgtggatgaattggccncaggctcgagggagggctggagtgggtgcataataaaagtagactgctggtgagacaaacagctacgctgctgccttnagagnagntcacatcctnagagatgaactcaacaggagcactcgtagtttcagactaaatgaaacaggaccgtagggaaacggaccggacgggaaaccacgaacggacccttagttagttatttaattggtaactaagtttacggaacctaacgttaacgttaacccggg

SEQ ID NO: 318925 - DNA, 572 bp, Homo sapiens
  misc_feature: GZ8MTXP01ECUNW.3.67.G01.1.454.CMB.2.raw
  modified_base (276)..(276): a, c, t, g, unknown or other
  misc_feature (276)..(276): n is a, c, g, or t
  modified_base (314)..(314): a, c, t, g, unknown or other
  misc_feature (314)..(314): n is a, c, g, or t
  modified_base (445)..(445): a, c, t, g, unknown or other
  misc_feature (445)..(445): n is a, c, g, or t
  modified_base (459)..(459): a, c, t, g, unknown or other
  misc_feature (459)..(459): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttcctgctgcctattttaaaggttccactgtgagctgcgactgggtggcgtcgtggggggaggcttgggtgcgaggccggggtgggtcccctgccgactctcctgtgcaatttcngaacgccccttcaatacagtgtggatgaattgggtccnccaggctccgagggagggctgggagtgggttgcataataaaaagtagctgctgggtagagaacaaaacagctacgctgctgccttcgagaggcagacttcaccattcttcagtagatgaatcaacaggganctactctgtttccngacaaatcgaaacacggtccgtaggaaacgacggacggaaacaccgaaggcccttaagttgttaatttaagttagtaacctagttacggacctaacgttaacgttaacccggg

SEQ ID NO: 318926 - DNA, 589 bp, Homo sapiens
  misc_feature: GZ8MTXP01AUMI2.3.67.G01.1.454.CMB.2.raw
  modified_base (277)..(277): a, c, t, g, unknown or other
  misc_feature (277)..(277): n is a, c, g, or t
  modified_base (282)..(282): a, c, t, g, unknown or other
  misc_feature (282)..(282): n is a, c, g, or t
  modified_base (317)..(317): a, c, t, g, unknown or other
  misc_feature (317)..(317): n is a, c, g, or t
  modified_base (421)..(421): a, c, t, g, unknown or other
  misc_feature (421)..(421): n is a, c, g, or t
  modified_base (424)..(424): a, c, t, g, unknown or other
  misc_feature (424)..(424): n is a, c, g, or t
  modified_base (426)..(426): a, c, t, g, unknown or other
  misc_feature (426)..(426): n is a, c, g, or t
  modified_base (439)..(439): a, c, t, g, unknown or other
  misc_feature (439)..(439): n is a, c, g, or t
  modified_base (443)..(443): a, c, t, g, unknown or other
  misc_feature (443)..(443): n is a, c, g, or t
  modified_base (445)..(445): a, c, t, g, unknown or other
  misc_feature (445)..(445): n is a, c, g, or t
  modified_base (454)..(454): a, c, t, g, unknown or other
  misc_feature (454)..(454): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttcctgctgcctattttaaaaggttccactgtgagctgcgactgggtggcgtcgtgggggagcgttgggtgcgaggccggggtgggtcccctgcgactctcctgtgactaatttcngaacnccccttacaatacagtgtggatgaagttcgggccnccgaggcctccgagggggaaggggctgggaggtgggttggacctaagtaaagtaaaaagtagactgctaggtagagacaaacagaactacgctagctgcccttnagngnagatcacatctanagananagaatacanaggacgctacttcttgtttcgagtaactaaatcgaaacgtacgtaccgtagggaaacgccggacggaaccacgaacgccttagttcgttattaattgtaaacgtgttaacggactaacgttaacgtaacccgggg

SEQ ID NO: 318927 - DNA, 544 bp, Homo sapiens
  misc_feature: GZ8MTXP01ADYGU.3.67.G01.1.454.CMB.2.raw
  modified_base (270)..(270): a, c, t, g, unknown or other
  misc_feature (270)..(270): n is a, c, g, or t
  modified_base (309)..(309): a, c, t, g, unknown or other
  misc_feature (309)..(309): n is a, c, g, or t
  modified_base (396)..(396): a, c, t, g, unknown or other
  misc_feature (396)..(396): n is a, c, g, or t
  modified_base (451)..(451): a, c, t, g, unknown or other
  misc_feature (451)..(451): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttcctgctgcctattttaaaaggttccactgtgagctgcgactggtggcgtcgtgggggagcttgggtgcaggccgggtgggtccctgcgactctcctgtgcaatttcngaacgcccccttcaatacagtgtggatgaattgggtccnccaggctccgaggggagggctgggagtgggttggccatataaaagtagactgctggtgagacaaacagaactacgctgctgcccttnagaggcaggtattcaccatctacagtagatgaatcacaggacgcactcttgttcngacaaatgaacagcctgggaacacggcggacacgtacgacccagttgttattaactgtaactagttacggactaacgttaacgttaacccggg

SEQ ID NO: 318928 - DNA, 638 bp, Homo sapiens
  misc_feature: GZ8MTXP01BMJIP.3.67.G01.1.454.CMB.2.raw
  modified_base (281)..(281): a, c, t, g, unknown or other
  misc_feature (281)..(281): n is a, c, g, or t
  modified_base (326)..(326): a, c, t, g, unknown or other
  misc_feature (326)..(326): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttcctgctgcctattttaaaaggttccactgtgagctgcgactggtggcgtcgtggggggagtcgttgggtgcgaggccggggttgggtcccctggccgacttctcctgtgctaatttcngaacgtcccccttacaatacgagtgtaggatgaagttcgggcccnccgaggcctccgagggggagggctgggagtgggtcgacgataaagtaaaacgaagacgtcgacgtggtagagaacaaaacgagaacgtacgcgtcgactggtaccttcgagacgggtcagtacttccacctattccgttacagaacgtattagaactacgaacgaggggaactacctaccttcgtttaggtttccagaacaaaagtacgtaacgacgacccggtaggaaaacggcgaccgggacaacaacggttccttattcgtttaagttaattacggaatacgttaggaccttaagttcgttaacccggg

SEQ ID NO: 318929 - DNA, 550 bp, Homo sapiens
  misc_feature: GZ8MTXP01AJY8R.3.67.G01.1.454.CMB.2.raw
  modified_base (272)..(272): a, c, t, g, unknown or other
  misc_feature (272)..(272): n is a, c, g, or t
  modified_base (310)..(310): a, c, t, g, unknown or other
  misc_feature (310)..(310): n is a, c, g, or t
  modified_base (419)..(419): a, c, t, g, unknown or other
  misc_feature (419)..(419): n is a, c, g, or t
  modified_base (423)..(423): a, c, t, g, unknown or other
  misc_feature (423)..(423): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttcctgctgcctattttaaaaggttccatgtgagctgcgactgggtggcgtcgtggggggagcttgggtgcaggccgggtgggtcccctgcgactctcctgtgcaatttcngaacgccccttccaatacagtgtggatgaattgggccnccaggctccgaggggagggctggagtgggttgccataataaaaagtagactgctggtgagacaaaacagaactacgctgctgcccttgagagcagattcaccatcttanaganatagaatacaacgagggacactacttcttgtttcagaactaaatacgaaacacgaccgagggaacgacggacggacacgaacgcttagttgttattaatagtaactagtagactaacgttaagtccg

SEQ ID NO: 318930 - DNA, 573 bp, Homo sapiens
  misc_feature: GZ8MTXP01BJM1T.3.67.G01.1.454.CMB.2.raw
  modified_base (276)..(276): a, c, t, g, unknown or other
  misc_feature (276)..(276): n is a, c, g, or t
  modified_base (317)..(317): a, c, t, g, unknown or other
  misc_feature (317)..(317): n is a, c, g, or t
  modified_base (407)..(407): a, c, t, g, unknown or other
  misc_feature (407)..(407): n is a, c, g, or t
  modified_base (482)..(482): a, c, t, g, unknown or other
  misc_feature (482)..(482): n is a, c, g, or t
  modified_base (495)..(495): a, c, t, g, unknown or other
  misc_feature (495)..(495): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttcctgctgcctattttaaaggttccactgtgagctgcgactgggtggcgtcggtgggggagtcttgggtgcgaggccggggtgggtccctgccgactctcctgtgctaatttcngaacgcccccttcaatacagtgtggatgaagttgggtcccnccatcgctccgagggggagggggctgggaggttgggggttgcctaaagtaaataaaaaaggtagacctggacgtggtagagaaacaacgngactacgctgctcgccttcgagagcagacttcactatcttacagagatgaaatcaagagagcacttcttgtttcngacaaatgaaacncgccgtaaggaacgccggacggacacgacgccttattgtaattagttgtaactagttaacggtaacttaacgttaacg

SEQ ID NO: 318931 - DNA, 602 bp, Homo sapiens
  misc_feature: GZ8MTXP01CMJWO.3.67.G01.1.454.CMB.2.raw
  modified_base (271)..(271): a, c, t, g, unknown or other
  misc_feature (271)..(271): n is a, c, g, or t
  modified_base (310)..(310): a, c, t, g, unknown or other
  misc_feature (310)..(310): n is a, c, g, or t
tcagagacgcactccacgaccggtgctcgatttagagtatacatattgggtttggggagctctgggtagaggagccccagccttgggattcccaagtgttttcattcagtgatcaggactgaacacagaggactcaccatggactttgggctgaggtggattttcctgctgcctattttaaaggttccatgtgagctgcgactggtggcgtcgtgggggagcttgggtgcaggtccggggtggtccctgcgactctcctgtgctaatttcngaacgccccttacaatacagtgtggatgaagttgggccncgaggctccgagggggagggctgggagtgggttcgacctaagtaaagtaaaaagtagactcgcgtaggtagaagaacaaacgagaacctacgctgctgtcctcgagtaggcagtacttcacctatcttacagatatagaatcaacgaggactcgtaacttcgttcgtttcagtacaaagtcgaaacgacggtacccgtagggaaacgcggacgggaccacgacgccttagttacgttaatttaacgttagtaacgtaacgtttaaggacctaacgttaacgttaaccccggg

SEQ ID NO: 318932 - DNA, 629 bp, Homo sapiens
  misc_feature: GZ8MTXP01DDE0H.3.67.G01.1.454.CMB.2.raw
  modified_base (390)..(390): a, c, t, g, unknown or other
  misc_feature (390)..(390): n is a, c, g, or t
  modified_base (437)..(437): a, c, t, g, unknown or other
  misc_feature (437)..(437): n is a, c, g, or t
tcagagacgcactccacgaccggtgctcgatttagagtatacatattgggtttggggagctctgggagaggagcccccagccttgggattcccaagtgttttcattcagtgatcaggactgaacacagaggactcaccatggactttggctgaggtgattttcctgctgcctattttaaaaggttccactgtgagctgcgactgggtggcgtcgtgggggagtcgttgggtgcgaggcccggggtggtccctgccgacttctcctgtcgctaatttcagaccgtccccttacaatacagtgtagatagtaagttgggccccgcgaggccgtccggaaggggaaggggctaggggaggttgggttcggacctaaagttaaagtaaaaaggngacgtgcgtggtagaagacaaacagtcctacgctgctgccttagagngacagtacttacactatcttacgagtagatagaactacacgagggactactacttcgttacgttccgagtaaccaaagttacgaaacgtacggaccgtagggaaaccacggacggaaccacgtaacgccgttaagttcgtttatttaagtagtaacctaagttacgaacgttaaccgttaacgttccccggg

SEQ ID NO: 318933 - DNA, 637 bp, Homo sapiens
  misc_feature: GZ8MTXP01BTNVT.3.67.G01.1.454.CMB.2.raw
  modified_base (285)..(285): a, c, t, g, unknown or other
  misc_feature (285)..(285): n is a, c, g, or t
  modified_base (324)..(324): a, c, t, g, unknown or other
  misc_feature (324)..(324): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttcctgctgcctaatttttaaaaggttccactgtgagctgcgactgggtggcgtcgtggggggaggtcttgggtgcgagggccggggtgggtcccctgccgtactctcctgtcgactaatttcngaacgtccccttacaatacagtgtgatgaagtcgggccncaggctcggaggggagggctgggagtgggttgacctaagtaaataaaaagtagactgcgtggtagagacaaacagaactacgctgctcgcccttagagacggcaagtacttacaacctattaccgttacaagagtaatagaactacgaacgagggacgtacctaacttcgttcggtttacctaggtaacctaaaagtacgaaacgtacggtacccggtaagggaaaccgaccggaccgggaaacacgacggaccttaagttgttaattaagttacgtaactaacgttacggactaacgttaacgtaacccggg

SEQ ID NO: 318934 - DNA, 589 bp, Homo sapiens
  misc_feature: GZ8MTXP01ATM84.3.67.G01.1.454.CMB.2.raw
  modified_base (308)..(308): a, c, t, g, unknown or other
  misc_feature (308)..(308): n is a, c, g, or t
  modified_base (353)..(353): a, c, t, g, unknown or other
  misc_feature (353)..(353): n is a, c, g, or t
  modified_base (366)..(366): a, c, t, g, unknown or other
  misc_feature (366)..(366): n is a, c, g, or t
  modified_base (480)..(480): a, c, t, g, unknown or other
  misc_feature (480)..(480): n is a, c, g, or t
  modified_base (489)..(489): a, c, t, g, unknown or other
  misc_feature (489)..(489): n is a, c, g, or t
  modified_base (513)..(513): a, c, t, g, unknown or other
  misc_feature (513)..(513): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttcctgctgcctattttaaaaggttccactgtgagctgcgactggtggcgtcgtgggggagcttgggtgcaggccgggtggtccctgcgactctcctgtgctaatttcagaacgtccccttacaatacagtgtgatgaagttggccncaggcctcggagggagggctgggagtgggtgacaataagaaaagngactgctggaganaacaaacagtaacacgctgctcgcccttagaaggacgcagtacttaccgaacctattaccttacaggaactatacgaaactacgaacgaggacgctacttcgtttacgttcganaactaaagngaaacctcggaccgtagggaaacnccggacggaaccacgacgaccgttagttgttaattaagtacgtaactggttaacgactaacgttaacgtaacccgg

SEQ ID NO: 318935 - DNA, 745 bp, Homo sapiens
  misc_feature: GZ8MTXP01A3YBV.3.67.G01.1.454.CMB.2.raw
  modified_base (285)..(285): a, c, t, g, unknown or other
  misc_feature (285)..(285): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttccttgctgcctaatttttaaaaggttccactgtgagctgcgactggtggcgtcgtggggggagcgtttgggtgcgaggccgggggtgggtcccctggccgtactctcctgtgactaatttcngaacgtcccccttacaatacgagtgtggatgaagttcgggtcccgccaggcctccggagggggaaggggctagggaggtgggttggacctaataaagtaaaaaagtagactggctgggtagaacgaacaaaacaggtaacctacgcctgctcgtcccttagaacggtacggctaagtacttaccaacctacttacccgttacgaaggtaagtaagttacgaaacttaccgaaaccgaaggggaaccgtacctaaccgtttcctttacgtttaccggtagtaaccctaaaagttacggtaaaaccgaccggttaacccggtaaggggaaaacggtaacccgggaccgggaaacccaacgtaacccgacccgttaaacgtttacggtttaaacgttttaattaaccggttaactaagggtttaaaccggaaccttaaccgttaaacggtttaacccccgggg

SEQ ID NO: 318936 - DNA, 546 bp, Homo sapiens
  misc_feature: GZ8MTXP01AUWKD.3.67.G01.1.454.CMB.2.raw
  modified_base (270)..(270): a, c, t, g, unknown or other
  misc_feature (270)..(270): n is a, c, g, or t
  modified_base (311)..(311): a, c, t, g, unknown or other
  misc_feature (311)..(311): n is a, c, g, or t
  modified_base (463)..(463): a, c, t, g, unknown or other
  misc_feature (463)..(463): n is a, c, g, or t
  modified_base (476)..(476): a, c, t, g, unknown or other
  misc_feature (476)..(476): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttcctgctgccattttaaaaggttccactgtgagctgcgactggtggcgtcgtggggggagcttggtgcaggccgggtgggtcccctgcgactctcctgtgcaatttcngaacgcccccttacaatacagtgtggatgaattgggtcccnccgaggctccgaggggagggctgggagtgggttgccataataaaagagactgcgtggtagagacaaacagctacgctgctgcctgagaggcagacttcacctatccttacgagacgatagaaactcaacgaggacgcctacgtcttgtttcngacaaatgaaacngcctggaacgcgaggacacgagccagttgttattaatgtaacagttacggactaacgttaagtaaccggg

SEQ ID NO: 318937 - DNA, 750 bp, Homo sapiens
  misc_feature: GZ8MTXP01BTMZR.3.67.G01.1.454.CMB.2.raw
tcagagacgcactccacgaccggtgctcgatttagagtatacatattgggtttggggagctctgggagaggagccccagccttgggattcccaagtgttttcattcagtgatcaggactgaacacagaggactcaccatggactttgggctggaggtggtattttcctgctgcctattttaaaaggttccactgtgagctgcgactgggtggcgtcggtgggggaggcttgggtgcgagggccggggtgggtccctgccgtactctcctgtcgactaatttcagaaaccgtccccctttaccaaattacaggttgtaggagttggaagttcggggtcccgcccgaggggccctaccgggaagggggaaacgggggtcgtgggggtacgggttcgggggtttggaaccctaaagttaaaacgttaaaaaaaggtacgaaccgttggtaccgtaggggtacgaacgtaaaccgaaaaacgaacggtaacccgtaacggtcctgggtaccttacggacccttacggaacggacgggactaagtacttacccaacctattacccgttagagtaagtaatacgaaatcgaaacgacgacgtacctacttcgttcgttacctagtaacctaaagtacgaaaccgacggtaccgtagggaaaaccggcggaaccgggaaaccacgaacggtaccttaagttgttaattaagttacgtaacgtaaggttaacgaccgtaacgttaacgtaacccgggg

SEQ ID NO: 318938 - DNA, 595 bp, Homo sapiens
  misc_feature: GZ8MTXP01DKD9D.3.67.G01.1.454.CMB.2.raw
  modified_base (284)..(284): a, c, t, g, unknown or other
  misc_feature (284)..(284): n is a, c, g, or t
  modified_base (324)..(324): a, c, t, g, unknown or other
  misc_feature (324)..(324): n is a, c, g, or t
  modified_base (450)..(450): a, c, t, g, unknown or other
  misc_feature (450)..(450): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctgaggtggatttttccttgctgcctaatttttaaaaggttccactgtgagctgcgactgggtggcgtcgtggggggaggtcttgggtgcaggcccggggtgggtcccctgccgtactctcctgtgctaatttcngaacgcccccttacaatacagtgtagatgaagttggtccncaggctcgaggggagggctggaggtgggttgccaataagtaaaaagagactgctggtagacgaacaaacagaacctacgctagctcgccttcgaagaggacagtacttacactaatcttacgaganatagaatcacgaggagctactcttagtttcagacaaacgtagaaacacgccgtagggaaacggaccgacgggaaccaacgacgaccttagttacgttatttaattacgttaactaagttaggactaacgttaacgttaacccggg

SEQ ID NO: 318939 - DNA, 675 bp, Homo sapiens
  misc_feature: GZ8MTXP01EBAZR.3.67.G01.1.454.CMB.2.raw
  modified_base (282)..(282): a, c, t, g, unknown or other
  misc_feature (282)..(282): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttccttgctgcctaatttttaaaaggtttccactgtgagctgcgactggtggcgtcgtggggggaggtcttgggtgcgaggccggggtgggtccctgcgactctcctgtgactaattttcngaacgtcccccttcaaatacagtgtaggatgaagttggcccgcgaggcctccgagggggaacggggctgggtaggtggggtttacggacctaaagttaaacgttaaaaaaggtaagacgttgcttagggtagaacgaacaaaaaccaggaacttaccggcttagccttcgtccttacgaaggtacggacgaagtacttaccaacctacttacttacgtagaagatagaactacaaccaagggacgtcctaacttaccgtttgtttaccgtacgtactaaaagttacgtaaacacggtaccgtagggaaacggaaccgaccgggaaccacgacgacccttagttacgttattaacttagtaactagttaacggactaacgttaagttaacccgg

SEQ ID NO: 318940 - DNA, 717 bp, Homo sapiens
  misc_feature: GZ8MTXP01A5LZV.3.67.G01.1.454.CMB.2.raw
  modified_base (288)..(288): a, c, t, g, unknown or other
  misc_feature (288)..(288): n is a, c, g, or t
  modified_base (302)..(302): a, c, t, g, unknown or other
  misc_feature (302)..(302): n is a, c, g, or t
  modified_base (306)..(306): a, c, t, g, unknown or other
  misc_feature (306)..(306): n is a, c, g, or t
  modified_base (321)..(321): a, c, t, g, unknown or other
  misc_feature (321)..(321): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctgaggtggtattttcctgctgcctaattttaaaaggttccatgtgagctgcgactggtggcgtcgtggggggagtcttgggtgccgaggccggggttgggtcccctggccgtactctcctgtcgctaatttcagaacnccccttacaatacngtgngatgagttcgggccncgaggctcggagggggacgggctagggaggtgggtagaccaaagttaaactaaaaaaggtagactggacgttagggtagaaacgaacaaaacaggaacttacggcttagccgtacgtcccttagaaggtaccggataacggtacttaccaacctaacttaccgttaacgaaggaacgttaaacgtacgtaaactaccgaacgaacgggtaacgttaccttaccgttacgtttacgtttacgaacgtaaactaaagtacggtaaaccgtacggtaccggtaaacgggaaaccgacccggaaccggaaaccacgtaacggtaccttaaagtttacgtttaactttaagttacgttaaacgtaaggttaaccggaccttaacgttaacccggttccggg

SEQ ID NO: 318941 - DNA, 569 bp, Homo sapiens
  misc_feature: GZ8MTXP01AKAN4.3.67.G01.1.454.CMB.2.raw
  modified_base (268)..(268): a, c, t, g, unknown or other
  misc_feature (268)..(268): n is a, c, g, or t
  modified_base (305)..(305): a, c, t, g, unknown or other
  misc_feature (305)..(305): n is a, c, g, or t
  modified_base (463)..(463): a, c, t, g, unknown or other
  misc_feature (463)..(463): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctgaggtggatttcctgctgccatttaaaggttccatgtgagctgcgactggtggcgtcgtggggggagcttgggtgcaggccggggtgggtccctgcgactctcctgtgctaatttcngaacgccccttcaatacagtgtggatgaattgggccncaggctcgagggagggctgggagtgggttgccataataaaagagactgctggtagagacaaaacgagaactacgctagctggccttacgagacggacaggacttcaacctatccttcaagtagatagaaatcaacgaggacgccaacttctcgtttcngactaaatgaacacggcctagggaaacgacggaccggaacacgaacgccagttggttacttaagttacggtaactaagttacggaactaacgttaagtaacccggg

SEQ ID NO: 318942 - DNA, 641 bp, Homo sapiens
  misc_feature: GZ8MTXP01CMJDT.3.67.G01.1.454.CMB.2.raw
tcagagacgcactccacgaccggtgctcgatttagagtatacatattgggtttggggagctctgggagaggagccccagccttgggattcccaagtgttttcattcagtgatcaggactgaacacagaggactcaccatggactttggctgaggtgattttcctgctgcctattttaaaggttccatgtgagctgcgacgtggtggcggtcgtggggggagcgttgggtgcgaggccggggtgggtccctgcgacttctcctgtgactaatttcagaacgtccccttacaatacagtgtgatgagttcgggtccacgacggcctaccggaagggggaacgggctgggaggttgggttaggacctaataaagtaaaaagtagaactgtacgtaggtacgaaagaacgaaaacacggaactacgactgtctacgtccttacgaggacggtacaggtacttacaaccttcgtacttacgaagtagaatagtaactacgaaccaaggggactacgttaccttacgttctttacgtacgaacctaaagtacgtaaacacggtaccgagggaaacggacgaccggaaacacggacgtcaagttgttatttaactgtaactaggtacgactaacgttaagtaacccgg

SEQ ID NO: 318943 - DNA, 634 bp, Homo sapiens
  misc_feature: GZ8MTXP01COKXF.3.67.G01.1.454.CMB.2.raw
  modified_base (284)..(284): a, c, t, g, unknown or other
  misc_feature (284)..(284): n is a, c, g, or t
  modified_base (320)..(320): a, c, t, g, unknown or other
  misc_feature (320)..(320): n is a, c, g, or t
  modified_base (364)..(364): a, c, t, g, unknown or other
  misc_feature (364)..(364): n is a, c, g, or t
  modified_base (369)..(369): a, c, t, g, unknown or other
  misc_feature (369)..(369): n is a, c, g, or t
  modified_base (378)..(378): a, c, t, g, unknown or other
  misc_feature (378)..(378): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttcctgctgcctatttttaaaaggttccactgtgagctgcgactgggtggcggtcgtggggggagtcgttgggtgcgaggcccggggtgggtcccctggccgactctcctgtcgctaatttcngaacgccccttcaatacagtgtgatgaagttggccncatgctcgagggaggctggagtggtgcataataaagtagactgntggtnagaacaacngactacgctagctcgtccttgagagcagtactccactattcttacgagacgtatagaactacaacgaggaacgcctaaaccgttcgtttacgtttccgtacgtaaccgtaaacgttcggaaaacctacgggcccgttaaggggaaaccggacccgggaccgggaaccaaaccgacggttacccgttagttacgggttaacttttaacgtttaacgtaaacctaggtttaaacggtaacccgttaacgtttaaccgg

SEQ ID NO: 318944 - DNA, 285 bp, Homo sapiens
  misc_feature: GZ8MTXP02HGSRJ.3.67.G01.1.454.CMB.2.raw
  modified_base (283)..(285): a, c, t, g, unknown or other
  misc_feature (283)..(285): n is a, c, g, or t
tcagagacgcactccacgaccggtgctcgatttagagtatacatattgggtttgggggaagaggaagacgcggacacagccatgtattattgtacattaggacactatagtccctggggccagggaaccctcgtcaccgtctcctcagcctccaccaagggcccatcggtcttccccctggcgccctgctccaggagcacctccgagagcacagcggccctgggctgcctggtcaaggactacttccgagtgcgtctctgagcgggctggcaaggcgcatagnnn

SEQ ID NO: 318945 - DNA, 547 bp, Homo sapiens
  misc_feature: GZ8MTXP02JGC0T.3.67.G01.1.454.CMB.2.raw
  modified_base (307)..(307): a, c, t, g, unknown or other
  misc_feature (307)..(307): n is a, c, g, or t
  modified_base (428)..(428): a, c, t, g, unknown or other
  misc_feature (428)..(428): n is a, c, g, or t
  modified_base (453)..(453): a, c, t, g, unknown or other
  misc_feature (453)..(453): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttcctgctgcctattttaaaaggttccactgtgagctgcgactggtggcgtcgtgggggagcttgggtgcaggccgggtgggtccctgcgactctcctgtgcaatttctgaagccccttccaatcagtgtggatgaattgggtccncaggctccgagggaaggggctgggagtgggttggccatataaaagtagactgctggtgagacaacagactacgctgctgcttcagagcagattcacatcttcagagatagaatcacaggancactctgtttctgacaaatgaaacngacctagggaaacgacggcggaacacgacggcccaagttgtaatttaagttaggtaacctagtttaaggaacctaacgttactttaaacccggg

SEQ ID NO: 318946 - DNA, 537 bp, Homo sapiens
  misc_feature: GZ8MTXP02HPJU8.3.67.G01.1.454.CMB.2.raw
  modified_base (267)..(267): a, c, t, g, unknown or other
  misc_feature (267)..(267): n is a, c, g, or t
  modified_base (305)..(305): a, c, t, g, unknown or other
  misc_feature (305)..(305): n is a, c, g, or t
  modified_base (394)..(394): a, c, t, g, unknown or other
  misc_feature (394)..(394): n is a, c, g, or t
  modified_base (414)..(414): a, c, t, g, unknown or other
  misc_feature (414)..(414): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttcctgctgccattttaaaaggttccactgtgagctgcgactggtggcgtctgggggagcttgggtgcagccgggtgggtccctgcgactctcctgtgcaatttcngaacgccccttcaatacagtgtggatgaattgggtccnccaggctccgaggggaagggctgggagtggggttggccataataaaaagtagactgctggtgagacaacagactacgctgcctgccttnagagcagatcaccatctcanagatgaaatcaacagacgcacttctagtttctgacaaaatcgaaacagcctagggaaaacgaccggacggaacacgacgccaatgtaattaagttgtactagttaaggactacttaataccgg

SEQ ID NO: 318947 - DNA, 538 bp, Homo sapiens
  misc_feature: GZ8MTXP02HCCC4.3.67.G01.1.454.CMB.2.raw
  modified_base (419)..(419): a, c, t, g, unknown or other
  misc_feature (419)..(419): n is a, c, g, or t
  modified_base (424)..(424): a, c, t, g, unknown or other
  misc_feature (424)..(424): n is a, c, g, or t
  modified_base (450)..(450): a, c, t, g, unknown or other
  misc_feature (450)..(450): n is a, c, g, or t
  modified_base (463)..(463): a, c, t, g, unknown or other
  misc_feature (463)..(463): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttcctgctgccattttaaaaggttccactgtgagctgcgactggtggcgtctgggggaggcttgggtgcaggccgggtgggtccctgcgactctcctgtgcaatttctgaagccccttcaatacagtgtggatgaattgggtccgccaggcctccgaggggaacggggctgggagtgggttggccaagtaaataaaaagtagactgctggtgaagacaaacagactacgctgactgccttcagagcagatcacatctnagagntagaatcacagagcacttctagttcngacaaatgaaacngtcctaggaaacgacgcggaacacgacgccaatgtaattaagtagtaactagttaacggactacgtaagtaccgg

SEQ ID NO: 318948 - DNA, 524 bp, Homo sapiens
  misc_feature: GZ8MTXP02HBZKB.3.67.G01.1.454.CMB.2.raw
  modified_base (269)..(269): a, c, t, g, unknown or other
  misc_feature (269)..(269): n is a, c, g, or t
  modified_base (304)..(304): a, c, t, g, unknown or other
  misc_feature (304)..(304): n is a, c, g, or t
  modified_base (374)..(374): a, c, t, g, unknown or other
  misc_feature (374)..(374): n is a, c, g, or t
  modified_base (393)..(393): a, c, t, g, unknown or other
  misc_feature (393)..(393): n is a, c, g, or t
  modified_base (444)..(444): a, c, t, g, unknown or other
  misc_feature (444)..(444): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttcctgctgccattttaaaaggttccactgtgagctgcgactggtggcgtctgggggaggcttggtgcaggccgggtgggtcccctgcgactctcctgtgcaatttcngaagccccttcaatcagtgtggatgaattgggccnccaggctccgaggggaaggggctgggagtggggttggccataataaaaagtagactgctggtgagacaanagactacgctgctgccttnagagcagattcaccatcttcagagatagaatcaacagagcactctgtttcngacaaatgaaacagcctaggaacgacgcggacacgacgcccatgttaattaagttgtaacagttaggactactataccgg

SEQ ID NO: 318949 - DNA, 505 bp, Homo sapiens
  misc_feature: GZ8MTXP02JOQZ1.3.67.G01.1.454.CMB.2.raw
  modified_base (268)..(268): a, c, t, g, unknown or other
  misc_feature (268)..(268): n is a, c, g, or t
  modified_base (303)..(303): a, c, t, g, unknown or other
  misc_feature (303)..(303): n is a, c, g, or t
  modified_base (335)..(335): a, c, t, g, unknown or other
  misc_feature (335)..(335): n is a, c, g, or t
  modified_base (352)..(352): a, c, t, g, unknown or other
  misc_feature (352)..(352): n is a, c, g, or t
  modified_base (362)..(362): a, c, t, g, unknown or other
  misc_feature (362)..(362): n is a, c, g, or t
  modified_base (415)..(415): a, c, t, g, unknown or other
  misc_feature (415)..(415): n is a, c, g, or t
  modified_base (420)..(420): a, c, t, g, unknown or other
  misc_feature (420)..(420): n is a, c, g, or t
  modified_base (426)..(426): a, c, t, g, unknown or other
  misc_feature (426)..(426): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttcctgctgccattttaaaggttccactgtgagctgcgactggtggcgtctgggggagcttgggtgcaggccgggtgggtcccctgcgactctcctgtgcaatttcngaacgccccttcaatcagtgtggatgattgggccncaggctcgagggaggctggagtgggtgcatanaaaagtagactgctggngagacaaacngactacgctgctgccttcagagcagatcacatctcagagatgaatcacaggancactntgttcngacaaatcgaacagctaggaacgacgcgacacgtacgccatgtaattgtacgtaactagttaagactaactagtaccgg

SEQ ID NO: 318950 - DNA, 541 bp, Homo sapiens
  misc_feature: GZ8MTXP02ILUDI.3.67.G01.1.454.CMB.2.raw
  modified_base (273)..(273): a, c, t, g, unknown or other
  misc_feature (273)..(273): n is a, c, g, or t
  modified_base (313)..(313): a, c, t, g, unknown or other
  misc_feature (313)..(313): n is a, c, g, or t
  modified_base (369)..(369): a, c, t, g, unknown or other
  misc_feature (369)..(369): n is a, c, g, or t
  modified_base (397)..(397): a, c, t, g, unknown or other
  misc_feature (397)..(397): n is a, c, g, or t
  modified_base (433)..(433): a, c, t, g, unknown or other
  misc_feature (433)..(433): n is a, c, g, or t
  modified_base (444)..(444): a, c, t, g, unknown or other
  misc_feature (444)..(444): n is a, c, g, or t
  modified_base (456)..(456): a, c, t, g, unknown or other
  misc_feature (456)..(456): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttcctgctgccattttaaaaggttccactgtgagctgcgactgggtggcgtctgggggagcttgggtgcaggccggggtgggtcccctgccgactctcctgtgctaatttcngaacgccccttccaaatacagtgtggatgaattgggtccnccaggctccgagggaagggctggagtgggtgcataataaaaagtagactgactggngagacaacagacctagctgctgcccttnagagcagattcaccatctcagagatgaatcacagancactctgttcngacaatgaaacnaccgtaggaacgacgacggacacgacgtaccaattgtaacttaagttacgtaactatttaacggacctaacgttagtaacccggg

SEQ ID NO: 318951 - DNA, 571 bp, Homo sapiens
  misc_feature: GZ8MTXP02I65XJ.3.67.G01.1.454.CMB.2.raw
  modified_base (384)..(384): a, c, t, g, unknown or other
  misc_feature (384)..(384): n is a, c, g, or t
tcagagacgcactccacgaccggtgctcgatttagagtatacatattgggtttggggagctctgggagaggagccccagccttgggattcccaagtgttttcattcagtgatcaggactgaacacagacgactcaccatggactttgggctgaggtggattttcctgctgcctatttaaaaggttccactgtgagctgcgactgggtggcgtcgtggggggagcttgggtgcaggccggggtgggtcccctgccgactctcctgtgctaatttctgaacgcccccttcaaatacagtgtggatgaattgggtccgccaggctccgaggggaaggggctgggagtggggttggaccaataaataaaaagtaagactgctgggtanaagacaaacagactacgctagcctagcctttacgagagggacaaggtacttacaaccctaatcttacaagagatagaatacaacgagaagctactcttgttctagacaaagtagaacagacctaggaacgacgacggaacacacgccaatgtaattaatagtaacagtacggactaactagtaccgg

SEQ ID NO: 318952 - DNA, 545 bp, Homo sapiens
  misc_feature: GZ8MTXP02H97A0.3.67.G01.1.454.CMB.2.raw
  modified_base (233)..(233): a, c, t, g, unknown or other
  misc_feature (233)..(233): n is a, c, g, or t
  modified_base (275)..(275): a, c, t, g, unknown or other
  misc_feature (275)..(275): n is a, c, g, or t
  modified_base (296)..(296): a, c, t, g, unknown or other
  misc_feature (296)..(296): n is a, c, g, or t
  modified_base (312)..(312): a, c, t, g, unknown or other
  misc_feature (312)..(312): n is a, c, g, or t
  modified_base (397)..(397): a, c, t, g, unknown or other
  misc_feature (397)..(397): n is a, c, g, or t
  modified_base (420)..(420): a, c, t, g, unknown or other
  misc_feature (420)..(420): n is a, c, g, or t
  modified_base (441)..(441): a, c, t, g, unknown or other
  misc_feature (441)..(441): n is a, c, g, or t
  modified_base (505)..(505): a, c, t, g, unknown or other
  misc_feature (505)..(505): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttcctgctgcctatttttaaaaggttccactgtgagctgcgactggtggcgttcgtggggggagctttgggngcaggccgggtgggtccctgcgactctcctgtgctaatttcngacgccccttcaatacagtgnggatgaattcgggccnccaggctccgaggggagggctgggagtgggtgcagtaataaaaagtagactgctggtagagacaacgagctacgctgctgccctnagagcagattcacatctacaganatgaatcacagacgtcacttntgtttcagactaaaatgaaacacgaccgtaggaacgaccggacggacaacgacgtaccaagttntaattaagttgtaactagttacggacctattacgtaccgg

SEQ ID NO: 318953 - DNA, 550 bp, Homo sapiens
  misc_feature: GZ8MTXP02HPTXN.3.67.G01.1.454.CMB.2.raw
  modified_base (271)..(271): a, c, t, g, unknown or other
  misc_feature (271)..(271): n is a, c, g, or t
  modified_base (294)..(294): a, c, t, g, unknown or other
  misc_feature (294)..(294): n is a, c, g, or t
  modified_base (311)..(311): a, c, t, g, unknown or other
  misc_feature (311)..(311): n is a, c, g, or t
  modified_base (375)..(375): a, c, t, g, unknown or other
  misc_feature (375)..(375): n is a, c, g, or t
  modified_base (383)..(383): a, c, t, g, unknown or other
  misc_feature (383)..(383): n is a, c, g, or t
  modified_base (465)..(465): a, c, t, g, unknown or other
  misc_feature (465)..(465): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttcctgctgccattttaaaggttccactgtgagctgcgactggtggcgtcgtgggggagcttgggtgcaggccggggtgggtcccctggcgactctcctgtgcaatttcngaacgccccttacaatacagtgnggatgaattggggtccnccagggcctccgaggggaaggggctgggagtggggttggcataataaaaagtagactgctggtnagacaacngactacgctagcctgccttgagagcagtacttcacctatcttacagtagatagaactcaacgagacgctacgttctgtttcncgacaaacgtgaaacctagacctaggaacgacggccgacacgacgaccatgtattaatgtaactagtacgtacacttatacccgg

SEQ ID NO: 318954 - DNA, 518 bp, Homo sapiens
  misc_feature: GZ8MTXP02H164E.3.67.G01.1.454.CMB.2.raw
  modified_base (304)..(304): a, c, t, g, unknown or other
  misc_feature (304)..(304): n is a, c, g, or t
  modified_base (356)..(356): a, c, t, g, unknown or other
  misc_feature (356)..(356): n is a, c, g, or t
  modified_base (371)..(371): a, c, t, g, unknown or other
  misc_feature (371)..(371): n is a, c, g, or t
  modified_base (380)..(380): a, c, t, g, unknown or other
  misc_feature (380)..(380): n is a, c, g, or t
  modified_base (398)..(398): a, c, t, g, unknown or other
  misc_feature (398)..(398): n is a, c, g, or t
  modified_base (419)..(419): a, c, t, g, unknown or other
  misc_feature (419)..(419): n is a, c, g, or t
  modified_base (430)..(430): a, c, t, g, unknown or other
  misc_feature (430)..(430): n is a, c, g, or t
  modified_base (445)..(445): a, c, t, g, unknown or other
  misc_feature (445)..(445): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttcctgctgccattttaaaaggttccactgtgagctgcgactggtggcgtctgggggagcttggtgcagccgggtggtccctgcgactctcctgtgctaatttctgaacgccccttaccaatacagtgtggatgaattggccncaggctcgagggaggctggagtgggtgcataaataaaaagtagactgctggnagacaacagctacgntgctgcctnagagcagatcacatctanagagatcgaatcaacaggacnctaactcgttnttctacgactaatanaacgacgacgacgaacgacgacgacgacacgacactagtattaagtagtaactactacgacgtactacgtacg

SEQ ID NO: 318955 - DNA, 576 bp, Homo sapiens
  misc_feature: GZ8MTXP02I7EO2.3.67.G01.1.454.CMB.2.raw
  modified_base (223)..(223): a, c, t, g, unknown or other
  misc_feature (223)..(223): n is a, c, g, or t
  modified_base (264)..(264): a, c, t, g, unknown or other
  misc_feature (264)..(264): n is a, c, g, or t
  modified_base (301)..(301): a, c, t, g, unknown or other
  misc_feature (301)..(301): n is a, c, g, or t
  modified_base (342)..(342): a, c, t, g, unknown or other
  misc_feature (342)..(342): n is a, c, g, or t
  modified_base (436)..(436): a, c, t, g, unknown or other
  misc_feature (436)..(436): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctgaggtgatttcctgctgccatttaaaggttccactgtgagctgcgactggtggcgtcgtgggggagcttggngcaggccgggtgggtccctggcgactctctgtgcaatttcngaacgccccttcaatacagtgtggatgaattgggccncaggctcgagggaggctggagtgggttgcataataaaaganactgctggtgagacaacagacctacgctgctgcccttagagagcagtacttacacctattctcaagtagatagaatcgaacagacgctacgttnttacgtttcagaactaaagtagaaccgagacccgtaggaaacggaccgacgggaaccaacgacggtaccctattacggtttaattaacgtttaggtaaaccttagtttaacggaacctaacgttaaacgtttaaccccgg

SEQ ID NO: 318956 - DNA, 689 bp, Homo sapiens
  misc_feature: GZ8MTXP02H97C5.3.67.G01.1.454.CMB.2.raw
  modified_base (273)..(273): a, c, t, g, unknown or other
  misc_feature (273)..(273): n is a, c, g, or t
  modified_base (295)..(295): a, c, t, g, unknown or other
  misc_feature (295)..(295): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctgaggtgattttcctgctgcctattttaaaggttccatgtgagctgcgacgtggtggcgttcgtggggggagcttgggtgcgaggcccggggtgggtccctgcgactctcctgtgctaattcngacgccccttacaatacagtgngatgaattgggccgccgaggctcgaggggaggctgggagtgggtgcataaataaaaagtagactgcgtaggtagaggtacaaacgaagtaccgtaacgctacggcttcgtaccctttgaacggacgggcgtaacgtacttaccaacctaattaccttacgaaaggtaagaagttagaaacttacgaaacgtagaacggtacctaacttcgtttacgtttactacggtaagtaaaacttacggaaaccacggtacccggtaaggggaaaacggacccgggaaccggggtaaaccaaaccgaacggtaccctaaggtttaacttaagtttaacgtttaaggtaaccgttaaaggtttaaccgggtaaaccttaacgttaacggtttaaccccgggg

SEQ ID NO: 318957 - DNA, 545 bp, Homo sapiens
  misc_feature: GZ8MTXP02JD5NJ.3.67.G01.1.454.CMB.2.raw
  modified_base (397)..(397): a, c, t, g, unknown or other
  misc_feature (397)..(397): n is a, c, g, or t
tcagagacgcactccacgaccggtgctcgatttagagtatacatattgggtttggggagctctgggagaggagccccagccttgggattcccaagttgttttcattcagtgatcaggactgaacacagaggactcaccatggactttgggctgaggtggattttcctgctgcctattttaaaaggttccactgtgagctgcgactggtggcgtcgtggggggagcttgggtgcaggccggggtgggtcccctgccgactctcctgtgcatttctgaacgcccctcaatacagtgtggatgaattggtccgcaggcctccgaggggaagggctgggagtggggttgccaataataaaagtagactgctggtgagacaacagactacgctgctgccttnagaggcagactcactatctcagagatgaatcaacagagcactcttgttctgacaaatcgaacagaccgtaggaaacgacggacggaaccacgacgacctaatgttaattaagttagtaactagttaacggactaaccttataacccgg

SEQ ID NO: 318958 - DNA, 547 bp, Homo sapiens
  misc_feature: GZ8MTXP02F4JGB.3.67.G01.1.454.CMB.2.raw
  modified_base (307)..(307): a, c, t, g, unknown or other
  misc_feature (307)..(307): n is a, c, g, or t
  modified_base (397)..(397): a, c, t, g, unknown or other
  misc_feature (397)..(397): n is a, c, g, or t
  modified_base (455)..(455): a, c, t, g, unknown or other
  misc_feature (455)..(455): n is a, c, g, or t
  modified_base (499)..(499): a, c, t, g, unknown or other
  misc_feature (499)..(499): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttcctgctgccattttaaaaggttccactgtgagctgcgactggtggcgtctgggggagcttgggtgcaggccgggtgggtccctgcgactctcctgtgcaatttctgaagccccttcaatacagtgtggatggaattgggtcccnccaggctccgagggaaggggctgggaggtgggtggctaagtaataaaaagtagactgctggtagagacaacagctacgctgctgaccttnagaggcagacttcacctatctcagagatagaatcaacagtacgactactcttgtttcngacaaatgaaacacgaccgtaggaaacgacgacggaacacgacncctatgttaattaagttgtaactaacgttaggacaacgttactaccgg

SEQ ID NO: 318959 - DNA, 523 bp, Homo sapiens
  misc_feature: GZ8MTXP02HTGHQ.3.67.G01.1.454.CMB.2.raw
  modified_base (230)..(230): a, c, t, g, unknown or other
  misc_feature (230)..(230): n is a, c, g, or t
  modified_base (272)..(272): a, c, t, g, unknown or other
  misc_feature (272)..(272): n is a, c, g, or t
  modified_base (310)..(310): a, c, t, g, unknown or other
  misc_feature (310)..(310): n is a, c, g, or t
  modified_base (373)..(373): a, c, t, g, unknown or other
  misc_feature (373)..(373): n is a, c, g, or t
  modified_base (445)..(445): a, c, t, g, unknown or other
  misc_feature (445)..(445): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttcctgctgccattttaaaaggttccactgtgagctgcgactgggtggcgtcgtgggggaggcttgggngcaggccggggtgggtccctgcgactctcctgtgcaatttcngaacgccccttcaatacagtgtggatgaattgggtccnccaggctccgaggggaaggggctgggagtgggttggccaataataaaaagtagactgctggtnagacaacagctagctgctgccttcagagcagattcacattctcagagatgaatcacagagcactctgtttcngacaaatgaaactagcctaggaacgacgcggaacacacgccatcgtattaacgtgtaacattaggactactataccgg

SEQ ID NO: 318960 - DNA, 655 bp, Homo sapiens
  misc_feature: GZ8MTXP02F3B1Z.3.67.G01.1.454.CMB.2.raw
  modified_base (272)..(272): a, c, t, g, unknown or other
  misc_feature (272)..(272): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttcctgctgcctaattttaaaaggttccatgtgagctgcgactggtggcgtcgtgggggagtcttggtgcgaggccggggtggtccctgcgactctcctgtgctaatttcngaacgccccttcaatacagtgtggatgaagttggtccgcaggctccgaagggagggctggaggtgggtcgacctaagtaaataaaaagtagactgacgtggagaagacaaacgagacgtacgctgcgtcgccttacgaggtacgggcaagtactaccaaccgtacttacttaccgaagtaacgtaagtaacgtaataaccgaaacgaagaacgtacctactttacgtttacgtttaccgtaaggtaacctaaaagttaacgaaacgtaacggtacccgtaagggaaaaccggaccggaaccggaaaccgaaacgacgaccgtaatacgttaaattaaccgttaggtaactaagtacggtaaactacgtaacgtttaacccggg

SEQ ID NO: 318961 - DNA, 555 bp, Homo sapiens
  misc_feature: GZ8MTXP02IOCIE.3.67.G01.1.454.CMB.2.raw
  modified_base (273)..(273): a, c, t, g, unknown or other
  misc_feature (273)..(273): n is a, c, g, or t
  modified_base (310)..(310): a, c, t, g, unknown or other
  misc_feature (310)..(310): n is a, c, g, or t
  modified_base (344)..(344): a, c, t, g, unknown or other
  misc_feature (344)..(344): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttcctgctgcctattttaaaaggttccactgtgagctgcgactgggtggcgtctgggggagcttgggtgcaggccggggtgggtcccctgcgactctcctgtgctaatttcngaacgccccttcaatacagtgtggatgaattgggccncaggctcgagggaggctggagtccgggtgcatanaaaagtagctgctggtagagacaacgagactacgctagcttgccttcgagagcagatcactatcttcagtagatagaatacacaagacgcacctttcgtacgttctagaactaaatacgaacacgacgtaggaacggacgacgaacacgacgacctaagtagttaattaagttacgtaacttaagttaacggaactaacgttaacgtacgg

SEQ ID NO: 318962 - DNA, 681 bp, Homo sapiens
  misc_feature: GZ8MTXP02F7XEG.3.67.G01.1.454.CMB.2.raw
  modified_base (273)..(273): a, c, t, g, unknown or other
  misc_feature (273)..(273): n is a, c, g, or t
  modified_base (313)..(313): a, c, t, g, unknown or other
  misc_feature (313)..(313): n is a, c, g, or t
  modified_base (393)..(393): a, c, t, g, unknown or other
  misc_feature (393)..(393): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttcctgctgccattttaaaaggttccactgtgagctgcgactgggtggcgtcgtgggggagcttgggtgcaggccggggtgggtcccctgcgactctctgtgactaatttcngaacgtccccttcaaatcagtgtgatgaagttcgggtccncgaggtcctccggaaggggaacgggcgtgggacggtggggttcgcctaaagtaaagtaaaaagtagactggctagggtanagaacaaagagctacgctagcgtgtaccttcgaggtaggctaagtacttacccaactacttaccttagaaaggaagtataggaactaccaaacgaagggtactactaccttcgtttcggttttacacgtaactaaaagtacggaaaccacgggtacccgtaaaagggaacgggtacccggaccgggaaaccaaacggtaccgacccttaagttacggtttaaacttaactttagggtaaaaccttaagggtttaaccggaaaacttaacccgttaagtttaccccggg

SEQ ID NO: 318963 - DNA, 652 bp, Homo sapiens
  misc_feature: GZ8MTXP02JNRN1.3.67.G01.1.454.CMB.2.raw
  modified_base (278)..(278): a, c, t, g, unknown or other
  misc_feature (278)..(278): n is a, c, g, or t
  modified_base (320)..(320): a, c, t, g, unknown or other
  misc_feature (320)..(320): n is a, c, g, or t
  modified_base (354)..(354): a, c, t, g, unknown or other
  misc_feature (354)..(354): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctgaggtgattttcctgctgcctaattttaaaggttccactgtgagctgcgacgtggtggcgtcgtgggggagtcgttgggtgcgaggccggggttgggtccctgccgactctcctgtcgctaatttcngaacgtccccttcaatacgagtgtggatgaagttcgggcccncgacggcctccggaaggggaacgggcgtaggggnggttggggttcgactaaagtaaaagtaaaaaaggtagtactggacgttagggtagaacgaacaaacgagaccgtacgcgtgtcctcgtcccttagaggacggctaagtacttccaactacttacttaccgaagaagtagtacgtaaactacgaacgaagacgtactaccgttcgttacgtttacagaaacctaaagtacgaaacgtacgtaccgaagggaaacgaccgacggaaaccaacgacgtacctagttagttaattaagtacgtaactagtaacgactaacttacgtaccggg

SEQ ID NO: 318964 - DNA, 591 bp, Homo sapiens
  misc_feature: GZ8MTXP02IE69Y.3.67.G01.1.454.CMB.2.raw
  modified_base (275)..(275): a, c, t, g, unknown or other
  misc_feature (275)..(275): n is a, c, g, or t
  modified_base (312)..(312): a, c, t, g, unknown or other
  misc_feature (312)..(312): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttcctgctgcctaattttaaaaggttccactgtgagctgcgactgggtggcgtcgtgggggagcttgggtgcgaggccggggtgggtccctgcgactctcctgtgctaatttcngaacgccccttcaatacagtgtggatgaattgggccnccaggctccgaggggaggctgggagtggggttgcaataaagtaaaaagtagactggctgggtagaagaacaaacgagaccttacggcttagcttcgcccttgagacggtcaggtacttcaaccctattcttacgaagagaatacgaactcaaacagacgtctacttcttgtttcagtacaaagtcgaaacgcgacgtaggaaacgacggacggaacacgacgacctagttagtaatttaagttagtaactagttaacggtactaacgttacgtacccgg

SEQ ID NO: 318965 - DNA, 524 bp, Homo sapiens
  misc_feature: GZ8MTXP02IG2L7.3.67.G01.1.454.CMB.2.raw
  modified_base (269)..(269): a, c, t, g, unknown or other
  misc_feature (269)..(269): n is a, c, g, or t
  modified_base (304)..(304): a, c, t, g, unknown or other
  misc_feature (304)..(304): n is a, c, g, or t
  modified_base (396)..(396): a, c, t, g, unknown or other
  misc_feature (396)..(396): n is a, c, g, or t
  modified_base (413)..(413): a, c, t, g, unknown or other
  misc_feature (413)..(413): n is a, c, g, or t
  modified_base (439)..(439): a, c, t, g, unknown or other
  misc_feature (439)..(439): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttcctgctgccattttaaaaggttccactgtgagctgcgactgggtggcgtctgggggagcttgggtgcaggccgggtggtcccctgcgactctcctgtgcaatttcngaagccccttcaatcagtgtggatgaattgggccncaggctcagggaaggctggagtgggttggccagtaataaaaagtagactgactggtgagacaaacagacctacgctgcctgccttcagagcngatcaccatcttcaganatgaatcaacagagcactctgtttcngacaaatcgaacagcctagggaaacacggcggaacacaacgccaatgtaattaatacgtaactattaacggactaactataccgg

SEQ ID NO: 318966 - DNA, 587 bp, Homo sapiens
  misc_feature: GZ8MTXP02GT18F.3.67.G01.1.454.CMB.2.raw
  modified_base (267)..(267): a, c, t, g, unknown or other
  misc_feature (267)..(267): n is a, c, g, or t
  modified_base (303)..(303): a, c, t, g, unknown or other
  misc_feature (303)..(303): n is a, c, g, or t
  modified_base (444)..(444): a, c, t, g, unknown or other
  misc_feature (444)..(444): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttcctgctgcctattttaaaaggttccactgtgagctgcgactggtggcgtctgggggagcttggtgcaggccgggtggtccctgcgactctcctgtgcaatttcngaacgccccttacaatcagtgtggatgaattggccncaggctcgagggaggctggagtgggtgctaataagtaaaagtagactgcgtaggtagagaaccaaacgagtaccgtaacgctgacctgtcccttacgaaggaggccaagacttcacctatcttacgagtagatagaactanaacgagacgactacttcgttagtttccagtacaaagtcgaaactacgaccgtagggaacgacggacggaacaacgaacgacctaagtagtttaattaagtttaacgtaactagttaacggaacctaacgttaacgttacccgg

SEQ ID NO: 318967 - DNA, 545 bp, Homo sapiens
  misc_feature: GZ8MTXP02FSJ2P.3.67.G01.1.454.CMB.2.raw
  modified_base (270)..(270): a, c, t, g, unknown or other
  misc_feature (270)..(270): n is a, c, g, or t
  modified_base (305)..(305): a, c, t, g, unknown or other
  misc_feature (305)..(305): n is a, c, g, or t
  modified_base (364)..(364): a, c, t, g, unknown or other
  misc_feature (364)..(364): n is a, c, g, or t
  modified_base (390)..(390): a, c, t, g, unknown or other
  misc_feature (390)..(390): n is a, c, g, or t
  modified_base (405)..(405): a, c, t, g, unknown or other
  misc_feature (405)..(405): n is a, c, g, or t
  modified_base (409)..(409): a, c, t, g, unknown or other
  misc_feature (409)..(409): n is a, c, g, or t
  modified_base (413)..(413): a, c, t, g, unknown or other
  misc_feature (413)..(413): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttcctgctgccattttaaaaggttccactgtgagctgcgactggtggcgtctgggggaggcttggtgcaggccggggtgggtcccctgcgactctcctgtgcaatttcngaacgccccttcaatacagtgtgatgaattggccncaggctccgaggggagggctgggagtgggtggccagtaataaaaagagactgctggtanagacaacagctacgctgcctgccttnagagcagattcactntctnaganatagatacacgagagactacttcgttgtttccagtactaaaatcgaaacacgaccgtaggaaaacgcggacggaccaacgacgacctaagtgttattaattgtaactagttaggaactacctagtaacccgg

SEQ ID NO: 318968 - DNA, 551 bp, Homo sapiens
  misc_feature: GZ8MTXP02G04UG.3.67.G01.1.454.CMB.2.raw
  modified_base (275)..(275): a, c, t, g, unknown or other
  misc_feature (275)..(275): n is a, c, g, or t
  modified_base (397)..(397): a, c, t, g, unknown or other
  misc_feature (397)..(397): n is a, c, g, or t
  modified_base (400)..(400): a, c, t, g, unknown or other
  misc_feature (400)..(400): n is a, c, g, or t
  modified_base (420)..(420): a, c, t, g, unknown or other
  misc_feature (420)..(420): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttcctgctgccattttaaaaggttccactgtgagctgcgactggtggcgtcgtgggggagcttgggtgcgaggccggggtgggtcccctggccgactctcctgtgctaatttcngaacgccccttcaatacagtgtggatgaagttggtccgccaggctaccgagggagggctggagtgggtgcataaataaaaagtagactgctggtagagacaacagactacgctgctgccttnagngcagatcacatctcagaganagaaatcaacagacgcacttctgttcctagactaaatcgaaacagcctaagggaaacgacggacggaaccacgaacgacctagtagttaattaagttcgtaactagttacggaactaacctagttacccgg

SEQ ID NO: 318969 - DNA, 555 bp, Homo sapiens
  misc_feature: GZ8MTXP02ICOBT.3.67.G01.1.454.CMB.2.raw
  modified_base (262)..(262): a, c, t, g, unknown or other
  misc_feature (262)..(262): n is a, c, g, or t
  modified_base (274)..(274): a, c, t, g, unknown or other
  misc_feature (274)..(274): n is a, c, g, or t
  modified_base (297)..(297): a, c, t, g, unknown or other
  misc_feature (297)..(297): n is a, c, g, or t
  modified_base (313)..(313): a, c, t, g, unknown or other
  misc_feature (313)..(313): n is a, c, g, or t
  modified_base (352)..(352): a, c, t, g, unknown or other
  misc_feature (352)..(352): n is a, c, g, or t
  modified_base (372)..(372): a, c, t, g, unknown or other
  misc_feature (372)..(372): n is a, c, g, or t
  modified_base (381)..(381): a, c, t, g, unknown or other
  misc_feature (381)..(381): n is a, c, g, or t
  modified_base (399)..(399): a, c, t, g, unknown or other
  misc_feature (399)..(399): n is a, c, g, or t
  modified_base (407)..(407): a, c, t, g, unknown or other
  misc_feature (407)..(407): n is a, c, g, or t
  modified_base (412)..(412): a, c, t, g, unknown or other
  misc_feature (412)..(412): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttcctgctgcctattttaaaaggttccactgtgagctgcgactggtggcgtcgtggggggagcttggtgcaggcccggggtgggtccctggcgactctccngtgctaatttcngaacgccccttacaatacagtgnggatgaattcgggccncaggctccgaggggagggctgggagtggggtgcataaanaaaaagtagactgctgggtnagacaaacngactacgctgctgccttnagagcagntcacntctcagacgatagaatcacagagctattctgtttcagtacaaagtgaacagtcctaggaacgacggacggaaacacgaacgtaccagttacttaattaattacgtaaactaatttaacgggaaccctagttaacgtaacccgg

SEQ ID NO: 318970 - DNA, 559 bp, Homo sapiens
  misc_feature: GZ8MTXP02F1O0M.3.67.G01.1.454.CMB.2.raw
  modified_base (272)..(272): a, c, t, g, unknown or other
  misc_feature (272)..(272): n is a, c, g, or t
  modified_base (277)..(277): a, c, t, g, unknown or other
  misc_feature (277)..(277): n is a, c, g, or t
  modified_base (310)..(310): a, c, t, g, unknown or other
  misc_feature (310)..(310): n is a, c, g, or t
  modified_base (377)..(377): a, c, t, g, unknown or other
  misc_feature (377)..(377): n is a, c, g, or t
  modified_base (385)..(385): a, c, t, g, unknown or other
  misc_feature (385)..(385): n is a, c, g, or t
  modified_base (399)..(399): a, c, t, g, unknown or other
  misc_feature (399)..(399): n is a, c, g, or t
  modified_base (402)..(402): a, c, t, g, unknown or other
  misc_feature (402)..(402): n is a, c, g, or t
  modified_base (436)..(436): a, c, t, g, unknown or other
  misc_feature (436)..(436): n is a, c, g, or t
tcagagacgcactccacgaccggtgctcgatttagagtatacatattgggtttggggagctctgggagaggagcaccagccttgggattcccaagtgttttcattcagtgatcaggactgaacacagaggactcaccatggactttgggctgaggtggattttcctgctgcctattttaaaaggtttccactgtgagctgcgactggtggcgtcgtgggggagcgttggtgcgaggccgggtggtccctgcgactctcctgtgctaatttcngaacnccccttacaatacagtgtggatgattcgggccncgaggctcgagggagggctggagtgggtgacaagtaataaaagtagacctgacgtgtagagacaacngactacgntacgctagccttanagngacagtatcactatctacgagagatagaactcanacgatacctacttacttgtttcgagtaactaaatacgaacagaccgtaggaacggaccgacggaaacacgacgacctagttagtaatttaagtctaacgtagttaacgacctaacgtttaacg

SEQ ID NO: 318971 - DNA, 617 bp, Homo sapiens
  misc_feature: GZ8MTXP02GRYRI.3.67.G01.1.454.CMB.2.raw
  modified_base (274)..(274): a, c, t, g, unknown or other
  misc_feature (274)..(274): n is a, c, g, or t
  modified_base (315)..(315): a, c, t, g, unknown or other
  misc_feature (315)..(315): n is a, c, g, or t
  modified_base (412)..(412): a, c, t, g, unknown or other
  misc_feature (412)..(412): n is a, c, g, or t
  modified_base (448)..(448): a, c, t, g, unknown or other
  misc_feature (448)..(448): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttcctgctgcctattttaaaaggttccactgtgagctgcgactggtggcgtcgtggggggagcttgggtgcaggccggggtgggtcccctggcgactctcctgtgcaatttcngaacgccccttacaatacagtgtggatgaagttgggtcccnccagggcctaccggaggggaaggggctggggaggttggggttgacctaagtaaagtaaaaaggtagactgacgtggtagagacaacagacctacccngcctgcccttgagagcagactacactatctacaganatagaaactcaaacaggacgtacctacttccgttagtttccacgtactaaaatcgaaacgagtacccgaagggaacgaaccggcggtaaaccacgaacgcctaagttacgttaatttaagttcgtaaactaagtttacggaacctaacgttaacgtacggtaccccggg

SEQ ID NO: 318972 - DNA, 591 bp, Homo sapiens
  misc_feature: GZ8MTXP02JX2Y8.3.67.G01.1.454.CMB.2.raw
  modified_base (269)..(269): a, c, t, g, unknown or other
  misc_feature (269)..(269): n is a, c, g, or t
  modified_base (307)..(307): a, c, t, g, unknown or other
  misc_feature (307)..(307): n is a, c, g, or t
  modified_base (374)..(374): a, c, t, g, unknown or other
  misc_feature (374)..(374): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttcctgctgcctattttaaaaggttccactgtgagctgcgactggtggcgtcgtgggggagcttgggtgcaggccgggtggtccctgcgactctcctgtgcaatttcngaacgccccttcaatacagtgtggatgaattgggtccncaggctccgaggggaaggctggagtggggttgcataaagtaaaaagagactgctgggtgaagacaanaggactacggctggctgccctttagagaggcaagacttccaacctatcttacagagatagaatacgacaagacgacaacttcgtagtttaccaaacgtaaaatcgaaacacgtaccgtagggaaacgaaccggacggaaaccaaccgacggaccctaaagtcgttaattaaacgttgttaacaagtttacggaactacgtaacgtacgtaccccggg

SEQ ID NO: 318973 - DNA, 531 bp, Homo sapiens
  misc_feature: GZ8MTXP02GKG8V.3.67.G01.1.454.CMB.2.raw
  modified_base (270)..(270): a, c, t, g, unknown or other
  misc_feature (270)..(270): n is a, c, g, or t
  modified_base (291)..(291): a, c, t, g, unknown or other
  misc_feature (291)..(291): n is a, c, g, or t
  modified_base (306)..(306): a, c, t, g, unknown or other
  misc_feature (306)..(306): n is a, c, g, or t
  modified_base (385)..(385): a, c, t, g, unknown or other
  misc_feature (385)..(385): n is a, c, g, or t
  modified_base (393)..(393): a, c, t, g, unknown or other
  misc_feature (393)..(393): n is a, c, g, or t
  modified_base (459)..(459): a, c, t, g, unknown or other
  misc_feature (459)..(459): n is a, c, g, or t
  modified_base (524)..(524): a, c, t, g, unknown or other
  misc_feature (524)..(524): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttccttgctgccattttaaaaggttccactgtgagctgcgactggtggcgtctgggggagcttgggtgcaggccgggtgggtcccctgcgactctcctgtgcaatttcngaagccccttcaatacagtgnggatgaattgggccncaggctcgagggaggctggagtgggtgccataataaaagtagactgctggtgagacaacagactacgctgctgcccttnagagcagntcaccatctcagagatgaaatcgaacagaacgcaacgttcttagttcctgactaaatacggaaacngaccgtagggaaacgcggacggacacgacgccaatgtaattgtagtaacagttacggacaacgtntaaccgg

SEQ ID NO: 318974 - DNA, 547 bp, Homo sapiens
  misc_feature: GZ8MTXP02I696X.3.67.G01.1.454.CMB.2.raw
  modified_base (272)..(272): a, c, t, g, unknown or other
  misc_feature (272)..(272): n is a, c, g, or t
  modified_base (277)..(277): a, c, t, g, unknown or other
  misc_feature (277)..(277): n is a, c, g, or t
  modified_base (284)..(284): a, c, t, g, unknown or other
  misc_feature (284)..(284): n is a, c, g, or t
  modified_base (305)..(305): a, c, t, g, unknown or other
  misc_feature (305)..(305): n is a, c, g, or t
  modified_base (340)..(340): a, c, t, g, unknown or other
  misc_feature (340)..(340): n is a, c, g, or t
  modified_base (395)..(395): a, c, t, g, unknown or other
  misc_feature (395)..(395): n is a, c, g, or t
  modified_base (435)..(435): a, c, t, g, unknown or other
  misc_feature (435)..(435): n is a, c, g, or t
  modified_base (439)..(439): a, c, t, g, unknown or other
  misc_feature (439)..(439): n is a, c, g, or t
  modified_base (454)..(454): a, c, t, g, unknown or other
  misc_feature (454)..(454): n is a, c, g, or t
  modified_base (467)..(467): a, c, t, g, unknown or other
  misc_feature (467)..(467): n is a, c, g, or t
  modified_base (474)..(474): a, c, t, g, unknown or other
  misc_feature (474)..(474): n is a, c, g, or t
tcagagacgcactccacgaccggtgctcgatttagagtatacatattgggttttgggagctctgggagaggagccccagccttgggattcccaagtgttttcattcagtgatcaggactgaacacagaggactcaccatggactttgggctgtggtggattttcctgctgcctattttaaaggttccactgtgagctgcgactggtggcgtcgtgggggagcttgggtgcgaggccggggtggtcccctgcgactctcctgtgctaatttcngaacnccccttnaatcagtgtgattagtggccncgagctcgaggggaggctggagtgggtgcataaanaaaagtagactgcgtggagagacaacgagactacgctaggctgccttacgaaggnggaccagtacttcgacctatctacaggagatagaatcaanaganctactcttgtttacngaacaatgaaacngcagganaccggacgacacgacacagttacgtatttagtaagtaactagttacggacctaacgttacgtaacgtcccggg

SEQ ID NO: 318975 - DNA, 568 bp, Homo sapiens
  misc_feature: GZ8MTXP02JX4YC.3.67.G01.1.454.CMB.2.raw
  modified_base (228)..(228): a, c, t, g, unknown or other
  misc_feature (228)..(228): n is a, c, g, or t
  modified_base (270)..(270): a, c, t, g, unknown or other
  misc_feature (270)..(270): n is a, c, g, or t
  modified_base (274)..(274): a, c, t, g, unknown or other
  misc_feature (274)..(274): n is a, c, g, or t
  modified_base (304)..(304): a, c, t, g, unknown or other
  misc_feature (304)..(304): n is a, c, g, or t
  modified_base (363)..(363): a, c, t, g, unknown or other
  misc_feature (363)..(363): n is a, c, g, or t
  modified_base (392)..(392): a, c, t, g, unknown or other
  misc_feature (392)..(392): n is a, c, g, or t
  modified_base (395)..(395): a, c, t, g, unknown or other
  misc_feature (395)..(395): n is a, c, g, or t
  modified_base (426)..(426): a, c, t, g, unknown or other
  misc_feature (426)..(426): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttccttgctgccattttaaaaggttccactgtgagctgcgactggtggcgtcgtgggggagcttggngcaggccggggtgggtccctgcgactctcctgtgcaatttcngacncccctcaatcagtgtggatgaattgggccncaggctcgaggggagggctggagtgggttgccaataataaaaagtagactgctgggtanagacaacgagactacgctagctgcccttnagngcagacttcacatctcagagatagaactcanagagctactcttgtttcagacaaagtcgaaacacgtaccgaggaacggaccggacggaactaccgaacggacctagttacgttatttaacgttacggttaaacgtagtttaacggaacctttacgtaaacgtttaccccggg

SEQ ID NO: 318976 - DNA, 607 bp, Homo sapiens
  misc_feature: GZ8MTXP02GKAMY.3.67.G01.1.454.CMB.2.raw
  modified_base (230)..(230): a, c, t, g, unknown or other
  misc_feature (230)..(230): n is a, c, g, or t
  modified_base (274)..(274): a, c, t, g, unknown or other
  misc_feature (274)..(274): n is a, c, g, or t
  modified_base (312)..(312): a, c, t, g, unknown or other
  misc_feature (312)..(312): n is a, c, g, or t
  modified_base (370)..(370): a, c, t, g, unknown or other
  misc_feature (370)..(370): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttcctgctgccattttaaaaggttccactgtgagctgcgactgggtggcgtcgtggggggagcttgggngcgaggccggggtgggtccctggcgactctcctgtgcaatttcngaacgccccttcaatacagtgtggatgaagttgggccncaggctcgaggggagggctgggagtgggtgacataagtaaaaagtagactgctaggtnaagacaacgagacctacgctgcttgccttgaaggagcagtacttcaccctattctacgagtagatagaatccgaacagacgctaactcgttgtttaccgagaactaaacgtcgaaacctcgacccgtaagggaaacggaccggtaccggaaccaacgacggaccctaaagttacggttaaatttaagtttacggtaaactaacggtttaaacggaacctacgtttaacgtacccggg

SEQ ID NO: 318977 - DNA, 591 bp, Homo sapiens
  misc_feature: GZ8MTXP02F40QN.3.67.G01.1.454.CMB.2.raw
  modified_base (232)..(232): a, c, t, g, unknown or other
  misc_feature (232)..(232): n is a, c, g, or t
  modified_base (276)..(276): a, c, t, g, unknown or other
  misc_feature (276)..(276): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttcctgctgcctaattttaaaaggtttccactgtgagctgcgactgggtggcgtcgtgggggagcttgggngcaggccggggtgggtcccctggcgactctcctgtgcaatttcngaacgcccccttcaatacagtgtggatgaattcgggtccgccgaggcctccgaaggggaaggggctagggaggtggggttggcctaataaagtaaaaaagtagactgcgtaggtgaagacaacagactacgctgctgccttcgagagcagattcactatctacagagatagaatcaacagacgcacttcttattcctagactaaaatacgaacaacgccgtaagggaaacgacggaccggaacaacgacgaccaagttagttaattaagttacgttaactaaagttaacggaactaacgttaacgttaacccggg

SEQ ID NO: 318978 - DNA, 586 bp, Homo sapiens
  misc_feature: GZ8MTXP02IM540.3.67.G01.1.454.CMB.2.raw
  modified_base (279)..(279): a, c, t, g, unknown or other
  misc_feature (279)..(279): n is a, c, g, or t
  modified_base (316)..(316): a, c, t, g, unknown or other
  misc_feature (316)..(316): n is a, c, g, or t
  modified_base (362)..(362): a, c, t, g, unknown or other
  misc_feature (362)..(362): n is a, c, g, or t
  modified_base (373)..(373): a, c, t, g, unknown or other
  misc_feature (373)..(373): n is a, c, g, or t
  modified_base (401)..(401): a, c, t, g, unknown or other
  misc_feature (401)..(401): n is a, c, g, or t
  modified_base (489)..(489): a, c, t, g, unknown or other
  misc_feature (489)..(489): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttcctgctgcctattttaaaaggtttccactgtgagctgcgactgggtggcgtcgtggggggaggcttgggtgcgaggccggggtgggtcccctggcgactctcctgtgctaatttcngaacgccccttcaatacagtgtggatgaattgggccnccaggctccgaggggagggctggagtgggtgcataataaaagtagntgcgtggtganacaaacagactacgctgcctgcccttanagagcagacttcacctatcttacagtagaattgaaactcaacaggtacacactttctacgttttccgagtaacctaaaatcgaaaacngacccgtaagggaacggaaccgaccgggaaccaacgacgaccctaagttacgtaatttaagttagtaactagttaacgactaactacgttaacccgg

SEQ ID NO: 318979 - DNA, 536 bp, Homo sapiens
  misc_feature: GZ8MTXP02F5WYD.3.67.G01.1.454.CMB.2.raw
  modified_base (272)..(272): a, c, t, g, unknown or other
  misc_feature (272)..(272): n is a, c, g, or t
  modified_base (309)..(309): a, c, t, g, unknown or other
  misc_feature (309)..(309): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttcctgctgccattttaaaaggttccactgtgagctgcgactgggtggcgtcgtggggggagcttggtgcaggccggggtggtcccctgccgactctcctgtgcaatttcngaacgccccttcaaatcagtgtggatgaattggtccnccaggctcgagggaggctggagtgggtgccataagtaaaagtagactgctggtagagacaacagctacgctagctgccttcagagcagattcacatctcagagtatagatacacagacgcacttcttagtttcagactaaagtgaacacgaccgtaggaacgacgacggacacgacgacctatagttattaagttagtaactacgttagaactactaacgttaccgg

SEQ ID NO: 318980 - DNA, 581 bp, Homo sapiens
  misc_feature: GZ8MTXP02G9HMM.3.67.G01.1.454.CMB.2.raw
  modified_base (278)..(278): a, c, t, g, unknown or other
  misc_feature (278)..(278): n is a, c, g, or t
  modified_base (315)..(315): a, c, t, g, unknown or other
  misc_feature (315)..(315): n is a, c, g, or t
  modified_base (359)..(359): a, c, t, g, unknown or other
  misc_feature (359)..(359): n is a, c, g, or t
  modified_base (386)..(386): a, c, t, g, unknown or other
  misc_feature (386)..(386): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttcctgctgcctattttaaaaggttccactgtgagctgcgactgggtggcgtcgtggggggaggcttgggtgcgaggccggggtgggtcccctggcgactctcctgtgctaatttcngaacgcccccttacaatacagtgtgatgaattggccncaggctcgagggagggctgggagtgggtgctataataaaagtanactgctgggtagagacaacagactcgntcgctgcccttagaacgaggcagacttacacctatcttcagtagagttagaaatccgaaacgtagacgtccaacgttcgttcgtttccagacctaaagtcgaaacgtacgtaccgtaagggaacgacggacggaaccacgacgacctatacgttaattaacgttagaactagttacgactacgtacgtacccggg

SEQ ID NO: 318981 - DNA, 581 bp, Homo sapiens
  misc_feature: GZ8MTXP02FOJ35.3.67.G01.1.454.CMB.2.raw
  modified_base (426)..(426): a, c, t, g, unknown or other
  misc_feature (426)..(426): n is a, c, g, or t
  modified_base (453)..(453): a, c, t, g, unknown or other
  misc_feature (453)..(453): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctgaggtgattttcctgctgcctattttaaaaggttccactgtgagctgcgactggtggcgtcgtgggggaggcttgggtgcaggccggggtgggtcccctgcgactctcctgtgcaatttctgaacgccccttcaatacagtgtggatggaattgggtccgccgaggctccgaggggaggggctggagtgggtgcaataataaaaagtaagctgctggtagagacaacagactacgctgctgccttcagagcagacttcaccatcttcagagatanaatcaacagacgctactcttgtttccngacaaagtcgaaacagtcccgtagggaaaacgaccggacgggaaccaacgacggaccctaagttacgttaaatttaacgtttacgtaaaccgttaagttaaaggaacctaacgttagttaaccccggg

SEQ ID NO: 318982 - DNA, 638 bp, Homo sapiens
  misc_feature: GZ8MTXP02JT5G4.3.67.G01.1.454.CMB.2.raw
  modified_base (273)..(273): a, c, t, g, unknown or other
  misc_feature (273)..(273): n is a, c, g, or t
  modified_base (314)..(314): a, c, t, g, unknown or other
  misc_feature (314)..(314): n is a, c, g, or t
  modified_base (542)..(542): a, c, t, g, unknown or other
  misc_feature (542)..(542): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttcctgctgcctattttaaaagttccactgtgagctgcgacgtggtggcgtcgtgggggagtcttgggtgcaggccggggtgggtccctgcgactctcctgtgctaatttcngaacgccccttcaattacagtgtggatgaagttcgggtccncgaggcctaccggaaggggaacggggcttaggggacggtttggggttacggacctaaagtaaacgtaaaaaaggtacgacctggacgtagggtagaacgaacaaacagaccctacgctggctggtcccttagaagaggcctaaagtacttaccaaccctattccctagaagagtatagaactacgaacgaagacgctaacttcggttactttcgaacgtacaaaacgngaaaacctcggtaccgaaggaaccgacggaccggaaaccacggacgttaccaagttgtaattaagtacgtaacatacggactacgttacgtccggg

SEQ ID NO: 318983 - DNA, 563 bp, Homo sapiens
  misc_feature: GZ8MTXP02IFBWS.3.67.G01.1.454.CMB.2.raw
  modified_base (272)..(272): a, c, t, g, unknown or other
  misc_feature (272)..(272): n is a, c, g, or t
  modified_base (307)..(307): a, c, t, g, unknown or other
  misc_feature (307)..(307): n is a, c, g, or t
  modified_base (391)..(391): a, c, t, g, unknown or other
  misc_feature (391)..(391): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttcctgctgcctattttaaaaggttccactgtgagctgcgactggtggcgtcgtgggggagtcttgggtgcgaggccgggtgggtccctgcgactctcctgtgcaatttcngaacgccccttcaatcagtgtggatgaatcggccncaggctcgagggaggctggagtgggtgcataataaaagtagactgctggtgagacaacagctacgctgctgccttgagagcagntcgaccatctcagagatagaatacacagacgcacttcttagtttcctgaacctaaagtacgaaactacgacccgtagggaaacggaccggacgggaaaccaacgacgacctaagtcgtttaattaagttacgttaaactagtttaacggaactaacgtaacgttaacccggg

SEQ ID NO: 318984 - DNA, 593 bp, Homo sapiens
  misc_feature: GZ8MTXP02HAIX5.3.67.G01.1.454.CMB.2.raw
  modified_base (278)..(278): a, c, t, g, unknown or other
  misc_feature (278)..(278): n is a, c, g, or t
  modified_base (460)..(460): a, c, t, g, unknown or other
  misc_feature (460)..(460): n is a, c, g, or t
  modified_base (469)..(469): a, c, t, g, unknown or other
  misc_feature (469)..(469): n is a, c, g, or t
  modified_base (474)..(474): a, c, t, g, unknown or other
  misc_feature (474)..(474): n is a, c, g, or t
tcagagacgcactccacgaccggtgctcgatttagagtatacatattgggtttggggagctctgggagaggagcaccagccttgggattcccaagtgttttcattcagtgatcaggactgaacacagaggactcaccatggactttgggctgaggtggattttcctgctgcctattttaaaaggttccatgtgagctgcgacgtggtggcgtcgtggggggagtcgttgggtgcgaggccggggtggtccctgcgactctcctgtgctattctgaacnccccttacaatacagtgtagatgaagttcgggccgcgaggctccggaaggggagggcgtggagggttggggtcgacctaagtaaagtaaaaaggtagacgtgctgggtacgagaacaaacgagtacctacgctgcctcgtcccttagacgagacacgtactaccacctatctacgagagtanagaatcaanacganctacgttcttcgttacgtacaataaacgtacgaacgacgtacgaaggaacgacggaccggaacacgacgacctagttagttaattacgttataacgtaacgtacgtactaacgttaacg

SEQ ID NO: 318985 - DNA, 680 bp, Homo sapiens
  misc_feature: GZ8MTXP02HY2ON.3.67.G01.1.454.CMB.2.raw
  modified_base (260)..(260): a, c, t, g, unknown or other
  misc_feature (260)..(260): n is a, c, g, or t
  modified_base (290)..(290): a, c, t, g, unknown or other
  misc_feature (290)..(290): n is a, c, g, or t
  modified_base (418)..(418): a, c, t, g, unknown or other
  misc_feature (418)..(418): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttcctgctgcctattttaaaggttccactgtgagctgcgactggtggcgtcgtgggggagcttggtgcaggccgggtgggtccctgcgactctcctgtnctattcagaacgccccttacaatacagtgngatagaagttcggccgcaggctaccgaggggaacgggctgggaggttggggttggacctaaagtaaagtaaaaaaacggtagtacgttagaccgttagggagaaacgacaaacgacgtaccttacccngtccctcgtacccttagaagtacggacacgtacttaccaacctactccttacgaaggaagtacgtagaactacgaacgacgtacgtacctacgttcgtttacgtttacgagtaacgtaaacgtaacgaacgtaacgtaccgtaacggaaacggaacggaccggaaccgaaccgaacgtaacgtaacgttaacgttaacgttaacgttaacgttaacgttaaacgttaacggtaacgtaacgttaacgttaaccggtacccgg

SEQ ID NO: 318986 - DNA, 569 bp, Homo sapiens
  misc_feature: GZ8MTXP02JN8HD.3.67.G01.1.454.CMB.2.raw
  modified_base (284)..(284): a, c, t, g, unknown or other
  misc_feature (284)..(284): n is a, c, g, or t
  modified_base (306)..(306): a, c, t, g, unknown or other
  misc_feature (306)..(306): n is a, c, g, or t
  modified_base (320)..(320): a, c, t, g, unknown or other
  misc_feature (320)..(320): n is a, c, g, or t
  modified_base (374)..(374): a, c, t, g, unknown or other
  misc_feature (374)..(374): n is a, c, g, or t
  modified_base (548)..(548): a, c, t, g, unknown or other
  misc_feature (548)..(548): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctggaggtggtattttccttgctgcctaattttaaaaggttccactgtgagctgcgactggtggcgtgtgggggagcttggtgcgaggccggggttgggtcccctggccgtacttctccgtgtcgactaatttcngaacgccccttacaatcagtgnggatgattcggccncaggctcgagggaggctggagtgggtcgcataaataaaagtagactgcgtggtnaagacaagagacctacgctgacctgtccctagagacggctaagtacttccaactattcgttacaagtagatagtaatcgaacagacgtctacgttcttgttcagacctaaagtacgaacaccgtacgacggaaacggacgacgggacaacacgccattcgtattaacgtataanactagactagttactaccggg

SEQ ID NO: 318987 - DNA, 594 bp, Homo sapiens
  misc_feature: GZ8MTXP02JE9PL.3.67.G01.1.454.CMB.2.raw
  modified_base (274)..(274): a, c, t, g, unknown or other
  misc_feature (274)..(274): n is a, c, g, or t
  modified_base (313)..(313): a, c, t, g, unknown or other
  misc_feature (313)..(313): n is a, c, g, or t
  modified_base (464)..(464): a, c, t, g, unknown or other
  misc_feature (464)..(464): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttccttgctgcctaattttaaaaggttccactgtgagctgcgactgggtggcgtcgtgggggagcttggtgcgaggccgggtgggtccctgccgactctcctgtgcaatttcngaacgccccttacaatacagtgtgatgaagttgggtccncaggcctccgaggggacgggctgggaggtggggttgccaataagtaaaaagtagactggctggtgaagacaaacgagaccgtacgctggcctggtcccttacgaggacgacagtacttacacctatcttacagagatagaatcacaggacncgacttcttgttcagaactaaatcgaaacacgaccgtagggaacgaccggacggaaccgacgacggacctaacgttattaattaagttaacgtaactagttaacggacttaacgtaacgtttaacccggg

SEQ ID NO: 318988 - DNA, 555 bp, Homo sapiens
  misc_feature: GZ8MTXP02GTLL5.3.67.G01.1.454.CMB.2.raw
  modified_base (257)..(257): a, c, t, g, unknown or other
  misc_feature (257)..(257): n is a, c, g, or t
  modified_base (264)..(264): a, c, t, g, unknown or other
  misc_feature (264)..(264): n is a, c, g, or t
  modified_base (422)..(422): a, c, t, g, unknown or other
  misc_feature (422)..(422): n is a, c, g, or t
  modified_base (442)..(442): a, c, t, g, unknown or other
  misc_feature (442)..(442): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctgaggtgattttcctgctgccatttaaaggttccactgtgagctgcgactgggtggcgtctgggggagcttggtgcaggccgggtgggtccctgcgactctcctgtncaattcngaagccccttcaatacagtgtggatgaattcgggtccgccagggctaccgaggggaaggggctgggagttggggttgacctataaataaaaaaggtagactgctggtgaagacaaacagctacgactgctgcttcgagagcagatcaccatctcaganatagaatcacgagagcactntgtttcagactaatcgaacacgtaccgaggtaacgacgaccggaactaaccgacgaccaatgttaaagttaacttacggtaactaagttacgactaaccgtactttaacccgg

SEQ ID NO: 318989 - DNA, 567 bp, Homo sapiens
  misc_feature: GZ8MTXP02FKDLK.3.67.G01.1.454.CMB.2.raw
  modified_base (272)..(272): a, c, t, g, unknown or other
  misc_feature (272)..(272): n is a, c, g, or t
  modified_base (277)..(277): a, c, t, g, unknown or other
  misc_feature (277)..(277): n is a, c, g, or t
  modified_base (294)..(294): a, c, t, g, unknown or other
  misc_feature (294)..(294): n is a, c, g, or t
  modified_base (307)..(307): a, c, t, g, unknown or other
  misc_feature (307)..(307): n is a, c, g, or t
  modified_base (368)..(368): a, c, t, g, unknown or other
  misc_feature (368)..(368): n is a, c, g, or t
  modified_base (439)..(439): a, c, t, g, unknown or other
  misc_feature (439)..(439): n is a, c, g, or t
  modified_base (444)..(444): a, c, t, g, unknown or other
  misc_feature (444)..(444): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttcctgctgcctattttaaaaggttccactgtgagctgcgactggtggcgtcgtgggggagtcttgggtgcgaggccggggtggtccctgcgactctctgtgctaatttcngaacnccccttcaatacagtgngatgaattggccncagctcgagggaggctgggagtgggtcgacctaataaagtaaaaagtagactgctaggtanagaacaacagctacgctagcctgacctgaaggagcaagtacttacaccattctacagagatagaataccanagacnctaacttcttagttcctagactaaagtacgaaacgagtaccgaaggaacgacggacgaacacgacgcctaagtagttaataagttaacgtactaagttaacggacctaacgtagttaccccgg

SEQ ID NO: 318990 - DNA, 627 bp, Homo sapiens
  misc_feature: GZ8MTXP02G65JD.3.67.G01.1.454.CMB.2.raw
  modified_base (231)..(231): a, c, t, g, unknown or other
  misc_feature (231)..(231): n is a, c, g, or t
  modified_base (272)..(272): a, c, t, g, unknown or other
  misc_feature (272)..(272): n is a, c, g, or t
  modified_base (309)..(309): a, c, t, g, unknown or other
  misc_feature (309)..(309): n is a, c, g, or t
  modified_base (419)..(419): a, c, t, g, unknown or other
  misc_feature (419)..(419): n is a, c, g, or t
  modified_base (428)..(428): a, c, t, g, unknown or other
  misc_feature (428)..(428): n is a, c, g, or t
  modified_base (460)..(460): a, c, t, g, unknown or other
  misc_feature (460)..(460): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttcctgctgcctattttaaaaggttccactgtgagctgcgactgggtggcgtcgtgggggagtcttgggngcaggccgggtggtcccctgcgactctcctgtgctatttcngaacgccccttacaatcagtgtggatgaagtcggccncaggcctccggaggggagggctgggagtggggtacggactaagtaaaagtaaaaaggtagacgtcgctgggtagaagacaaacagtacctacgctagcctcgtaccgttnaagggacgnacgtattccaacctattacgttacaaggtaanagttagaaacttacgaacgaacgacgtcctacttccggttatttccgtagaactaaaagtcgaaacgtacgtaccgtaggaaaccgacggaccggaacacacgacctaagttacgttaagttaattacgtaacgttaagttacggaacttacgtaacgttacccggg

SEQ ID NO: 318991 - DNA, 556 bp, Homo sapiens
  misc_feature: GZ8MTXP02G3F1H.3.67.G01.1.454.CMB.2.raw
  modified_base (230)..(230): a, c, t, g, unknown or other
  misc_feature (230)..(230): n is a, c, g, or t
  modified_base (275)..(275): a, c, t, g, unknown or other
  misc_feature (275)..(275): n is a, c, g, or t
  modified_base (298)..(298): a, c, t, g, unknown or other
  misc_feature (298)..(298): n is a, c, g, or t
  modified_base (313)..(313): a, c, t, g, unknown or other
  misc_feature (313)..(313): n is a, c, g, or t
  modified_base (371)..(371): a, c, t, g, unknown or other
  misc_feature (371)..(371): n is a, c, g, or t
  modified_base (379)..(379): a, c, t, g, unknown or other
  misc_feature (379)..(379): n is a, c, g, or t
  modified_base (387)..(387): a, c, t, g, unknown or other
  misc_feature (387)..(387): n is a, c, g, or t
  modified_base (396)..(396): a, c, t, g, unknown or other
  misc_feature (396)..(396): n is a, c, g, or t
  modified_base (423)..(423): a, c, t, g, unknown or other
  misc_feature (423)..(423): n is a, c, g, or t
  modified_base (469)..(469): a, c, t, g, unknown or other
  misc_feature (469)..(469): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttcctgctgcctattttaaaaggttccactgtgagctgcgactgggtggcgtcgtgggggagcttgggngcgaggccggggtggtcccctggcgactctcctgtgctaatttcngaacgccccttacaatacagtgngatgaagtcggtccncaggctacgaggggaggctgggagtggggtgctaataaataaaagagactgctaggtnagacaacngacctccngctgccttnagaggcagtactcacctatctacaganatagaatcacagacgctacttcttgtttacagactaaagtcgaacncgaccgtaggaacgacgacgacacgacgactagttagtaacttgttaacgtaactaagttacgaactacttacgtaccgtacccggg

SEQ ID NO: 318992 - DNA, 590 bp, Homo sapiens
  misc_feature: GZ8MTXP02HXN1M.3.67.G01.1.454.CMB.2.raw
  modified_base (191)..(191): a, c, t, g, unknown or other
  misc_feature (191)..(191): n is a, c, g, or t
  modified_base (337)..(337): a, c, t, g, unknown or other
  misc_feature (337)..(337): n is a, c, g, or t
  modified_base (356)..(356): a, c, t, g, unknown or other
  misc_feature (356)..(356): n is a, c, g, or t
  modified_base (367)..(367): a, c, t, g, unknown or other
  misc_feature (367)..(367): n is a, c, g, or t
  modified_base (377)..(377): a, c, t, g, unknown or other
  misc_feature (377)..(377): n is a, c, g, or t
  modified_base (459)..(459): a, c, t, g, unknown or other
  misc_feature (459)..(459): n is a, c, g, or t
tcagagacgcactccacgaccggtgctcgatttagagtatacatattgggtttggggagctctgggagaggagccccagccttggggattcccaagtgttttcattcagtgatcaggactgaacacagaggactcaccatggactttgggctgaggtggatttcttgctgccattttaaaggttcactgtnagctggcgactgggtggcgtctggggggagcttgggtggccaggccgggtgggtccctgcgactctcctgtgctaatttctgaacgccccttacaatacagtgtggtatgaattggggtccgccaggctcgagggaggggctgggngtgggtgcatataaaaagngactgctggtnagacaaacgngactacgctgctcgccttcagaggcagtattacaccatacttcagtaagacttagaatcaacagagcacttcgtcgtttacngtacaaagtcgaaacgcgtaaccgtagggaacgaccggacgggaaccacgaaacggtcctaacgtacggttaactttaagtttaggttaaaacctagtttaaacgggacctaacgtttaacgtaacccggg

SEQ ID NO: 318993 - DNA, 593 bp, Homo sapiens
  misc_feature: GZ8MTXP02FLA5W.3.67.G01.1.454.CMB.2.raw
  modified_base (269)..(269): a, c, t, g, unknown or other
  misc_feature (269)..(269): n is a, c, g, or t
  modified_base (291)..(291): a, c, t, g, unknown or other
  misc_feature (291)..(291): n is a, c, g, or t
  modified_base (309)..(309): a, c, t, g, unknown or other
  misc_feature (309)..(309): n is a, c, g, or t
  modified_base (364)..(364): a, c, t, g, unknown or other
  misc_feature (364)..(364): n is a, c, g, or t
  modified_base (367)..(367): a, c, t, g, unknown or other
  misc_feature (367)..(367): n is a, c, g, or t
  modified_base (372)..(372): a, c, t, g, unknown or other
  misc_feature (372)..(372): n is a, c, g, or t
  modified_base (389)..(389): a, c, t, g, unknown or other
  misc_feature (389)..(389): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctgaggtggatttcctgctgccaattttaaaaggttccactgtgagctgcgactggtggcgtcgtgggggagcttggtgcaggccgggtgggtccctgcgactctcctgtgctaatttcngaacgccccttacaatcagtgnggatggaattgggtcccncaggcctacgagggagggctggagtgggtgcctaataagaaaagtgactgctggnaanacaangcctagctgctagcctnagagcagtactacacctatcttacaagtaagatagaaactaccaacagacgacctacgttccgttagtttaccagaacaaaagtcgaaactacgcccgtaagggaaaacgaccggaccggtaacaaccgacggaccctaagttcgttaaatttaacgttacgtaaccgtaaagttacggaacctaaacggttacgtaaacccgg

SEQ ID NO: 318994 - DNA, 590 bp, Homo sapiens
  misc_feature: GZ8MTXP02I076I.3.67.G01.1.454.CMB.2.raw
  modified_base (272)..(272): a, c, t, g, unknown or other
  misc_feature (272)..(272): n is a, c, g, or t
  modified_base (416)..(416): a, c, t, g, unknown or other
  misc_feature (416)..(416): n is a, c, g, or t
  modified_base (442)..(442): a, c, t, g, unknown or other
  misc_feature (442)..(442): n is a, c, g, or t
  modified_base (528)..(528): a, c, t, g, unknown or other
  misc_feature (528)..(528): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttcctgctgcctattttaaaaggttccactgtgagctgcgactggtggcgtcgtgggggagcttggtgcaggccgggtgggtcccctggcgactctccgtgtgcaatttcngagccccttcaatacagtgtgatgagttcggccgcaggctaccgagggaagggctggaggtggggttgccaagtaataaaaagtagactgctggtagagaccaaagagctacgctgactgcccttagagagcagtactcacctntcttcgagacgatagaatacaacganaacgcaactttctagttttccaggtacctaaaagttacgaaacacgtacccgtaaggaaacggtaccgaaccgggacaaaccgtanacccgtagttagttattaacgttagtaaccttaagtaacggaactacgttaagttaacccgg

SEQ ID NO: 318995 - DNA, 561 bp, Homo sapiens
  misc_feature: GZ8MTXP02FZG0G.3.67.G01.1.454.CMB.2.raw
  modified_base (189)..(189): a, c, t, g, unknown or other
  misc_feature (189)..(189): n is a, c, g, or t
  modified_base (273)..(273): a, c, t, g, unknown or other
  misc_feature (273)..(273): n is a, c, g, or t
  modified_base (311)..(311): a, c, t, g, unknown or other
  misc_feature (311)..(311): n is a, c, g, or t
  modified_base (327)..(327): a, c, t, g, unknown or other
  misc_feature (327)..(327): n is a, c, g, or t
  modified_base (330)..(330): a, c, t, g, unknown or other
  misc_feature (330)..(330): n is a, c, g, or t
  modified_base (365)..(365): a, c, t, g, unknown or other
  misc_feature (365)..(365): n is a, c, g, or t
  modified_base (390)..(390): a, c, t, g, unknown or other
  misc_feature (390)..(390): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggacttggctgaggtgatttcctgctgcctatttaaagttccactgtganctgcgactgggtggcgtcgtggggggagcgttgggtgcgaggccggggtgggtcccctggcgactctccgtgtcgctaatttcngaacgcccccttacaatacagtgtagatgaattggccncagctcgagggaggcnggngtgggtgctaataataaaagtagactgcgtagganagacaagagctacgctgctgccttnagacgcagacttacacctatctacagagatagaatcacgagacgactacgttcgttagtttccagtaactaaattacgaaactagaccgtaaggaacgacggacgaactaacgacgaccgtatagttaattaacgtagtaactagttaacgaactacgttagtaacccggg

SEQ ID NO: 318996 - DNA, 563 bp, Homo sapiens
  misc_feature: GZ8MTXP02GTSNZ.3.67.G01.1.454.CMB.2.raw
  modified_base (309)..(309): a, c, t, g, unknown or other
  misc_feature (309)..(309): n is a, c, g, or t
  modified_base (329)..(329): a, c, t, g, unknown or other
  misc_feature (329)..(329): n is a, c, g, or t
  modified_base (354)..(354): a, c, t, g, unknown or other
  misc_feature (354)..(354): n is a, c, g, or t
  modified_base (468)..(468): a, c, t, g, unknown or other
  misc_feature (468)..(468): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttcctgctgccattttaaaaggttccactgtgagctgcgactggtggcgtcgtgggggagcttgggtgcaggccggggtgggtccctgcgactctcctgtgcaatttctgaacgccccttcaatacagtgtggatagaattgggtccnccgaggctccgagggagggntggagtgggtgcataataaaaaganactgctaggtgagacaacagacctacgctagctcgtacttcgagacggcagtatcaaccatacttcagagaatagaaatcaacaagcgactactcttagtttccagaactaaanacgaaacgtacgacgtaaggaacgacggacgaaacacgacgtacacgttagttaattaagttactaacgtaacgttaagactacgtacgtaccgg

SEQ ID NO: 318997 - DNA, 658 bp, Homo sapiens
  misc_feature: GZ8MTXP02HEEW9.3.67.G01.1.454.CMB.2.raw
  modified_base (235)..(235): a, c, t, g, unknown or other
  misc_feature (235)..(235): n is a, c, g, or t
  modified_base (290)..(290): a, c, t, g, unknown or other
  misc_feature (290)..(290): n is a, c, g, or t
  modified_base (309)..(309): a, c, t, g, unknown or other
  misc_feature (309)..(309): n is a, c, g, or t
  modified_base (420)..(420): a, c, t, g, unknown or other
  misc_feature (420)..(420): n is a, c, g, or t
  modified_base (517)..(517): a, c, t, g, unknown or other
  misc_feature (517)..(517): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttcctgctgcctaattttaaaaggttccactgtgagctgcgacgtgggtggcgtcggtgggggagtcgttgggngcgacgggtccggggtcgggtcccctggccgtactcctccttgtagtaatttcgngaccgtcccctacaatacngtgtgatgtagtcggtcccgcgaggcctacggaggggaacggggtcgtaggggtaggtcggggttcggaccgtaagttaaaagtaaaaaaggtagacgtgaccgtgggtanacgaaacaacgtagacctaggctgcttacgccgttacgaggacgcgaacgtactaccacacttacgtacaagagactaagactacgaaagacgaacnccgttaacttcggttactttacgacgtaaacttaaacgaacgtaacgacgtaccgaaagggaaccggaacgcggaaacacgaaacgctatacgtagtttaactgtaagttacgtacgtaactacgtacgtaccggtccggg

SEQ ID NO: 318998 - DNA, 634 bp, Homo sapiens
  misc_feature: GZ8MTXP02IM0L3.3.67.G01.1.454.CMB.2.raw
  modified_base (198)..(198): a, c, t, g, unknown or other
  misc_feature (198)..(198): n is a, c, g, or t
  modified_base (271)..(271): a, c, t, g, unknown or other
  misc_feature (271)..(271): n is a, c, g, or t
  modified_base (280)..(280): a, c, t, g, unknown or other
  misc_feature (280)..(280): n is a, c, g, or t
  modified_base (298)..(298): a, c, t, g, unknown or other
  misc_feature (298)..(298): n is a, c, g, or t
  modified_base (316)..(316): a, c, t, g, unknown or other
  misc_feature (316)..(316): n is a, c, g, or t
  modified_base (334)..(334): a, c, t, g, unknown or other
  misc_feature (334)..(334): n is a, c, g, or t
  modified_base (339)..(339): a, c, t, g, unknown or other
  misc_feature (339)..(339): n is a, c, g, or t
  modified_base (408)..(408): a, c, t, g, unknown or other
  misc_feature (408)..(408): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctgaggtggtattttcctgctgcctaattttaaaaggttccactgtganctgcgacgtggtggcgtgtgggggagtcttgggtgcgaggtccggggtgggtcccctggccgactctcgtgtnctaatttcngaactccccttacaatcngtgagatgagttcggccncaggcctcggagggaggntgggngttgggtgacaagtaaataaaagtagctgcgtgagaacgacaagagctcgctcgctcgtctagagacgnaagtactaccgactagttactacgaagataagtacgaaactccaaacgaggtactaccttacgtttcgttacgtttccgaagtaaacctaaagtacgaaccgtagtccgtaaagggaacgaccggtacggaaacaccgacgtaccgttaagtttacgtttaagtttaacgttaacgtaaacgtttaacggttaacgacctttaacggttaacggtttaaccccggg

SEQ ID NO: 318999 - DNA, 581 bp, Homo sapiens
  misc_feature: GZ8MTXP02GBNJH.3.67.G01.1.454.CMB.2.raw
  modified_base (274)..(274): a, c, t, g, unknown or other
  misc_feature (274)..(274): n is a, c, g, or t
  modified_base (311)..(311): a, c, t, g, unknown or other
  misc_feature (311)..(311): n is a, c, g, or t
  modified_base (330)..(330): a, c, t, g, unknown or other
  misc_feature (330)..(330): n is a, c, g, or t
  modified_base (350)..(350): a, c, t, g, unknown or other
  misc_feature (350)..(350): n is a, c, g, or t
  modified_base (360)..(360): a, c, t, g, unknown or other
  misc_feature (360)..(360): n is a, c, g, or t
  modified_base (369)..(369): a, c, t, g, unknown or other
  misc_feature (369)..(369): n is a, c, g, or t
  modified_base (375)..(375): a, c, t, g, unknown or other
  misc_feature (375)..(375): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttcctgctgccattttaaaaggtttccactgtgagctgcgactggtggcgtcgtggggggaggcttgggtgcaggccggggtgggtcccctgcgctctcctgtcgcaatttcngaacgccccttcaaatcagtgtggatgaatgggtccncgaggctccgaggggaggntggaggtgggtgctaataanaaaagagacngctggaganacaacngacacgctgctgcttacagagcagacttcaccatctcagagatgaatcaacagaacgtcaacttcgttacgttttccgagtacaaaatcggaaacctagtcccggtaagggaaaacggacggacgaacctacggaccgaccgtatttagtactttaaacgtttacgtaacttaagtttacggaaaccctagtttactaacccgggg

SEQ ID NO: 319000 - DNA, 619 bp, Homo sapiens
  misc_feature: GZ8MTXP02ISSG1.3.67.G01.1.454.CMB.2.raw
  modified_base (197)..(197): a, c, t, g, unknown or other
  misc_feature (197)..(197): n is a, c, g, or t
  modified_base (216)..(216): a, c, t, g, unknown or other
  misc_feature (216)..(216): n is a, c, g, or t
  modified_base (229)..(229): a, c, t, g, unknown or other
  misc_feature (229)..(229): n is a, c, g, or t
  modified_base (263)..(263): a, c, t, g, unknown or other
  misc_feature (263)..(263): n is a, c, g, or t
  modified_base (270)..(270): a, c, t, g, unknown or other
  misc_feature (270)..(270): n is a, c, g, or t
  modified_base (275)..(275): a, c, t, g, unknown or other
  misc_feature (275)..(275): n is a, c, g, or t
  modified_base (290)..(290): a, c, t, g, unknown or other
  misc_feature (290)..(290): n is a, c, g, or t
  modified_base (304)..(304): a, c, t, g, unknown or other
  misc_feature (304)..(304): n is a, c, g, or t
  modified_base (349)..(349): a, c, t, g, unknown or other
  misc_feature (349)..(349): n is a, c, g, or t
  modified_base (357)..(357): a, c, t, g, unknown or other
  misc_feature (357)..(357): n is a, c, g, or t
  modified_base (360)..(360): a, c, t, g, unknown or other
  misc_feature (360)..(360): n is a, c, g, or t
  modified_base (365)..(365): a, c, t, g, unknown or other
  misc_feature (365)..(365): n is a, c, g, or t
  modified_base (373)..(373): a, c, t, g, unknown or other
  misc_feature (373)..(373): n is a, c, g, or t
  modified_base (378)..(378): a, c, t, g, unknown or other
  misc_feature (378)..(378): n is a, c, g, or t
  modified_base (391)..(391): a, c, t, g, unknown or other
  misc_feature (391)..(391): n is a, c, g, or t
  modified_base (402)..(402): a, c, t, g, unknown or other
  misc_feature (402)..(402): n is a, c, g, or t
tcagagacgcactccacgaccggtgctcgatttagagtatacatattgggtttggggagctctgggagaggagccccagccttgggattcccaagtgttttcattcagtgatcaggactgaacacagaggactcaccatggactttgggctgaggtggatttttcctgctgcctattttaaaaggttccactgtganctgcgactgggtgcgtcgngggggagcttggngccagggccggggtggtccctgcactctcctgtnctattcngaacncccctcaatcagtgngatgacgttggccncaggcaccgaggggaggctggagtgggtgctaagtaaataaaganactgctgnganacaanagcacgtngctanccctagagacganagatcgaactntacttcgagtaagtacagaaactcaaacgtagaacgtacccttacttcgtttagttacccgtaggaaccttaaaaagtcgaaaaacccgtagtaccccggtaagggaaaacgaccgggaccggaaaccaacggtaaccggtaccctaaagtttacgttattaaagtttccgtaaacgtagtttaacccggaacttaaccgtttactaaaccccgggg

SEQ ID NO: 319001 - DNA, 619 bp, Homo sapiens
  misc_feature: GZ8MTXP01EOBLB.11.23.C01.1.454.CMB.2.raw
  modified_base (316)..(316): a, c, t, g, unknown or other
  misc_feature (316)..(316): n is a, c, g, or t
  modified_base (402)..(402): a, c, t, g, unknown or other
  misc_feature (402)..(402): n is a, c, g, or t
  modified_base (614)..(615): a, c, t, g, unknown or other
  misc_feature (614)..(615): n is a, c, g, or t
  modified_base (617)..(617): a, c, t, g, unknown or other
  misc_feature (617)..(617): n is a, c, g, or t
  modified_base (619)..(619): a, c, t, g, unknown or other
  misc_feature (619)..(619): n is a, c, g, or t
tcagcgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtactctacaagtgacagtcaacgaaaccgaagacgacgggtcgtagttattttgcgacgaagagaaaggaggtattatgctntgtagtggtgtctgtactttagttacgtcgttacggtttggacgtcggtcggggaccgaacgggaccacgtctaatccgtcctccncgacgcccctaccaaccggaacgggccctacgttcccgtcccttccccgtcgaccctacccgtccctacaacgcgccgtacccgtcggtacggggaccacggcggcccggtccgtcgggctcggccgtggtaccaacggtcccttacgttccgtatccctcgttcgcgttggaccgggcgggcgttcgggaccgaacggggccaacagtcgnngngn

SEQ ID NO: 319002 - DNA, 537 bp, Homo sapiens
  misc_feature: GZ8MTXP01AY9DA.11.23.C01.1.454.CMB.2.raw
  modified_base (286)..(286): a, c, t, g, unknown or other
  misc_feature (286)..(286): n is a, c, g, or t
  modified_base (534)..(537): a, c, t, g, unknown or other
  misc_feature (534)..(537): n is a, c, g, or t
tcagcgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaaacgaattcactgtatctccaaatggacagtctagaaaaccgaagacacgggctgtatttttgngccagagaagagggatattgctctgatggtgtctgctattacgtcttacggtttggacgtctcgggggccaaaggggaccacggtcaatcgtctcctcagcctcaccaagggcccatcgtccttcccctggccaccctcctccaagacgccacctcgtcgggggcacgacgccggccctggggctcgcctggtcaaggtcctactccgtatcctcttcgcttgacgcgggcttgggcaaggcgcatgnnnn

SEQ ID NO: 319003 - DNA, 547 bp, Homo sapiens
  misc_feature: GZ8MTXP01C17XR.11.23.C01.1.454.CMB.2.raw
  modified_base (267)..(267): a, c, t, g, unknown or other
  misc_feature (267)..(267): n is a, c, g, or t
  modified_base (351)..(351): a, c, t, g, unknown or other
  misc_feature (351)..(351): n is a, c, g, or t
  modified_base (428)..(428): a, c, t, g, unknown or other
  misc_feature (428)..(428): n is a, c, g, or t
  modified_base (480)..(480): a, c, t, g, unknown or other
  misc_feature (480)..(480): n is a, c, g, or t
  modified_base (527)..(527): a, c, t, g, unknown or other
  misc_feature (527)..(527): n is a, c, g, or t
  modified_base (537)..(537): a, c, t, g, unknown or other
  misc_feature (537)..(537): n is a, c, g, or t
  modified_base (543)..(547): a, c, t, g, unknown or other
  misc_feature (543)..(547): n is a, c, g, or t
tcagcgagagataccacgaccggtgctcgatttagtacacgtgattagggattggggcagggtgtacacctgtggttctcgggctgccctttggctttggagatggtttctcgatggggctggagtggcttgggcgctctagaaacaaggttgccagtcataccacagaatatgtcgcgactgtgaagggcagagtcaccatctcaagagatgattcaacgaattcactgtacctcaaatgacatactagaaacgagacacggcgtntattgtgcagagagaggatatgctctgatgtgtctgctatttacgcgttacggtttggacgtctcgggggacccgaagggaccnggtcatcgtctcctcacgccctcccaccgaagggcccactcggttcctccccctggccacccttcccgaccaaacgngccaccctcgtcgggggaccacaggggcccggccccgttggggctgtcccgnggttcgaaacggtctaccgttccctatcctctcgctgaggccgggcncggcacggcnaagtgnnnnn

SEQ ID NO: 319004 - DNA, 583 bp, Homo sapiens
  misc_feature: GZ8MTXP01A7XFG.11.23.C01.1.454.CMB.2.raw
  modified_base (286)..(286): a, c, t, g, unknown or other
  misc_feature (286)..(286): n is a, c, g, or t
  modified_base (306)..(306): a, c, t, g, unknown or other
  misc_feature (306)..(306): n is a, c, g, or t
  modified_base (315)..(315): a, c, t, g, unknown or other
  misc_feature (315)..(315): n is a, c, g, or t
  modified_base (540)..(540): a, c, t, g, unknown or other
  misc_feature (540)..(540): n is a, c, g, or t
  modified_base (545)..(545): a, c, t, g, unknown or other
  misc_feature (545)..(545): n is a, c, g, or t
  modified_base (575)..(575): a, c, t, g, unknown or other
  misc_feature (575)..(575): n is a, c, g, or t
  modified_base (579)..(583): a, c, t, g, unknown or other
  misc_feature (579)..(583): n is a, c, g, or t
tcagcgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtactctacaagtgacagtctaagaaaaccgagacgacgggctagtattttgngcagagaagaggatatgctntgagtggtntctgcttaagttacgtcgttacgggtttggacgttcggtcggggaccgaaagggaccgacggtcaacttcgtcctcctacacgtccctacccgaacgacgggccctagttccggttccccttcccccgtggcccctaccccttccctaccgaaagcgccaccgtcggtcgggggccacggacggcccggccgtgggctcgccgttggaccaggtacctcttccgntctcncgtcttgacgcgggcgttggacgaagggcntagnnnnn

SEQ ID NO: 319005 - DNA, 546 bp, Homo sapiens
  misc_feature: GZ8MTXP01BHRP7.11.23.C01.1.454.CMB.2.raw
  modified_base (283)..(283): a, c, t, g, unknown or other
  misc_feature (283)..(283): n is a, c, g, or t
  modified_base (304)..(304): a, c, t, g, unknown or other
  misc_feature (304)..(304): n is a, c, g, or t
  modified_base (540)..(546): a, c, t, g, unknown or other
  misc_feature (540)..(546): n is a, c, g, or t
tcagcgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctagaaaccgagacacgggcgtgtattttgngccagagaagaggatatgctntgatggtgtctgctattacgtcttacggtttggacgtcgtcggggccaagggaccacggtcaatcgtctcctcacgcctccaccgaacgggcccatccggtccttcccccgtggcccaccctccctccaagcgccacctcgtcgggggccacggacggccgggccctggggcctcgccgtggtacaaggtccttacgttccgtatcctcttcgcttgcgcgggcttggcaaggcgnnnnnnn

SEQ ID NO: 319006 - DNA, 546 bp, Homo sapiens
  misc_feature: GZ8MTXP01ARA13.11.23.C01.1.454.CMB.2.raw
  modified_base (283)..(283): a, c, t, g, unknown or other
  misc_feature (283)..(283): n is a, c, g, or t
  modified_base (327)..(327): a, c, t, g, unknown or other
  misc_feature (327)..(327): n is a, c, g, or t
  modified_base (505)..(505): a, c, t, g, unknown or other
  misc_feature (505)..(505): n is a, c, g, or t
  modified_base (543)..(546): a, c, t, g, unknown or other
  misc_feature (543)..(546): n is a, c, g, or t
tcagcgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctagaaaaccgagacacgggctgtattttgngccagagaagaggatattgctctgatggtgtctgctattacgtntacggttgacgtctggggccagggaccacggtcaatcgtctcctcagcctccacgaagggccccatccggtccttccccctcggccacccctccctcccaacgacgccacccgtcgtcgggggccacggacgccggccccgtggggcctcgcctggtccaacggtctaccgttccgtntctcttcgcttggagcgggcgttgggcaaggcgcatgnnnn

SEQ ID NO: 319007 - DNA, 531 bp, Homo sapiens
  misc_feature: GZ8MTXP01BUI1U.11.23.C01.1.454.CMB.2.raw
  modified_base (484)..(484): a, c, t, g, unknown or other
  misc_feature (484)..(484): n is a, c, g, or t
  modified_base (494)..(494): a, c, t, g, unknown or other
  misc_feature (494)..(494): n is a, c, g, or t
  modified_base (507)..(507): a, c, t, g, unknown or other
  misc_feature (507)..(507): n is a, c, g, or t
  modified_base (523)..(523): a, c, t, g, unknown or other
  misc_feature (523)..(523): n is a, c, g, or t
  modified_base (525)..(525): a, c, t, g, unknown or other
  misc_feature (525)..(525): n is a, c, g, or t
  modified_base (528)..(531): a, c, t, g, unknown or other
  misc_feature (528)..(531): n is a, c, g, or t
tcagcgagagataccacgaccggtgctcgatttagtacacgtgattagggattgggggcagggtgtacacctgtggttctcggggctgccctttggctttggagatggttttctcgatgggggctggagtggcttgggcgctctagaaacaggttgccagtcataccacagaatatgccgcgactgtgaagggcagagtcaccatctcaagagatgattcaacgaattcactgtatctcaaatggacagtctagaaaccgagacacggcgtgtattttgtgccagagaagagggatattgctctgatggtgtctgctattacgtctacggtttggacgtcgtcggggccaaggggaccacggtcaatcgtctcctcagccctccacaacgggcccatccggtccttccccctggccaccctccctccaagcgccacctcgtcgggggccacgacgccggccctggggcctgcctggtcaaggtntacttccgtntctcttcgcttgngcggcttggcaaggcncntgnnnn

SEQ ID NO: 319008 - DNA, 571 bp, Homo sapiens
  misc_feature: GZ8MTXP01CG49H.11.23.C01.1.454.CMB.2.raw
  modified_base (282)..(282): a, c, t, g, unknown or other
  misc_feature (282)..(282): n is a, c, g, or t
  modified_base (311)..(311): a, c, t, g, unknown or other
  misc_feature (311)..(311): n is a, c, g, or t
  modified_base (568)..(571): a, c, t, g, unknown or other
  misc_feature (568)..(571): n is a, c, g, or t
tcagcgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctcaaatggacagtctagaaaaccgagacacgggctgtattttgngcagagaagaggatattgctctgatggtntctgcttattacgtcttacggtttggacgtcgtcggggccaagggaccacggtcaatcgtctcctcacgccctaccaccaagggcccatccgtcctcccctggccaccctcctaccaacgacgccaccgtcgtcgggggccacggacggccggccccgtggggccttcggcccgtggtaccgaaacgggtaccttaaccgttcccggttaatccttcgttcgtcttggacggcgggcgttgggcaagggcgcatagnnnn

SEQ ID NO: 319009 - DNA, 511 bp, Homo sapiens
  misc_feature: GZ8MTXP01DX3JB.11.23.C01.1.454.CMB.2.raw
  modified_base (279)..(279): a, c, t, g, unknown or other
  misc_feature (279)..(279): n is a, c, g, or t
  modified_base (370)..(370): a, c, t, g, unknown or other
  misc_feature (370)..(370): n is a, c, g, or t
  modified_base (374)..(374): a, c, t, g, unknown or other
  misc_feature (374)..(374): n is a, c, g, or t
  modified_base (403)..(403): a, c, t, g, unknown or other
  misc_feature (403)..(403): n is a, c, g, or t
  modified_base (426)..(426): a, c, t, g, unknown or other
  misc_feature (426)..(426): n is a, c, g, or t
  modified_base (505)..(511): a, c, t, g, unknown or other
  misc_feature (505)..(511): n is a, c, g, or t
tcagcgagagataccacgaccggtgctcgatttagtacacgtgattagggattggggcagggtgtacacctgtggttctcgggctgccctttggctttggagatggttttctcgatggggctggagtggcttgggcgctctagaaacaaggttgccagtcataccacagaatatgccgcgactgtgaagggcagagtcaccatctcaagagatgattcaacgaattcactgtatctccaaatggacagtctagaaaaccgagacacggctgtattttgngccagagaagagggatattgctctgatggtgtctgctattacgtctacggtttggacgtctcggggccaaaggggccacggtcaatcgtcncctnagcctccacaagggcccatcgtctccccngcaccctctccaagagcacctcnggggcacgacgcggccctgggctgcccgtggtcaaggtctacttccgtatctcttcgcttgagcgggcttggcaaggcnnnnnnn

SEQ ID NO: 319010 - DNA, 605 bp, Homo sapiens
  misc_feature: GZ8MTXP01CKJ1I.11.23.C01.1.454.CMB.2.raw
  modified_base (282)..(282): a, c, t, g, unknown or other
  misc_feature (282)..(282): n is a, c, g, or t
  modified_base (313)..(313): a, c, t, g, unknown or other
  misc_feature (313)..(313): n is a, c, g, or t
  modified_base (322)..(322): a, c, t, g, unknown or other
  misc_feature (322)..(322): n is a, c, g, or t
  modified_base (449)..(449): a, c, t, g, unknown or other
  misc_feature (449)..(449): n is a, c, g, or t
  modified_base (583)..(583): a, c, t, g, unknown or other
  misc_feature (583)..(583): n is a, c, g, or t
  modified_base (600)..(605): a, c, t, g, unknown or other
  misc_feature (600)..(605): n is a, c, g, or t
tcagcgagagataccacgaccggtgctcgatttagtacacgtgattagggattgggggcagggtgtacacctgtggttctcggggctgccctttggctttggagattggttttctcgatgggggctggagtggcttgggcgctctagaaacaaggttgccagtcataccacagaatatgccgcgactgtgaagggcagagtcaccatctcaagagatgattcaaacgtaattcactgtaactctaacaaagtgactagtcaaacgaaaacgagacgacggtntagtatttgcgacagagaagaggatatgctntgagtggtntctgtactttagttacgtcgttagggttggacgtcggtaccggggaccgaaagggacccgtacggtctaacgttcgtcctcctcacgtcccctacaaccggacggccctagttccgtccctccccgngaccctaccccgtcctaccgaagccgcctaccgtcgggaggggaccacggggacgccccgggtccgtgggctccgccgttggaccaacggtaccttaccgttcgtctccttcgcgtcgttggacggcggttcgnggaccgaagggcctaannnnnn

SEQ ID NO: 319011 - DNA, 522 bp, Homo sapiens
  misc_feature: GZ8MTXP01CN53V.11.23.C01.1.454.CMB.2.raw
  modified_base (281)..(281): a, c, t, g, unknown or other
  misc_feature (281)..(281): n is a, c, g, or t
  modified_base (310)..(310): a, c, t, g, unknown or other
  misc_feature (310)..(310): n is a, c, g, or t
  modified_base (324)..(324): a, c, t, g, unknown or other
  misc_feature (324)..(324): n is a, c, g, or t
  modified_base (433)..(433): a, c, t, g, unknown or other
  misc_feature (433)..(433): n is a, c, g, or t
  modified_base (516)..(522): a, c, t, g, unknown or other
  misc_feature (516)..(522): n is a, c, g, or t
tcagcgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctaccaaatggacagtcagaaaccgagacacggctgtattttgngccagagaagaggatatgctctgatggtntctgctattacgtntacggtttgacgtcgtggggccaaggggccacggtcaattcgtctcctcacgccctcaccaagggcccatcggtctccccctggccaccctcctccaagcgcacctcgnggggccacgacgtccggcctgggctcgcctggtaccaaggtctacttccgtatctcttcgcttgaggcggcgttggcaaggcnnnnnnn

SEQ ID NO: 319012 - DNA, 530 bp, Homo sapiens
  misc_feature: GZ8MTXP01DYJ3G.11.23.C01.1.454.CMB.2.raw
  modified_base (525)..(525): a, c, t, g, unknown or other
  misc_feature (525)..(525): n is a, c, g, or t
  modified_base (527)..(530): a, c, t, g, unknown or other
  misc_feature (527)..(530): n is a, c, g, or t
tcagcgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaaacgattcactgtatctcaaatggacagtctagaaaccgagacacggctgtattttgtgccagagaagagggatatgctctgatggtgtctgcttattacgtcttacggtttggacgtcgtcggggccaagggccacggtcaatcgtctcctcacgcctccaccgaagggcccagtcgtcctccccgtggccacccgtcctccaagcgcacctcgtggggcacgacgccggccctgggctcgcctggtcaacggtctacgttcgtatctcttcgcttgacggcggcgttggcaaggcgctagngnnnn

SEQ ID NO: 319013 - DNA, 534 bp, Homo sapiens
  misc_feature: GZ8MTXP01BY81J.11.23.C01.1.454.CMB.2.raw
  modified_base (282)..(282): a, c, t, g, unknown or other
  misc_feature (282)..(282): n is a, c, g, or t
  modified_base (502)..(502): a, c, t, g, unknown or other
  misc_feature (502)..(502): n is a, c, g, or t
  modified_base (529)..(534): a, c, t, g, unknown or other
  misc_feature (529)..(534): n is a, c, g, or t
tcagcgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctcaaatggacagtctagaaaaccgagacacgggctgtattttgngcagagaagaggatatgctctgatggtgtctgctattacgtctacggtttggacgtcgtcggggccaagggcccacggtcaactcgtctcctcacgccctaccaccgaacgggcccatcggtccttccccgtggccaccctcctaccaacgacgccacctcgtgggggccacggacgcggccctgggcctgccctggtcaggtacttactccgtatctcncgcttgagcgggcttggcaaggcgaannnnnn

SEQ ID NO: 319014 - DNA, 522 bp, Homo sapiens
  misc_feature: GZ8MTXP01DSKT9.11.23.C01.1.454.CMB.2.raw
  modified_base (488)..(488): a, c, t, g, unknown or other
  misc_feature (488)..(488): n is a, c, g, or t
  modified_base (519)..(522): a, c, t, g, unknown or other
  misc_feature (519)..(522): n is a, c, g, or t
tcagcgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctagaaaaccgagacacgggctgtattttgtgccagagaagagggatattgctctgatggtgtctgctattacgtctacggttgacgtctggggccaagggccacggtcaatcgtctctcagcctccaccaagggcccatcggtcttccccctggccaccctcctccaagcgcacctcgtgggggccacgacgcggcccctgggcctgccctggtcaaggtctacttccgatctcncgcttgagcgggcttgggcaaggcgcatagnnnn

SEQ ID NO: 319015 - DNA, 535 bp, Homo sapiens
  misc_feature: GZ8MTXP01BWLOX.11.23.C01.1.454.CMB.2.raw
  modified_base (284)..(284): a, c, t, g, unknown or other
  misc_feature (284)..(284): n is a, c, g, or t
  modified_base (409)..(409): a, c, t, g, unknown or other
  misc_feature (409)..(409): n is a, c, g, or t
  modified_base (526)..(526): a, c, t, g, unknown or other
  misc_feature (526)..(526): n is a, c, g, or t
  modified_base (530)..(530): a, c, t, g, unknown or other
  misc_feature (530)..(530): n is a, c, g, or t
  modified_base (532)..(535): a, c, t, g, unknown or other
  misc_feature (532)..(535): n is a, c, g, or t
tcagcgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaaacgaattcactgtatctccaaatggacagtctagaaaaccgagacacgggctgtattttgngccagagaagagggatatgctctgatggtgtctgctattacgtctacggtttggacgtctcggggccaagggaccaggtcaatcgtctctcacgcctccacacggggcccatcggtccttccccnggccaccctcctccaagacgcacctcgtgggggccacgacgccggccctcggggctcgccgtggtccaaggtacctacgttccgtatctcttcgcttgagcggcgttggcaagggcncagngnnnn

SEQ ID NO: 319016 - DNA, 669 bp, Homo sapiens
  misc_feature: GZ8MTXP01DV1SQ.11.23.C01.1.454.CMB.2.raw
  modified_base (208)..(208): a, c, t, g, unknown or other
  misc_feature (208)..(208): n is a, c, g, or t
  modified_base (286)..(286): a, c, t, g, unknown or other
  misc_feature (286)..(286): n is a, c, g, or t
  modified_base (310)..(310): a, c, t, g, unknown or other
  misc_feature (310)..(310): n is a, c, g, or t
  modified_base (663)..(663): a, c, t, g, unknown or other
  misc_feature (663)..(663): n is a, c, g, or t
  modified_base (666)..(666): a, c, t, g, unknown or other
  misc_feature (666)..(666): n is a, c, g, or t
  modified_base (668)..(668): a, c, t, g, unknown or other
  misc_feature (668)..(668): n is a, c, g, or t
tcagcgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatcncaaagagatgaattcaaacgaattcactgtatctaccaaatggacagtctagaaaaccgagacacggctgtattttgngcaagagaaagaggatattgctcngtatggtgtctgtcttaagtttacgtcttacggtttggacgtcgtcgggggaccaaagggaccctacggtctaacgttccgttcctcccttccaacggtcccctacccgaacccggaaacgggcccctaagttcccggttccctttccccccgaggtccccaaccccgttccctaccaaaacgcgacccacccgtccggttcgggggaccacggttacggcccgggccccgttggggcctacgcccgttgggtaccaaacgggtccttaaccgtttcccgtaattcccttccttggtccgttggaacgggccgggggttccttggggacccgaaagggcccgtaacaagtagncgngng

SEQ ID NO: 319017 - DNA, 548 bp, Homo sapiens
  misc_feature: GZ8MTXP01A46BJ.11.23.C01.1.454.CMB.2.raw
  modified_base (284)..(284): a, c, t, g, unknown or other
  misc_feature (284)..(284): n is a, c, g, or t
  modified_base (418)..(418): a, c, t, g, unknown or other
  misc_feature (418)..(418): n is a, c, g, or t
  modified_base (543)..(543): a, c, t, g, unknown or other
  misc_feature (543)..(543): n is a, c, g, or t
  modified_base (545)..(548): a, c, t, g, unknown or other
  misc_feature (545)..(548): n is a, c, g, or t
tcagcgagagataccacgaccggtgctcgatttagtacacgtgattagggattgggggcagggtgtacacctgtggttctcggggctgccctttggctttggagatggttttctcgatggggggctggagtggcttgggcgctctagaaacaaggttgccagtcataccacagaatatgccgcgactgtgaagggcagagtcaccatctcaagagatgattcaacgaattcactgtatctccaaatggacagtctagaaaaccgagacacgggctgtattttgngccagagaagagggatattgctctgatggtgtctgctattacgtctacggtttgacgtcgtcggggccaagggccacggtcaatcgtctccgtcagccctccaccacggggccccagtccggtccttcccccgnggccacccctcctccaagacgccacctcgtcgggggccacggacgccgggccctgggctcggcctggtcaacggtactaccttccgtatctcttcgcttgacggcgggcgcggcaaggcgctagngnnnn

SEQ ID NO: 319018 - DNA, 549 bp, Homo sapiens
  misc_feature: GZ8MTXP01EQ7UC.11.23.C01.1.454.CMB.2.raw
  modified_base (474)..(474): a, c, t, g, unknown or other
  misc_feature (474)..(474): n is a, c, g, or t
  modified_base (540)..(540): a, c, t, g, unknown or other
  misc_feature (540)..(540): n is a, c, g, or t
  modified_base (543)..(543): a, c, t, g, unknown or other
  misc_feature (543)..(543): n is a, c, g, or t
  modified_base (546)..(549): a, c, t, g, unknown or other
  misc_feature (546)..(549): n is a, c, g, or t
tcagcgagagataccacgaccggtgctcgatttagtacacgtgattagggattgggggcagggtgtacacctgtggttctcggggctgccctttggctttggagatggttttctcgatgggggctggagtggcttgggcgctctagaaacaggttgccagtcataccacagaatatgccgcgactgtgaagggcagagtcaccatctacaagagatgattcaaacgaattcactgtatctaccaaatggacagtctagaaaaccgaagacacgggctgtattttgtgccagagaagaggatattgctctgatggtgtctgcttattacgtctacggtttggacgtcgtcggggccaagggaccacggtcaatcgtctcctcacgcctccaccgaaacgggcccagtccggtccttcccccgtggccaccctcctaccaacgacgcaccgtcgcgggggcacggagccggcccgngggctcgccgtggtaccaaggtctacgttccgatctcttcgcttgacgcggcgttcggcaagggcncanagnnnn

SEQ ID NO: 319019 - DNA, 516 bp, Homo sapiens
  misc_feature: GZ8MTXP01BRBS1.11.23.C01.1.454.CMB.2.raw
  modified_base (283)..(283): a, c, t, g, unknown or other
  misc_feature (283)..(283): n is a, c, g, or t
  modified_base (370)..(370): a, c, t, g, unknown or other
  misc_feature (370)..(370): n is a, c, g, or t
  modified_base (405)..(405): a, c, t, g, unknown or other
  misc_feature (405)..(405): n is a, c, g, or t
  modified_base (467)..(467): a, c, t, g, unknown or other
  misc_feature (467)..(467): n is a, c, g, or t
  modified_base (485)..(485): a, c, t, g, unknown or other
  misc_feature (485)..(485): n is a, c, g, or t
  modified_base (509)..(509): a, c, t, g, unknown or other
  misc_feature (509)..(509): n is a, c, g, or t
  modified_base (513)..(516): a, c, t, g, unknown or other
  misc_feature (513)..(516): n is a, c, g, or t
tcagcgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaaacgaattcactgtatctacaaatggacagtctagaaaaccgagacacggctgtattttgngccagagaagaggatatgctctgatggtgtctgctattacgtcttacggtttggacgtctggggccaaagggccaggtcaatcgtcnctcagcctacacgaagggcccatcgtccttccccnggccaccctcctcaagcgcaccgtgcggggcacgagcggccctgggctgcctggtacaggtntacttcgatctcttcgcngacgcgggcttgggcaaggcgaanatgnnnn

SEQ ID NO: 319020 - DNA, 548 bp, Homo sapiens
  misc_feature: GZ8MTXP01BQD7A.11.23.C01.1.454.CMB.2.raw
  modified_base (545)..(548): a, c, t, g, unknown or other
  misc_feature (545)..(548): n is a, c, g, or t
tcagcgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctcaaatggacagtctagaaacgaagacacggctgtattttgtgcagagaagaggatatgctctgatggtgtctgctattacgtcttacggtttggacgtcgtcggggccaagggaccacggtcaatcgtctcctcacgcctccaccgaagggcccatccggtcttccccctggccaccctcctccaagcgcacctcgtgggggccacggacggccgggcccgtggggcctcggcccgtgggtacaacggtcttaccgttccgtatcctcttcgcttggacggcgggcttgggcaagggcgcagtagnnnn

SEQ ID NO: 319021 - DNA, 553 bp, Homo sapiens
  misc_feature: GZ8MTXP01AVUUG.11.23.C01.1.454.CMB.2.raw
  modified_base (548)..(548): a, c, t, g, unknown or other
  misc_feature (548)..(548): n is a, c, g, or t
  modified_base (550)..(553): a, c, t, g, unknown or other
  misc_feature (550)..(553): n is a, c, g, or t
tcagcgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaaacgaattcactgtatctacaaatggacagtctagaaaaccgaagacacgggctgtattttgtgcagagaagaggatatgctctgatggtgtctgcttattacgtcttacggtttggacgtcgtcggggaccaaggggaccacggtcaactcgtctcctcacgcctcaccaagggcccatccggtcctccccgtgccaccctcctaccaagcgccaccctcgtcgggggccacggacgccgggcccgtcggggcctcggcccgtggtaccaaggtacctacttccgtatcctcttcgcttggagcgggcttcgggcaaggcgcagngnnnn

SEQ ID NO: 319022 - DNA, 576 bp, Homo sapiens
  misc_feature: GZ8MTXP01D13QP.11.23.C01.1.454.CMB.2.raw
  modified_base (172)..(172): a, c, t, g, unknown or other
  misc_feature (172)..(172): n is a, c, g, or t
  modified_base (286)..(286): a, c, t, g, unknown or other
  misc_feature (286)..(286): n is a, c, g, or t
  modified_base (306)..(306): a, c, t, g, unknown or other
  misc_feature (306)..(306): n is a, c, g, or t
  modified_base (570)..(570): a, c, t, g, unknown or other
  misc_feature (570)..(570): n is a, c, g, or t
  modified_base (572)..(574): a, c, t, g, unknown or other
  misc_feature (572)..(574): n is a, c, g, or t
  modified_base (576)..(576): a, c, t, g, unknown or other
  misc_feature (576)..(576): n is a, c, g, or t
tcagcgagagataccacgaccggtgctcgatttagtacacgtgattagggattgggggcagggtgtacacctgtggttctcggggctgccctttggctttggagattggttttctcgagtggggggctggagtggcttgggcgctctagaaacaggttgccagtcataccanagaatatgccgcgactgtgaagggcagagtcaccatctacaagagatgattcaaacgaattcactgtatctacaaatggacagtcagaaaacgagacgacggcgtgtattttgngcagagaagaggatatgctntgatggtgtctgactatttacgtcgttacggttgacgtgtacggggaccgaaaggccacggtcaaattccgtctcctcacgccctaccaccgaacgggcccctacgttccggtaccttaccccgtggccctacccctcctaccgaagcgccaccgtcgtacgggggccacgacggccgggccctgggcctcgccgtggaccaaggtccctacgttccgattctcttcggcttggacggcggacgttggacgaaggcgaactagngnnngn

SEQ ID NO: 319023 - DNA, 557 bp, Homo sapiens
  misc_feature: GZ8MTXP01E3EV6.11.23.C01.1.454.CMB.2.raw
  modified_base (278)..(278): a, c, t, g, unknown or other
  misc_feature (278)..(278): n is a, c, g, or t
  modified_base (309)..(309): a, c, t, g, unknown or other
  misc_feature (309)..(309): n is a, c, g, or t
  modified_base (324)..(324): a, c, t, g, unknown or other
  misc_feature (324)..(324): n is a, c, g, or t
  modified_base (395)..(395): a, c, t, g, unknown or other
  misc_feature (395)..(395): n is a, c, g, or t
  modified_base (555)..(557): a, c, t, g, unknown or other
  misc_feature (555)..(557): n is a, c, g, or t
tcagcgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaaagagatgattcaacgaattcactgtatctccaaaatggacagtctgaaaaccgagacacgggctgtnttatgcacgagaagaaggagtattatgtctnagtggtgtcgtcgtntatacgttacgttacgttacgggtacgtcgtcggcggacggacgaccgtcgaaactcgtcctcctcacccncctccaccaccgaccgaccgtccgtccgtcccgtcccgtccgccctaccctaccaccacgacgcgcgcgcgcggcgcgccgcgcgcgtcgtcgtacgacgtactactctctctcttcgtcgttcgcggcggcggcggacgaacggacgaacgacgacatnnn

SEQ ID NO: 319024 - DNA, 649 bp, Homo sapiens
  misc_feature: GZ8MTXP01CPPJC.11.23.C01.1.454.CMB.2.raw
  modified_base (284)..(284): a, c, t, g, unknown or other
  misc_feature (284)..(284): n is a, c, g, or t
  modified_base (295)..(295): a, c, t, g, unknown or other
  misc_feature (295)..(295): n is a, c, g, or t
  modified_base (306)..(306): a, c, t, g, unknown or other
  misc_feature (306)..(306): n is a, c, g, or t
  modified_base (646)..(646): a, c, t, g, unknown or other
  misc_feature (646)..(646): n is a, c, g, or t
  modified_base (648)..(648): a, c, t, g, unknown or other
  misc_feature (648)..(648): n is a, c, g, or t
tcagcgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaaacgaattcactgtatctaccaaatggacagtcagaaaaccgagacacgggctgtattttgngccagagaagnggtatatgctntgatggtgtctgtcttattacgtcgttacggttaggcgtcgtcggggaccagggacctacggtcaatccgtctccctcacgccctaccgaaccgaacgggcccctagttcccggtccccttcccccgtcggcccctacccctccgtacccaacgaccgccacccgtcggtcgggggacccacgggcggccccgggtcccgtcggggccctacggcccgttacgggtaaccaacgggttacccttaccgtttacccggttacttcccgttccgttccgtccgttagggaccgggtccggggttcgcgggacccgaagggggccctaacgagtcgggcgtgngng

SEQ ID NO: 319025 - DNA, 549 bp, Homo sapiens
  misc_feature: GZ8MTXP01A0IKL.11.23.C01.1.454.CMB.2.raw
  modified_base (281)..(281): a, c, t, g, unknown or other
  misc_feature (281)..(281): n is a, c, g, or t
  modified_base (309)..(309): a, c, t, g, unknown or other
  misc_feature (309)..(309): n is a, c, g, or t
  modified_base (374)..(374): a, c, t, g, unknown or other
  misc_feature (374)..(374): n is a, c, g, or t
  modified_base (415)..(415): a, c, t, g, unknown or other
  misc_feature (415)..(415): n is a, c, g, or t
  modified_base (543)..(543): a, c, t, g, unknown or other
  misc_feature (543)..(543): n is a, c, g, or t
  modified_base (546)..(549): a, c, t, g, unknown or other
  misc_feature (546)..(549): n is a, c, g, or t
tcagcgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctcaaatggacagtctagaaaaccgagacacgggctgtatttgngcagagaagaggatatgctctgatggtntctgcttattacgtcttacggtttggacgtcgtcggggccaaggggacccagggtcaactcgtcncctcacgcctccaccgaagggcccagtcgtccttcccccgnggccacccgtccctaccaacgacgccaccgtcgtcgggggcacggacggccggcccgtgggcctcgcccgtggtacaacggtctacgttccgtatctcttcgcttgcgcgggcttggcgaaggcgcanagnnnn

SEQ ID NO: 319026 - DNA, 612 bp, Homo sapiens
  misc_feature: GZ8MTXP02J21HJ.11.23.C01.1.454.CMB.2.raw
  modified_base (312)..(312): a, c, t, g, unknown or other
  misc_feature (312)..(312): n is a, c, g, or t
  modified_base (320)..(320): a, c, t, g, unknown or other
  misc_feature (320)..(320): n is a, c, g, or t
  modified_base (497)..(497): a, c, t, g, unknown or other
  misc_feature (497)..(497): n is a, c, g, or t
  modified_base (608)..(608): a, c, t, g, unknown or other
  misc_feature (608)..(608): n is a, c, g, or t
  modified_base (610)..(610): a, c, t, g, unknown or other
  misc_feature (610)..(610): n is a, c, g, or t
  modified_base (612)..(612): a, c, t, g, unknown or other
  misc_feature (612)..(612): n is a, c, g, or t
tcagcgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaaacgaattcactgtactcctacaaatggacagtctaacgaaaacccgagacgacggtcgtgttattttgcgccagagagaggatatgctntgatggtntctgcttattacgtctacggtttggacttcggtcggggaccaaggggacccacgggttcacttcgtcctcctcacgccctccaccgaagggccccagtccggtcccttcccccgtggccccacccttccctaccaagacgccctaccctcggtcgggggcacgcggcccggtcccgnggggcctcggcccgttggaccgaaacggggtaccttaccgttaccgtacttcctccttcggccgtggacggtccggggtctcggggacgaacggggcccgaacacgtagcncncn

SEQ ID NO: 319027 - DNA, 520 bp, Homo sapiens
  misc_feature: GZ8MTXP02FWB9V.11.23.C01.1.454.CMB.2.raw
  modified_base (517)..(520): a, c, t, g, unknown or other
  misc_feature (517)..(520): n is a, c, g, or t
tcagcgagagataccacgaccggtgctcgatttagtacacgtgattagggattggggcagggtgtacacctgtggttctcggggctgccctttggctttggagatggttttctcgatggggctggagtggcttgggcgctctagaaacaaggttgccagtcataccacagaatatgccgcgactgtgaagggcagagtcaccatctcaagagatgattcaacgaattcactgtatctccaaatggacagtctagaaaacccgaagacacgggcgtgtatttttgtgccagagaagagggatattgctctgatggtgtctgctattacgtctacggtttggacgtctggggccaaggggaccacggtcatcgtctcctcagccctccaccaagggcccatcggtccttccccctggccaccctcctccaagcgcacctctcgggggcacagcgccctgggctcgcctggtcaaggctactccgtatctctcgctgacgcgggctggcaaggcgcatgnnnn

SEQ ID NO: 319028 - DNA, 516 bp, Homo sapiens
  misc_feature: GZ8MTXP02HB1P0.11.23.C01.1.454.CMB.2.raw
  modified_base (282)..(282): a, c, t, g, unknown or other
  misc_feature (282)..(282): n is a, c, g, or t
  modified_base (514)..(516): a, c, t, g, unknown or other
  misc_feature (514)..(516): n is a, c, g, or t
tcagcgagagataccacgaccggtgctcgatttagtacacgtgattagggattggggcagggtgtacacctgtggttctcggggctgccctttggctttggagatggttttctcgatggggctggagtggcttgggcgctctagaaacaaggttgccagtcataccacagaatatgccgcgactgtgaagggcagagtcaccatctcaagagatgattcaacgaattcactgtatctccaaatggacagtctagaaaaccgaagacacggcgtgtattttgngccagagaagagggatattgctctgatggtgtctgctattacgtctacggtttggacgtctggggccaagggaccacggtcatcgtctcctcagcctccacagggcccatcggtcttccccctggcaccatccctcaagcgcacctcgtgggggcacgagccggccctgggctgcctggtcaaggctacgttccgtatcctctcgctgacgcgggctggcaaggcgcatagnnn

SEQ ID NO: 319029 - DNA, 520 bp, Homo sapiens
  misc_feature: GZ8MTXP02ISEBX.11.23.C01.1.454.CMB.2.raw
  modified_base (284)..(284): a, c, t, g, unknown or other
  misc_feature (284)..(284): n is a, c, g, or t
  modified_base (518)..(520): a, c, t, g, unknown or other
  misc_feature (518)..(520): n is a, c, g, or t
tcagcgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctgaaaaccgaagacacgggcgtgtattttgngccagagaagaggatattgctctgatggtgtctgctattacgtctacggtttggacgtctggggccaagggaccacggtcatcgtctcctcagccctccaccaagggcccatcggtccttccccctggccaccctcctcccaagagccacctctgggggcacgagccgccctgggctcgcctggtcaaggctacttccgtatctctcgctgacgcgggctggcaaggcgcatgnnn

SEQ ID NO: 319030 - DNA, 545 bp, Homo sapiens
  misc_feature: GZ8MTXP02JU3WL.11.23.C01.1.454.CMB.2.raw
  modified_base (284)..(284): a, c, t, g, unknown or other
  misc_feature (284)..(284): n is a, c, g, or t
  modified_base (539)..(539): a, c, t, g, unknown or other
  misc_feature (539)..(539): n is a, c, g, or t
  modified_base (543)..(545): a, c, t, g, unknown or other
  misc_feature (543)..(545): n is a, c, g, or t
tcagcgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctagaaaaccgaagacacggcgtgtattttgngccagagaagaggatattgctctgatggtgtctgctattacgtctacggtttggacgtctggggccaaggggccacgggtcattcgtctcctcacgcctccaccgaagggcccatccggtccttccccctggcccacccctcctcccaacgacgccacccgtcgtgggggcaacgcggccggccctggggcctcgccctggtcaacggtctacgttccgtatctctcgctggacgcgggctcggcaaggccgcanagcnnn

SEQ ID NO: 319031 - DNA, 514 bp, Homo sapiens
  misc_feature: GZ8MTXP02GIJGJ.11.23.C01.1.454.CMB.2.raw
  modified_base (284)..(284): a, c, t, g, unknown or other
  misc_feature (284)..(284): n is a, c, g, or t
  modified_base (511)..(514): a, c, t, g, unknown or other
  misc_feature (511)..(514): n is a, c, g, or t
tcagcgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctgaaaaccgaagacacgggcgtgtattttgngccagagaagagggatattgctctgatggtgtctgctattacgtctacggtttgacgtctggggccaaggggaccacggtcatcgtctcctcagcctccacaagggcccatcgtctcccctggcaccctcctccaagacgcacctctgggggcacgacgcggccctgggctcgcctggtcaaggctactccgtatctctcgctgacgcggctggcaaggcgcatagnnnn

SEQ ID NO: 319032 - DNA, 548 bp, Homo sapiens
  misc_feature: GZ8MTXP02JXRXS.11.23.C01.1.454.CMB.2.raw
  modified_base (284)..(284): a, c, t, g, unknown or other
  misc_feature (284)..(284): n is a, c, g, or t
  modified_base (545)..(548): a, c, t, g, unknown or other
  misc_feature (545)..(548): n is a, c, g, or t
tcagcgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctaccaaatggacagtctagaaaaccgagacacggcgtgtattttgngccagagaagaggatattgctctgatggtgtctgctattacgtctacggtttgacgtctggggccaagggaccacggtcatcgtctcctcacgcctccaccgaacgggcccagtccggtccttccccctggcccaccccgtcctcccaacgacgccaccgtcgtcgggggccacgacggccggcccgtcggggctcgccgtgggtaccaaaggctaccgttccgtattcctctcgctgacgcgggctggcaaggcgcatgnnnn

SEQ ID NO: 319033 - DNA, 526 bp, Homo sapiens
  misc_feature: GZ8MTXP02F2OKM.11.23.C01.1.454.CMB.2.raw
  modified_base (281)..(281): a, c, t, g, unknown or other
  misc_feature (281)..(281): n is a, c, g, or t
  modified_base (509)..(509): a, c, t, g, unknown or other
  misc_feature (509)..(509): n is a, c, g, or t
  modified_base (521)..(521): a, c, t, g, unknown or other
  misc_feature (521)..(521): n is a, c, g, or t
  modified_base (523)..(526): a, c, t, g, unknown or other
  misc_feature (523)..(526): n is a, c, g, or t
tcagcgagagataccacgaccggtgctcgatttagtacacgtgattagggattggggcagggtgtacacctgtggttctcggggctgccctttggctttggagatggttttctcgatggggctggagtggcttgggcgctctagaaacaaggttgccagtcataccacagaatatgccgcgactgtgaagggcagagtcaccatctcaagagatgattcaacgaattcactgtatctccaaatggacagtctgaaaaccgaagacacgggctgtattttgngccagagaagagggatattgctctgatggtgtctgctattacgtctacggtttggacgtctggggccaaggggaccacggtcatcgtctcctcagccctcacgacgggcccagtcgtccttcccctggccaccctccctccaacgacgccacctcgtcgggggcaccgacggccgcccgtgggctcgccctggtcaaggctacttccgatctctcgctgacgcggtcnggcaaggcgcangnnnn

SEQ ID NO: 319034 - DNA, 525 bp, Homo sapiens
  misc_feature: GZ8MTXP02FWQI9.11.23.C01.1.454.CMB.2.raw
  modified_base (283)..(283): a, c, t, g, unknown or other
  misc_feature (283)..(283): n is a, c, g, or t
  modified_base (402)..(402): a, c, t, g, unknown or other
  misc_feature (402)..(402): n is a, c, g, or t
  modified_base (503)..(503): a, c, t, g, unknown or other
  misc_feature (503)..(503): n is a, c, g, or t
  modified_base (522)..(525): a, c, t, g, unknown or other
  misc_feature (522)..(525): n is a, c, g, or t
tcagcgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctagaaaaccgagacacggcgtgtattttgngccagagaagaggatattgctctgatggtgtctgctattacgtctacggttgactctggggccaaggccacggtcatcgtctcctcagccctccaccaagggcccatcgtccttccccngcaccctcctccaagacgcacctcgtcgggggccaacgacgccggccctcgggctcgcctggtcaaaggctacttccgtatctctcgctgacgcgggccgnggacgaacggcacacgagnnnn

SEQ ID NO: 319035 - DNA, 509 bp, Homo sapiens
  misc_feature: GZ8MTXP02FZR0Q.11.23.C01.1.454.CMB.2.raw
  modified_base (506)..(509): a, c, t, g, unknown or other
  misc_feature (506)..(509): n is a, c, g, or t
tcagcgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctagaaaaccgaagacacgggcgtgtattttgtgccagagaagagggatattgctctgatggtgtctgctattacgtctacggtttggacgtctggggccaaggggaccacggtcatcgtctcctcagcctccacagggcccatcgtctccctgcaccctctccagcgcacctctggggcacacgcggccctggggctgcctggtcaaggctacttccgtatctctcgctgacgcggctggcaaggcgcatagnnnn

SEQ ID NO: 319036 - DNA, 535 bp, Homo sapiens
  misc_feature: GZ8MTXP02GATTU.11.23.C01.1.454.CMB.2.raw
  modified_base (532)..(535): a, c, t, g, unknown or other
  misc_feature (532)..(535): n is a, c, g, or t
tcagcgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctagaaaacccgaagacacgggcgtgtattttgtgccagagaagagggatattgctctgatggtgtctgctattacgtctacggtttggacgtctggggccaagggccacggtcatcgtctcctcagcctccacaagggcccatccggtccttccccctggccaccctcctccaacgacgccaccctcgtcgggggccacgacgccggcccgtggggcctcggccgtggtcaaggctacttccgtatctctcgctgacgcgggctggcaaggcgcatagnnnn

SEQ ID NO: 319037 - DNA, 555 bp, Homo sapiens
  misc_feature: GZ8MTXP02JVLBU.11.23.C01.1.454.CMB.2.raw
  modified_base (553)..(555): a, c, t, g, unknown or other
  misc_feature (553)..(555): n is a, c, g, or t
tcagcgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctaccaaatggacagtctagaaaaccgagacacgggcgtgtattttgtgccagagaagagggatattgctctgatggtgtctgctattacgtctacggtttggacgtcgtggggccaaggggccacggtcatcgtctcctcacgccctccaccgaacgggcccatccggtccttcccccgtggcccacccctcctcccaagacgccacctcgtcgggggccacgacggccggcccgtcgggctcgcctgggtccaaggtaccttaccgttccgtactcctcgtcgctgaggccggcgtcggcgaaggcgcatagcnnn

SEQ ID NO: 319038 - DNA, 528 bp, Homo sapiens
  misc_feature: GZ8MTXP02IMEAT.11.23.C01.1.454.CMB.2.raw
  modified_base (313)..(313): a, c, t, g, unknown or other
  misc_feature (313)..(313): n is a, c, g, or t
  modified_base (405)..(405): a, c, t, g, unknown or other
  misc_feature (405)..(405): n is a, c, g, or t
  modified_base (525)..(528): a, c, t, g, unknown or other
  misc_feature (525)..(528): n is a, c, g, or t
tcagcgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctaccaaatggacagtctagaaaaccgagacacggctgtattttgtgccagagaagaggatattgctctgatggtntctgctattacgtctacggtttgacgtctggggccaagggccacggtcattcgtctcctcagccctccacaagggcccatcgtccttccccnggccaccctcctcccaagacgccacctcgtcgggggccacgaggccggcccctggggcctgcccgtggtcaaggctacttccgtatctctcgctgacgcgggctcggcaaggcgcatagnnnn

SEQ ID NO: 319039 - DNA, 547 bp, Homo sapiens
  misc_feature: GZ8MTXP02IK424.11.23.C01.1.454.CMB.2.raw
  modified_base (283)..(283): a, c, t, g, unknown or other
  misc_feature (283)..(283): n is a, c, g, or t
  modified_base (541)..(541): a, c, t, g, unknown or other
  misc_feature (541)..(541): n is a, c, g, or t
  modified_base (544)..(547): a, c, t, g, unknown or other
  misc_feature (544)..(547): n is a, c, g, or t
tcagcgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctagaaaccgaagacacggcgtgtattttgngccagagaagaggatattgctctgatggtgtctgctattacgtctacggtttggacgtcgtggggccaagggccacggtcatcgtctcctcacgccctccaccgaaacgggcccagtccggtccttcccccgtcggcccacccctcctaccaacgacgccacctcgtcgggggccacgacgccggcccgtcggggctcgccgtggtcaaggacctacgttccgtactctctcgctgacgcggcgtggcaaggcgacanagnnnn

SEQ ID NO: 319040 - DNA, 548 bp, Homo sapiens
  misc_feature: GZ8MTXP02F14FH.11.23.C01.1.454.CMB.2.raw
  modified_base (285)..(285): a, c, t, g, unknown or other
  misc_feature (285)..(285): n is a, c, g, or t
  modified_base (314)..(314): a, c, t, g, unknown or other
  misc_feature (314)..(314): n is a, c, g, or t
  modified_base (345)..(345): a, c, t, g, unknown or other
  misc_feature (345)..(345): n is a, c, g, or t
  modified_base (544)..(548): a, c, t, g, unknown or other
  misc_feature (544)..(548): n is a, c, g, or t
tcagcgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaaacgaattcactgtatctaccaaatggacagtctagaaaaccgagacacggcgtgtattttgngcagagaagaggatattgctctgatggtntctgctattacgtctacggtttggacgtcgnggggccaagggaccacggtcatcgtctcctcagccctccacaagggcccatcggtccttcccccgtggccaccctccctccaacgacgccaccgtcgtcgggggccacgacggccggcccgtagggacctcgcccgtggtaccaaggaccttacgttccgtatcctctcgcgtgacgtcggctggacgaaggcgacagnnnnn

SEQ ID NO: 319041 - DNA, 551 bp, Homo sapiens
  misc_feature: GZ8MTXP02ITH9B.11.23.C01.1.454.CMB.2.raw
  modified_base (305)..(305): a, c, t, g, unknown or other
  misc_feature (305)..(305): n is a, c, g, or t
  modified_base (514)..(514): a, c, t, g, unknown or other
  misc_feature (514)..(514): n is a, c, g, or t
  modified_base (549)..(551): a, c, t, g, unknown or other
  misc_feature (549)..(551): n is a, c, g, or t
tcagcgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctagaaaaccgagacacggcgtgtattttgtgccagagaagagggatatgctntgatggtgtctgcttattacgtctacggtttggacgtcgtcggggccaaggggaccacgggtcacttcgtctcctcacgccctccaccgaacgggcccatccggtccttccccctggccacccctcctacccaagacgcacctcgtcgggggcacgacggccggcccctggggccctgcccgtggtcaaaggtctacgttccgattccnctcgctggacgcgggctggcgaaggcgacactgcnnn

SEQ ID NO: 319042 - DNA, 518 bp, Homo sapiens
  misc_feature: GZ8MTXP02I6702.11.23.C01.1.454.CMB.2.raw
  modified_base (287)..(287): a, c, t, g, unknown or other
  misc_feature (287)..(287): n is a, c, g, or t
  modified_base (474)..(474): a, c, t, g, unknown or other
  misc_feature (474)..(474): n is a, c, g, or t
  modified_base (509)..(509): a, c, t, g, unknown or other
  misc_feature (509)..(509): n is a, c, g, or t
  modified_base (515)..(518): a, c, t, g, unknown or other
  misc_feature (515)..(518): n is a, c, g, or t
tcagcgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctagaaaacccgaagacacggggctgtatttttgngccagagaagagggatattgctctgatggtgtctgctattacgtctacggtttgacgtctggggccaagggccacggtcatcgtctcctcagccctccacaagggcccatcggtctcccctggccaccctcctccaagcgccacctctcgggggcacacgcggcccctgggcctgcctggtcaaggntactccgtatctctcgctgcgcggctggcaaggcncatagnnnn

SEQ ID NO: 319043 - DNA, 538 bp, Homo sapiens
  misc_feature: GZ8MTXP02I19X5.11.23.C01.1.454.CMB.2.raw
  modified_base (280)..(280): a, c, t, g, unknown or other
  misc_feature (280)..(280): n is a, c, g, or t
  modified_base (536)..(538): a, c, t, g, unknown or other
  misc_feature (536)..(538): n is a, c, g, or t
tcagcgagagataccacgaccggtgctcgatttagtacacgtgattagggattgggggcagggtgtacacctgtggttctcggggctgccctttggctttggagatggttttctcgatggggctggagtggcttgggcgctctagaaacaaggttgccagtcataccacagaatatgccgcgactgtgaagggcagagtcaccatctcaagagatgattcaacgattcactgtatctcaaatggacagtctagaaaaccgaagacacggctgtattttgngccagagaagaggatatgctctgatggtgtctgctattacgtctacggtttgacgtctggggccaagggccacggtcatcgctcctcacgcctccaccgaagggcccatccggtccttcccccgtggcccaccctccctccaacgacgccacctcgtcgggggcaccgacggccggccctgggctcgcagtcggtacaaggtactacttccgtactctctcgctcgacgcgggctcggcgaacggcgacagtacgnnn

SEQ ID NO: 319044 - DNA, 533 bp, Homo sapiens
  misc_feature: GZ8MTXP02HV806.11.23.C01.1.454.CMB.2.raw
  modified_base (317)..(317): a, c, t, g, unknown or other
  misc_feature (317)..(317): n is a, c, g, or t
  modified_base (530)..(533): a, c, t, g, unknown or other
  misc_feature (530)..(533): n is a, c, g, or t
tcagcgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctagaaaaccgaagacacgggcgtgtatttttgtgccagagaagagggatattgctctgatggtntctgctattacgtctacggtttggacgtctggggccaagggccacggtcattcgtctcctcagccctccaccaagggccccatcggtccttccccctcggccacccctccctcccaacgacgccaccctctgggggccacgacgccggccctgggcctgcctggtcaggctactccgtatctctcgctgacgcgggctggcaaggcgcatagnnnn

SEQ ID NO: 319045 - DNA, 525 bp, Homo sapiens
  misc_feature: GZ8MTXP02IGUIY.11.23.C01.1.454.CMB.2.raw
  modified_base (327)..(327): a, c, t, g, unknown or other
  misc_feature (327)..(327): n is a, c, g, or t
  modified_base (427)..(427): a, c, t, g, unknown or other
  misc_feature (427)..(427): n is a, c, g, or t
  modified_base (491)..(491): a, c, t, g, unknown or other
  misc_feature (491)..(491): n is a, c, g, or t
  modified_base (494)..(494): a, c, t, g, unknown or other
  misc_feature (494)..(494): n is a, c, g, or t
  modified_base (517)..(517): a, c, t, g, unknown or other
  misc_feature (517)..(517): n is a, c, g, or t
  modified_base (521)..(525): a, c, t, g, unknown or other
  misc_feature (521)..(525): n is a, c, g, or t
tcagcgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaaacgaattcactgtatctccaaatggacagtctagaaaaccgagacacggcgtgtattttgtgccagagaagaggatattgctctgatggttctgctattacgtntacggtttgacgtcgtgggccccaagggaccaggtcatcgtctcctcagcctccaccacgggcccagtcgtcctcccccgtgccaccctccctcaagacnccacctcgtgggggacacgacgcggccctgggctcgcctggtcaaggctactcgtatctcgtcnctnaggcggcgtcggcaagggcgtanatgnnnnn

SEQ ID NO: 319046 - DNA, 658 bp, Homo sapiens
  misc_feature: GZ8MTXP02JUO5X.11.23.C01.1.454.CMB.2.raw
  modified_base (285)..(285): a, c, t, g, unknown or other
  misc_feature (285)..(285): n is a, c, g, or t
  modified_base (307)..(307): a, c, t, g, unknown or other
  misc_feature (307)..(307): n is a, c, g, or t
  modified_base (654)..(654): a, c, t, g, unknown or other
  misc_feature (654)..(654): n is a, c, g, or t
  modified_base (656)..(657): a, c, t, g, unknown or other
  misc_feature (656)..(657): n is a, c, g, or t
tcagcgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctaccaaatggacagtctagaaaaccgaagacacggcgtgtattttgngccagagaagaggatattgctntgatggtgtctgtctattacgtcttacggtttggacgtcgtcggggccaagggaccacggtcattccgtctcctcacgccctccgacccgaaacgggcccccacgttcccgggttccctttcccccccgtgggcccctacccccgttccctaccccgaaacgccgccctaccccgttccggtcggggggacccaccgaccgggcccgggcccccgttcgggggcccgttccggccccgtggggtacccgaaacgggtaccctttaacccgttcccgttacttcccgtccgttccggtcgttcgggacgggcccggggcgtcgggaccgaagggccggacacgtagcncnng

SEQ ID NO: 319047 - DNA, 559 bp, Homo sapiens
  misc_feature: GZ8MTXP02JBS0I.11.23.C01.1.454.CMB.2.raw
  modified_base (286)..(286): a, c, t, g, unknown or other
  misc_feature (286)..(286): n is a, c, g, or t
  modified_base (555)..(555): a, c, t, g, unknown or other
  misc_feature (555)..(555): n is a, c, g, or t
  modified_base (557)..(559): a, c, t, g, unknown or other
  misc_feature (557)..(559): n is a, c, g, or t
tcagcgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctagaaaaccgaagacacgggcgtgtatttttgngccagagaagagggatattgctctgatggtgtctgctatacgtctacggtttgacgtctggggccaagggccacggtcatcgtctcctcacgccctccacgtaagggccccatccggtccttcccccgtggcccaccccgtcctcccaagacgccacctcgtgggggccaacgcgccggccccgtggggcctcggcccgtgggtccaaggtaccttaaccgttccgtatcctcgtcgctggacgtcgggctggaccaaggccgacagtncnnn

SEQ ID NO: 319048 - DNA, 507 bp, Homo sapiens
  misc_feature: GZ8MTXP02I0JSH.11.23.C01.1.454.CMB.2.raw
  modified_base (281)..(281): a, c, t, g, unknown or other
  misc_feature (281)..(281): n is a, c, g, or t
  modified_base (409)..(409): a, c, t, g, unknown or other
  misc_feature (409)..(409): n is a, c, g, or t
  modified_base (504)..(507): a, c, t, g, unknown or other
  misc_feature (504)..(507): n is a, c, g, or t
tcagcgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgattcactgtatctccaatggacagtctagaaaccgaagacacggcgtgtattttgngccagagagaggatattgctctgatggtgtctgctattacgtctacggtttggacgtctggggccagggaccacggtcatcgtctcctcagccctccacagggcccatcgtctcccctggcaccctcnccagcgcacctcgtggggcacgacgccggccctggggcctgccgtggtcaaggctacttccgtatctctcgctgagcggctggcaaggcgcatgnnnn

SEQ ID NO: 319049 - DNA, 612 bp, Homo sapiens
  misc_feature: GZ8MTXP02HYSE9.11.23.C01.1.454.CMB.2.raw
  modified_base (213)..(213): a, c, t, g, unknown or other
  misc_feature (213)..(213): n is a, c, g, or t
  modified_base (281)..(281): a, c, t, g, unknown or other
  misc_feature (281)..(281): n is a, c, g, or t
  modified_base (431)..(431): a, c, t, g, unknown or other
  misc_feature (431)..(431): n is a, c, g, or t
  modified_base (609)..(609): a, c, t, g, unknown or other
  misc_feature (609)..(609): n is a, c, g, or t
  modified_base (611)..(612): a, c, t, g, unknown or other
  misc_feature (611)..(612): n is a, c, g, or t
tcagcgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagngatgattcaacgaattcactgtatctccaaatggacagtcagaaaaccgagacacggctgtattttgngcagagaagaggatatgctctgatggtgtctgcttattacgtctacggtttggacgttcgtcggggaccaacggggaccacggtcagttcgtcctccgtcacgcccctccgaccgaaacgggcccctagtcccggttcccttccccccgnggtccccaaccccgttccctacccgaaacgtacgccctaccgtccgtacgggggccaacgacggcccgggtccccgtggggccctcggcccgtgggtaccaaacgggtaccttaacgttccgtacttcctcgttcgccgttggacggccgggctcgggaccaagggccgacacgtgcncnn

SEQ ID NO: 319050 - DNA, 625 bp, Homo sapiens
  misc_feature: GZ8MTXP02I60TB.11.23.C01.1.454.CMB.2.raw
  modified_base (618)..(618): a, c, t, g, unknown or other
  misc_feature (618)..(618): n is a, c, g, or t
  modified_base (624)..(624): a, c, t, g, unknown or other
  misc_feature (624)..(624): n is a, c, g, or t
tcagcgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctagaaaaccgaagacacggcgtgtattttgtgccagagaagaggatattgctctgatggtgtctgctattacgtctacggtttgacgtctggggccaagggccacggtcatcgtctcctcagccctccaccaagggcccatccggtccttccccctggcccaccctcctccaacgacgccacctcgtcgggggccacgacggccggccccgtgggggcctcggcccgttgggtaccgtaaaacgggtacctttaaccgtttccccggttaacttcccgttccgttcccggtccgtttacgggaaccgggcccgggggtccgttcgggggacccgaaaacgggggtcccggaccgaacgttacggngcgcgng

SEQ ID NO: 319051 - DNA, 537 bp, Homo sapiens
  misc_feature: GZ8MTXP02IM8BT.11.23.C01.1.454.CMB.2.raw
  modified_base (285)..(285): a, c, t, g, unknown or other
  misc_feature (285)..(285): n is a, c, g, or t
  modified_base (534)..(537): a, c, t, g, unknown or other
  misc_feature (534)..(537): n is a, c, g, or t
tcagcgagagataccacgaccggtgctcgatttagtacacgtgattagggattggggcagggtgtacacctgtggttctcggggctgccctttggctttggagatggttttctcgatggggctggagtggcttgggcgctctagaaacaaggttgccagtcataccacagaatatgccgcgactgtgaagggcagagtcaccatctcaagagatgattcaacgaattcactgtatctaccaaatggacagtctagaaaaccgaagacacgggcgtgtatttttgngccagagaagaggatattgctctgatggtgtctgctattacgtctacggtttggacgtctggggccaaggggccacggtcatcgtctcctcacgcctccaccgaagggcccatccggtccttccccctggcccacccctcctcccaagacgccacctcgtcgggggcacgacggccgccccgtggggcctgccctggtcaaggctactccgtatcctctcgctgacgcgggctggcaaggcgacatagnnnn

SEQ ID NO: 319052 - DNA, 550 bp, Homo sapiens
  misc_feature: GZ8MTXP02HOY1A.11.23.C01.1.454.CMB.2.raw
  modified_base (283)..(283): a, c, t, g, unknown or other
  misc_feature (283)..(283): n is a, c, g, or t
  modified_base (547)..(550): a, c, t, g, unknown or other
  misc_feature (547)..(550): n is a, c, g, or t
tcagcgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctagaaaaccgagacacggcgtgtattttgngccagagaagagggatattgctctgatggtgtctgcttattacgttctacggtttggacgtcgtcggggccaaggggccacgggtcacttcgtctcctcacgccctccaccgaagggccccatccggtccttccccctcggccacccctcctacccaacgacgccaccgtcgtcgggggcacgacgccggcccgtgggcctcgccgtggtcaacggactacttccgtatctctcgctgacgcggcgtcggcaacggcgcatagnnnn

SEQ ID NO: 319053 - DNA, 523 bp, Homo sapiens
  misc_feature: GZ8MTXP02FZYM7.11.23.C01.1.454.CMB.2.raw
  modified_base (213)..(213): a, c, t, g, unknown or other
  misc_feature (213)..(213): n is a, c, g, or t
  modified_base (282)..(282): a, c, t, g, unknown or other
  misc_feature (282)..(282): n is a, c, g, or t
  modified_base (313)..(313): a, c, t, g, unknown or other
  misc_feature (313)..(313): n is a, c, g, or t
  modified_base (505)..(505): a, c, t, g, unknown or other
  misc_feature (505)..(505): n is a, c, g, or t
  modified_base (520)..(523): a, c, t, g, unknown or other
  misc_feature (520)..(523): n is a, c, g, or t
tcagcgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagngatgattcaacgaattcactgtatctccaaatggacagtctagaaaaccgagacacggctgtattttgngccagagaagagggatattgctctgatggtntctgctattacgtctacggtttgacgtctggggccaaggggaccacggtcatcgtctcctcagccctccacaagggcccatcgtctcccctgcaccctcctccaagacgcacctcgtgggggcacacggcggcccctggggctcgcctggtcgaacggactacttccgtatccgtctcgctgacgcgggtcnggcaaggcgcatagnnnn

SEQ ID NO: 319054 - DNA, 539 bp, Homo sapiens
  misc_feature: GZ8MTXP02GQHCJ.11.23.C01.1.454.CMB.2.raw
  modified_base (287)..(287): a, c, t, g, unknown or other
  misc_feature (287)..(287): n is a, c, g, or t
  modified_base (534)..(534): a, c, t, g, unknown or other
  misc_feature (534)..(534): n is a, c, g, or t
  modified_base (536)..(539): a, c, t, g, unknown or other
  misc_feature (536)..(539): n is a, c, g, or t
tcagcgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctagaaaacccgaagacacgggcgtgtatttttgngccagagaagagggatattgctctgatggtgtctgctattacgtctacggtttggacgtcgtggggccaaggggaccacggtcatcgtctcctcacgcctccaccaagggcccagtcgtccttccccctggccaccctccctccaagacgccacctcgtcgggggccacgacgccggcccgtggggcctcgcccgtggtcaaacggctacgtccgtatctctcgctgacgcggctggcaaggcgcangnnnn

SEQ ID NO: 319055 - DNA, 555 bp, Homo sapiens
  misc_feature: GZ8MTXP02INAUB.11.23.C01.1.454.CMB.2.raw
  modified_base (281)..(281): a, c, t, g, unknown or other
  misc_feature (281)..(281): n is a, c, g, or t
  modified_base (411)..(411): a, c, t, g, unknown or other
  misc_feature (411)..(411): n is a, c, g, or t
  modified_base (437)..(437): a, c, t, g, unknown or other
  misc_feature (437)..(437): n is a, c, g, or t
  modified_base (552)..(555): a, c, t, g, unknown or other
  misc_feature (552)..(555): n is a, c, g, or t
tcagcgagagataccacgaccggtgctcgatttagtacacgtgattagggattgggggcagggtgtacacctgtggttctcggggctgccctttggctttggagatggttttctcgatgggggctggagtggcttgggcgctctagaaacaggttgccagtcataccacagaatatgccgcgactgtgaagggcagagtcaccatctcaagagatgattcaacgaattcactgtatctccaaatggacagtctagaaaaccgagacacggctgtattttgngccagagagaggatattgctctgatggtgtctgctattacgtcttacggtttggacgtcgtcggggaccaagggaccacggtcatccgtctcctcagccctcccacgacgggcccatcgtccttcccccncggcctaccccgtcctacccaagacnccaccctcgtcgggggccacgacggccggccccgtgggcctcgccgtggtacaacgggtaccttacgttccgtacgtcctcgtccgcgtgacggcgggctggacaaggcacatgnnnn

SEQ ID NO: 319056 - DNA, 537 bp, Homo sapiens
  misc_feature: GZ8MTXP02I1B59.11.23.C01.1.454.CMB.2.raw
  modified_base (283)..(283): a, c, t, g, unknown or other
  misc_feature (283)..(283): n is a, c, g, or t
  modified_base (413)..(413): a, c, t, g, unknown or other
  misc_feature (413)..(413): n is a, c, g, or t
  modified_base (535)..(537): a, c, t, g, unknown or other
  misc_feature (535)..(537): n is a, c, g, or t
tcagcgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctagaaaaccgaagacacggctgtattttgngccagagaagaggatattgctctgatggtgtctgctattacgtctacggtttggacgtcgtcggggccaagggccacggtcattcgtctcctcacgcctccaccaagggcccatccggtccttcccccgnggccaccctcctcccaagacgccacccgtcgtcgggggcagtacgccggcccgtgggcctcgccgtggtcaaggcttactcgtatctcgtcgctgacgcggcgtggcgaaggcgcactagcnnn

SEQ ID NO: 319057 - DNA, 557 bp, Homo sapiens
  misc_feature: GZ8MTXP02ITGHF.11.23.C01.1.454.CMB.2.raw
  modified_base (284)..(284): a, c, t, g, unknown or other
  misc_feature (284)..(284): n is a, c, g, or t
  modified_base (315)..(315): a, c, t, g, unknown or other
  misc_feature (315)..(315): n is a, c, g, or t
  modified_base (551)..(551): a, c, t, g, unknown or other
  misc_feature (551)..(551): n is a, c, g, or t
  modified_base (554)..(557): a, c, t, g, unknown or other
  misc_feature (554)..(557): n is a, c, g, or t
tcagcgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctgaaaaccgaagacacgggctgtatttttgngccagagaagagggatattgctctgatggtntctgctattcgtctacggtttgacgtctggggccaagggccacggtcatcgtctcctcagccctccacgaagggcccatccggtccttcccccgtggcccaccctcctcccaacgacgccaccctcgtcgggggccaccgacggccggccccgtggggcctcgcccgtggtccaaagggtaccttaccgttccgtacttcctctcgcgtcggacggccgggctggcgaaggcgcanagnnnn

SEQ ID NO: 319058 - DNA, 653 bp, Homo sapiens
  misc_feature: GZ8MTXP02ILWOK.11.23.C01.1.454.CMB.2.raw
  modified_base (648)..(648): a, c, t, g, unknown or other
  misc_feature (648)..(648): n is a, c, g, or t
  modified_base (650)..(653): a, c, t, g, unknown or other
  misc_feature (650)..(653): n is a, c, g, or t
tcagcgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtactctacaatgacagtcacgaaaaccgaagacgacggtcgtgttattttgtcgccagaaggaaggagggtatagttgacttctgagtggtgtctgtacttagtttacgtcgttacgggtttggacgttcggtccggggaccgaagggaccacggtcagttccgtctccctacacgcccctacccgaacggaacgggcccctacgttccggttccccttcccccgtcggccctacccccgttccctacccgaaagaccgtccctacccgtccgggtacgggggcccaacggaccgggccccggtccccggtgggtcccgtcgcccggttggtaccgaaaggtacctttacccgttcgtaacttcctcgtcggtccgtggacggccgggtcgtcggacggaaggcccgacgtagngnnnn

SEQ ID NO: 319059 - DNA, 658 bp, Homo sapiens
  misc_feature: GZ8MTXP02GF0J3.11.23.C01.1.454.CMB.2.raw
  modified_base (237)..(237): a, c, t, g, unknown or other
  misc_feature (237)..(237): n is a, c, g, or t
  modified_base (310)..(310): a, c, t, g, unknown or other
  misc_feature (310)..(310): n is a, c, g, or t
  modified_base (424)..(424): a, c, t, g, unknown or other
  misc_feature (424)..(424): n is a, c, g, or t
tcagcgagagataccacgaccggtgctcgatttagtacacgtgattagggattgggggcagggtgtacacctgtggttctcggggctgccctttggctttggagatggttttctcgatgggggctgggaggctttgttggagaccttgcacttgtactccttgccattcagccagtcctggtgcaggacggtgaggacgctgaccacacggtacgtgctgttgtactgctcctccgnggcttggccagcctggacggtccctgagactctcttgtacagggtctggtttctctttcagtcgaccataacngtggacgtcgggtccgcgaggccgtacggagggggcgggctggggagtcgggcgttcggggctaccgtacgtaaagaaacgtagggttcgaccgtagtccaaactaacccgaanaagtaattacgcggacccgacgtacgtaggaggaacgggacgagacgtaccaactacgtctaacgaagtagtagtagtaacttaacgaaacgttacttactacgttagtacttactaactaaagtacggaactacgtaacgtaaacgaaaaccggaacggtaaccggtacgggttacgtttacgtttagttttacggaacgtacgaaggtaacggaaggtaggtacttacgtcg

SEQ ID NO: 319060 - DNA, 580 bp, Homo sapiens
  misc_feature: GZ8MTXP02I1TTQ.11.23.C01.1.454.CMB.2.raw
  modified_base (306)..(306): a, c, t, g, unknown or other
  misc_feature (306)..(306): n is a, c, g, or t
  modified_base (439)..(439): a, c, t, g, unknown or other
  misc_feature (439)..(439): n is a, c, g, or t
  modified_base (575)..(575): a, c, t, g, unknown or other
  misc_feature (575)..(575): n is a, c, g, or t
  modified_base (577)..(577): a, c, t, g, unknown or other
  misc_feature (577)..(577): n is a, c, g, or t
  modified_base (579)..(580): a, c, t, g, unknown or other
  misc_feature (579)..(580): n is a, c, g, or t
tcagcgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctagaaaaccgaagacacgggcgtgtattttgtgccagagaagaggatatgctntgatggtgtctgctattacgtctacggtttggacgtcgtcggggccaagggaccacggtcatcgtctcctcacgcctccaccgaagggcccatccggtccttcccccgtggccaccccgtcctcccaaacgcnccaccgtcgtcgggggccacgacggccggcccgtggggcctcggcccgttgggtaccgaaagggtacccttacgtttcccggtatccgttcgttccgctggacggccgggccgtcgggacaacgggcgacgtacgngncnn

SEQ ID NO: 319061 - DNA, 570 bp, Homo sapiens
  misc_feature: GZ8MTXP02G7CB6.11.23.C01.1.454.CMB.2.raw
  modified_base (283)..(283): a, c, t, g, unknown or other
  misc_feature (283)..(283): n is a, c, g, or t
  modified_base (315)..(315): a, c, t, g, unknown or other
  misc_feature (315)..(315): n is a, c, g, or t
  modified_base (328)..(328): a, c, t, g, unknown or other
  misc_feature (328)..(328): n is a, c, g, or t
  modified_base (364)..(364): a, c, t, g, unknown or other
  misc_feature (364)..(364): n is a, c, g, or t
  modified_base (396)..(396): a, c, t, g, unknown or other
  misc_feature (396)..(396): n is a, c, g, or t
tcagcgagagataccacgaccggtgctcgatttagtacacgtgattagggattgggggcagggtgtacacctgtggttctcggggctgccctttggctttggagatggttttctcgatgggggctgggagggctttgttggagaccttgcacttgtactccttgccattcagccagtcctggtgcaggacggtgaggacgctgaccacacggtacgtgctgttgtactgctcctcccgcggcttggtccagcctggacgggtccctgacgactctcttgtacngggttctggtttctctttcagtgaccataacntggactgggtccncaggctcgaggggagggctggagtggcgttggggcncctgtaagaaacaggttcaccagtcataccanagaatagcgccgcgacgtggtagaagggcagacgtacaccatctacgaagagatagattacaaacgtattacactgtactctaccaaagtcgaacacgtacgtaacgaaaaccgaacgacgacgggtcgtagttattttcgaacgtacgaagaaggaaggtaggtattacgtag

SEQ ID NO: 319062 - DNA, 556 bp, Homo sapiens
  misc_feature: GZ8MTXP02IWX2B.11.23.C01.1.454.CMB.2.raw
  modified_base (419)..(419): a, c, t, g, unknown or other
  misc_feature (419)..(419): n is a, c, g, or t
  modified_base (553)..(556): a, c, t, g, unknown or other
  misc_feature (553)..(556): n is a, c, g, or t
tcagcgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctaccaaatggacagtctagaaaaccgaagacacgggctgtatttttgtgccagagaagagggatattgctctgatggtgtctgctattacgtctacggtttggacgtcgtggggccaagggccacggtcattcgtctcctcacgccctcccacacgggcccagtccggtcccttcccccgnggcccacccctctccccgaagacgccaccgtcgtcgggggaccacgacggccggccccgtggggcctcgcccgtggtcaaacggcctacttccgtactctctcgctggacgcgggctcggcaaggcgacatagnnnn

SEQ ID NO: 319063 - DNA, 643 bp, Homo sapiens
  misc_feature: GZ8MTXP02IA2NG.11.23.C01.1.454.CMB.2.raw
  modified_base (286)..(286): a, c, t, g, unknown or other
  misc_feature (286)..(286): n is a, c, g, or t
  modified_base (301)..(301): a, c, t, g, unknown or other
  misc_feature (301)..(301): n is a, c, g, or t
  modified_base (306)..(306): a, c, t, g, unknown or other
  misc_feature (306)..(306): n is a, c, g, or t
  modified_base (641)..(643): a, c, t, g, unknown or other
  misc_feature (641)..(643): n is a, c, g, or t
tcagcgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctacaagagatgattcaaacgaattcactgtatctccaaatggacagtctagaaaaccgaagacacgggctgtattttgngcagagaagaggatntgctntgatggtgtctgctatttacgctacgggtttggacgttcgtcggggaccaaggggacccacgggtcattccgttctccctcacgccctcccgaacccgaacgggccccacgttccggtccctttccccccgtcggtcccacccccttccccttacccaaaggaccgccctacccgttcgttacgggggccaaccgacggttccccgggccccgttcgggggcctcggcccgttggtacccgaaacgggtacccttaccgtttcccgtaactttccgtccgtttccgccttgggacggtccgggggcttggggaccgaaacggggcacgagtagcnnn

SEQ ID NO: 319064 - DNA, 585 bp, Homo sapiens
  misc_feature: GZ8MTXP02FG02Y.11.23.C01.1.454.CMB.2.raw
  modified_base (286)..(286): a, c, t, g, unknown or other
  misc_feature (286)..(286): n is a, c, g, or t
  modified_base (315)..(315): a, c, t, g, unknown or other
  misc_feature (315)..(315): n is a, c, g, or t
  modified_base (559)..(559): a, c, t, g, unknown or other
  misc_feature (559)..(559): n is a, c, g, or t
  modified_base (582)..(582): a, c, t, g, unknown or other
  misc_feature (582)..(582): n is a, c, g, or t
  modified_base (584)..(585): a, c, t, g, unknown or other
  misc_feature (584)..(585): n is a, c, g, or t
tcagcgagagataccacgaccggtgctcgatttagtacacgtgattagggattgggggcagggtgtacacctgtggttctcggggctgccctttggctttggagattggttttctcgatgggggctggagtgacttgggcgctctagaaacaaggttgccagtcataccacagaatatgccgcgactgtgaagggcagagtcaccatctcaagagatgattcaacgaattcactgtatctaccaaatggacagtctagaaaaccgaagacacggcgtgtattttgngccagagaagaggatatgctctgatggtntctgctattacgtctaggttgacgtcgtcggggaccaagggaccacggtcatcgtctcctcagccctaccaaccgaaacgggccccagtcccgttcccttcccccgtggcccacccccgttccacccaaacgacgccacccgtcgtcgggggacacgacggccggccccgtggggctccggccgtcggtaccgaaggtacctaccgtttcccgtactcctctcgtccgtggacggtccgggacncgggacgaaggccgacagtacgncnn

SEQ ID NO: 319065 - DNA, 525 bp, Homo sapiens
  misc_feature: GZ8MTXP02GWESP.11.23.C01.1.454.CMB.2.raw
  modified_base (282)..(282): a, c, t, g, unknown or other
  misc_feature (282)..(282): n is a, c, g, or t
  modified_base (421)..(421): a, c, t, g, unknown or other
  misc_feature (421)..(421): n is a, c, g, or t
  modified_base (522)..(525): a, c, t, g, unknown or other
  misc_feature (522)..(525): n is a, c, g, or t
tcagcgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctcaaatggacagtctagaaaccgaagacacggcgtgtattttgngccagagaagagggatattgctctgatggtgtctgctattacgtctacggtttggacgtctggggccaagggaccacggtcatcgtctcctcagcctccaccaacgggcccatcggtccttccccctggccacccctcncccaagcgccacctcgtgggggcacgagccggccctggggctcgcctggtcaaggctacgttccgtatctctcgctgacgcggctggcaaggcgcagtagnnnn

SEQ ID NO: 319066 - DNA, 588 bp, Homo sapiens
  misc_feature: GZ8MTXP02GYMJM.11.23.C01.1.454.CMB.2.raw
  modified_base (283)..(283): a, c, t, g, unknown or other
  misc_feature (283)..(283): n is a, c, g, or t
  modified_base (304)..(304): a, c, t, g, unknown or other
  misc_feature (304)..(304): n is a, c, g, or t
  modified_base (311)..(311): a, c, t, g, unknown or other
  misc_feature (311)..(311): n is a, c, g, or t
  modified_base (585)..(585): a, c, t, g, unknown or other
  misc_feature (585)..(585): n is a, c, g, or t
  modified_base (587)..(587): a, c, t, g, unknown or other
  misc_feature (587)..(587): n is a, c, g, or t
tcagcgagagataccacgaccggtgctcgatttagtacacgtgattagggattgggggcagggtgtacacctgtggttctcggggctgccctttggctttggagatggttttctcgatgggggctggagtggcttgggcgctctagaaacaagattgccagtcataccacagaatatgccgcgactgtgaagggcagagtcaccatctcaagagatgattcaacgaattcactgtatctccaaatggacagtctagaaaaccgagacacggcgtgtattttgngccagagaagaggatatgctngatggtntctgctattacgtctaggtttggacgtcgtggggccaagggaccacggtcagtcgtcctcctcgacgccctcaccaacgggcccagtccggtccttcccccgtggcccaccccgtccctaccaacgacgccaccgtcgtcgggggccacgacggcccggcccgtgggccctcgcccgtcggtaccgaacgggtaccttacgttccccggtacttccgtctccgtcgttcggacggccggggtcgtcgggccgaacgggccgaccagtacggcgngng

SEQ ID NO: 319067 - DNA, 634 bp, Homo sapiens
  misc_feature: GZ8MTXP02G0Q28.11.23.C01.1.454.CMB.2.raw
  modified_base (283)..(283): a, c, t, g, unknown or other
  misc_feature (283)..(283): n is a, c, g, or t
  modified_base (316)..(316): a, c, t, g, unknown or other
  misc_feature (316)..(316): n is a, c, g, or t
  modified_base (632)..(634): a, c, t, g, unknown or other
  misc_feature (632)..(634): n is a, c, g, or t
tcagcgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctagaaaaccgagacacggcgtgtattttgngccagagaagagggatattgctctgatggtgtntgctattacgtcttacggtttggacgttcgtcggggaccaaggggacccaacgggttcaagttccgtccgtccctcgacggccccttcccaaccgaaacggggccccctaagttcccgggttaccctttccccccgtcgggccccaacccccgttccctaccccgaacgacgccctacccgtccgtcgggggccaccgacggccggtccccgtggggcctcgcccgtacggtaccgaaacggaccttaccgttcccgtattcctccgtcggcctggacggccgggggactcgggacgaaggccgtacgagtacgcnnn

SEQ ID NO: 319068 - DNA, 593 bp, Homo sapiens
  misc_feature: GZ8MTXP02H5XOH.11.23.C01.1.454.CMB.2.raw
  modified_base (285)..(285): a, c, t, g, unknown or other
  misc_feature (285)..(285): n is a, c, g, or t
  modified_base (416)..(416): a, c, t, g, unknown or other
  misc_feature (416)..(416): n is a, c, g, or t
  modified_base (590)..(590): a, c, t, g, unknown or other
  misc_feature (590)..(590): n is a, c, g, or t
  modified_base (592)..(593): a, c, t, g, unknown or other
  misc_feature (592)..(593): n is a, c, g, or t
tcagcgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctacaaatggacagtctagaaaaccgaagacacgggcgtgtattttgngccagagaagaggatattgctctgatggtgtctgctattacgtcttacggtttggacgtcgtcggggaccaaggggaccacggtcatcgtctcctcacgccctccacgaacgggcccatcgtccttccccngccaccctcctccaagcgccacccgtcgtcgggggaccacgacgccggccccgtcggggcctcggcccgtgggtccgaaacgggtcccttaaccgttcccgttaacttccttccgtccgtcgttacggacggccgggggccttcgggaccgaaacgggcggacctacgtacgcncnn

SEQ ID NO: 319069 - DNA, 546 bp, Homo sapiens
  misc_feature: GZ8MTXP02GRZ83.11.23.C01.1.454.CMB.2.raw
  modified_base (287)..(287): a, c, t, g, unknown or other
  misc_feature (287)..(287): n is a, c, g, or t
  modified_base (544)..(546): a, c, t, g, unknown or other
  misc_feature (544)..(546): n is a, c, g, or t
tcagcgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaaacgaattcactgtatctccaaatggacagtctagaaaaccgaagacacgggcgtgtatttttgngccagagaagagggatattgctctgatggtgtctgctattacgtctacggtttggacgtcgtggggccaaggggaccacggtcattcgtcgtcctcacgccctccacgacgggcccatcggtccttccccctggccaccactccctccaagacgccacctcgtcgggggcacgagccggcccgtgggcctgccgtggtacaacggtactacgttccgtactctctcgctcgacgcggctggccgaaggcgacatagnnn

SEQ ID NO: 319070 - DNA, 587 bp, Homo sapiens
  misc_feature: GZ8MTXP02HYB3C.11.23.C01.1.454.CMB.2.raw
  modified_base (384)..(384): a, c, t, g, unknown or other
  misc_feature (384)..(384): n is a, c, g, or t
  modified_base (585)..(587): a, c, t, g, unknown or other
  misc_feature (585)..(587): n is a, c, g, or t
tcagcgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaaagagatgattcaaacgaattcactgtatctaccaaatggacagtctagaaaaccgaagacacggcgtgtattttgtgccagagaagaggatatgctctgatggtgtctgctattacgtcgtacggtttggacgtcgtcggggccgaacgggaccacggtcagtcgtctcctcncgccctccaccgaacgggcccctagtccgtcccttcccccgtcggccctacccctccctacccaagacgacccaccgtcgtcgggggccacgacggcccggccccgtgggccctcggccgtcggttacgaacgggtaccttacgttccgttactccgtccgtcgcttggacggccggcgtcggcgaaggcgactacgagcnnn

SEQ ID NO: 319071 - DNA, 604 bp, Homo sapiens
  misc_feature: GZ8MTXP02FPNXI.11.23.C01.1.454.CMB.2.raw
  modified_base (140)..(140): a, c, t, g, unknown or other
  misc_feature (140)..(140): n is a, c, g, or t
  modified_base (280)..(280): a, c, t, g, unknown or other
  misc_feature (280)..(280): n is a, c, g, or t
  modified_base (312)..(312): a, c, t, g, unknown or other
  misc_feature (312)..(312): n is a, c, g, or t
  modified_base (600)..(600): a, c, t, g, unknown or other
  misc_feature (600)..(600): n is a, c, g, or t
  modified_base (603)..(604): a, c, t, g, unknown or other
  misc_feature (603)..(604): n is a, c, g, or t
tcagcgagagataccacgaccggtgctcgatttagtacacgtgattagggattgggggcagggtgtacacctgtggttctcggggctgccctttggctttggagatggttttctcgatgggggctggagtggcttgggcnctctagaaacaaggttgccagtcataccacagaatatgccgcgactgtgaagggcagagtcaccatctcaagagatgattcaaacgattcactgtatctaccaaatggacagtcagaaacgagacacggctgtattttgngcagagagaggatatgctctgagtggtgtctnctattacgtcttacggttggacgtcgtcggggccgaacgggactacggtctactcgtctcctcacgccctccaacgtaacgggccctagtcccggttacccttcccccgtggccctaccccgtccctacccgaaacgtcgacctaccgtcgtacgggggccaacgacggcccggtccccgtggggcctcggtccgttcgggtaacgaacgggtaccctacgtttcccgtaatcccgttcgtcgtcgtcggacggccgggtcgtcgggacgaaggtcccgactagtcgngcnn

SEQ ID NO: 319072 - DNA, 569 bp, Homo sapiens
  misc_feature: GZ8MTXP02GVUAC.11.23.C01.1.454.CMB.2.raw
  modified_base (283)..(283): a, c, t, g, unknown or other
  misc_feature (283)..(283): n is a, c, g, or t
  modified_base (566)..(568): a, c, t, g, unknown or other
  misc_feature (566)..(568): n is a, c, g, or t
tcagcgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctacaaatggacagtctagaaaaccgagacacggcgtgtattttgngccagagaagaggatatgctctgatggtgtctgcttattacgtcgttacggtttggacgtcgtcggggaccaagggacctacggtcattccgtctcctcacgtccctaccaccgaacgggccccagtcccggtcccttcccccgcggcccaccccgtcctacccaagacgccaccgtcgcggggcacgcggccgcccgtgggctcgccgtcggacaacggccttacgtccgtactcctcgtcgcgtcggacggtcgggctgggacaagggccacgactagcgnnng

SEQ ID NO: 319073 - DNA, 611 bp, Homo sapiens
  misc_feature: GZ8MTXP02G4U16.11.23.C01.1.454.CMB.2.raw
  modified_base (286)..(286): a, c, t, g, unknown or other
  misc_feature (286)..(286): n is a, c, g, or t
  modified_base (305)..(305): a, c, t, g, unknown or other
  misc_feature (305)..(305): n is a, c, g, or t
  modified_base (597)..(597): a, c, t, g, unknown or other
  misc_feature (597)..(597): n is a, c, g, or t
  modified_base (604)..(604): a, c, t, g, unknown or other
  misc_feature (604)..(604): n is a, c, g, or t
  modified_base (610)..(611): a, c, t, g, unknown or other
  misc_feature (610)..(611): n is a, c, g, or t
tcagcgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctacaagagatgattcaacgtaattcactgtatctaccaaatggacagtcagaaaacgaagacgacggcgtgtattttgngcagagagaggatatgctntgatggtgtctgctattacgtcgttacggtttggacgttcgtcggggaccgaacgggaccacggtcacttcgtcctcctcacgtccctaccaccgacggccctacgtccgtcccttacccccgtcggccctaccccgtccctacccgaacgaccgacctacccgtcggtcggggccaaccgacggccggtccccgtggggacctccggcgtcggtaccgaacggttaccttaccgttccgtacgtccttccgtacgtcgtacggcggcggccggtaggaccgaaggggcccngtaacgngcgcgnn

SEQ ID NO: 319074 - DNA, 582 bp, Homo sapiens
  misc_feature: GZ8MTXP02JU0UP.11.23.C01.1.454.CMB.2.raw
  modified_base (285)..(285): a, c, t, g, unknown or other
  misc_feature (285)..(285): n is a, c, g, or t
  modified_base (380)..(380): a, c, t, g, unknown or other
  misc_feature (380)..(380): n is a, c, g, or t
  modified_base (580)..(582): a, c, t, g, unknown or other
  misc_feature (580)..(582): n is a, c, g, or t
tcagcgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctagaaaaccgaagacacgggctgtatttttgngccagagaagagggatattgctctgatggtgtctgctattacgtctacggtttggacgtcgtcggggcctaaggggaccacggtcatcgtctccnctacgccctccaccgaagggccccatccggttccttcccccgtggcccacccctcctcccaagtacgccacctcgtgggggccaacgcgccggcccctcggggctcggccctgggtaccgaacgggtaccttaccgttccgtacttcctcgtccgcttcggacggccggggcttcggaccgaagggccgaccgagtagcnnn

SEQ ID NO: 319075 - DNA, 556 bp, Homo sapiens
  misc_feature: GZ8MTXP02GKHTB.11.23.C01.1.454.CMB.2.raw
  modified_base (240)..(240): a, c, t, g, unknown or other
  misc_feature (240)..(240): n is a, c, g, or t
  modified_base (280)..(280): a, c, t, g, unknown or other
  misc_feature (280)..(280): n is a, c, g, or t
  modified_base (324)..(324): a, c, t, g, unknown or other
  misc_feature (324)..(324): n is a, c, g, or t
  modified_base (359)..(359): a, c, t, g, unknown or other
  misc_feature (359)..(359): n is a, c, g, or t
  modified_base (391)..(391): a, c, t, g, unknown or other
  misc_feature (391)..(391): n is a, c, g, or t
  modified_base (397)..(397): a, c, t, g, unknown or other
  misc_feature (397)..(397): n is a, c, g, or t
  modified_base (404)..(404): a, c, t, g, unknown or other
  misc_feature (404)..(404): n is a, c, g, or t
  modified_base (408)..(408): a, c, t, g, unknown or other
  misc_feature (408)..(408): n is a, c, g, or t
  modified_base (427)..(427): a, c, t, g, unknown or other
  misc_feature (427)..(427): n is a, c, g, or t
  modified_base (458)..(458): a, c, t, g, unknown or other
  misc_feature (458)..(458): n is a, c, g, or t
tcagcgagagataccacgaccggtgctcgatttagtacacgtgattagggattgggggcagggtgtacacctgtggttctcggggctgccctttggctttggagatggttttctcgatgggggctgggagggctttgttggagaccttgcacttgtactccttgccattcagccagtcctggtgcaggacggtgaggacgctgaccacacggtacgtgctgttgtactgcctcctcccgnggcttggccagcctggacggtccctgagctctcttgtacngggtctggtttctctttcagtgaccataacatggactgggtccncaggctcgaggggagggctgggagtggctggggcnctcgtagaaacaggttcgaccagtcataccanagatancgccganctgngaaggcagtagcacatcanaagagtatagattacaacgtaattacacttntatctaccaaatggacacgtactacgaaaaccgaagaacgacgggtacgtattaacgtttttgaagtaccaaggacggaaagagggtaacttattcgg

SEQ ID NO: 319076 - DNA, 669 bp, Homo sapiens
  misc_feature: GZ8MTXP02GSWXP.11.23.C01.1.454.CMB.2.raw
  modified_base (325)..(325): a, c, t, g, unknown or other
  misc_feature (325)..(325): n is a, c, g, or t
  modified_base (665)..(665): a, c, t, g, unknown or other
  misc_feature (665)..(665): n is a, c, g, or t
  modified_base (667)..(668): a, c, t, g, unknown or other
  misc_feature (667)..(668): n is a, c, g, or t
tcagcgagagataccacgaccggtgctcgatttagtacacgtgattagggattgggggcagggtgtacacctgtggttctcggggctgccctttggctttggagattggttttctcgagtggggggctggagtggcttgggcgctctagaaacaggttgccagtcataccacagaatatgccgcgactgtgaagggcagagtcaccatctcaagagatgattacaacgtaattcacttgtatctacaaatggactagtctaagaaaaccgagacgacggcgttgttattttgcgaccagagaagaggtattatgctgtgatggtntctgtacttagtttacggttcgttaacggggttttggaccgttcggtaccgggggacccgaaggggacccgtacgggttactacgttccgtcccttcccgtacgaccggcccctacccaccggaaaccgggtccctacgttcccggttacccttcccccgtcggccctaccccgtccctaccgaacgacgacccgtaccgtcggtacgggggacctaccggacggcccggtcccgtcgggccgtcgtccgtacggtacgaacgtaccgttaccgttccgtactcccgtccgtacgtcggtacggcgggtccggtacgacgaccgaacggctacgacgagncnng

SEQ ID NO: 319077 - DNA, 534 bp, Homo sapiens
  misc_feature: GZ8MTXP02HLB96.11.23.C01.1.454.CMB.2.raw
  modified_base (286)..(286): a, c, t, g, unknown or other
  misc_feature (286)..(286): n is a, c, g, or t
  modified_base (526)..(526): a, c, t, g, unknown or other
  misc_feature (526)..(526): n is a, c, g, or t
  modified_base (531)..(534): a, c, t, g, unknown or other
  misc_feature (531)..(534): n is a, c, g, or t
tcagcgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaaacgaattcactgtatctaccaaatggacagtctagaaaaccgagacacgggcgtgtattttgngcagagaagaggatatgctctgatggtgtctgcttattcgtctacgggtttggacgtctcggggccaaggggacccaggtcattcgtctcctcacgccctccaaccgaagggccccagtccgtccttccccctggcccacccctccctacccaagacgccacctcgtgggggcacgagccggccctgggcctgcctgtcaaggctactcgtatctctcgctgcgcgggctcggcaaggcncatgnnnn

SEQ ID NO: 319078 - DNA, 641 bp, Homo sapiens
  misc_feature: GZ8MTXP02FM60M.11.23.C01.1.454.CMB.2.raw
  modified_base (242)..(242): a, c, t, g, unknown or other
  misc_feature (242)..(242): n is a, c, g, or t
  modified_base (320)..(320): a, c, t, g, unknown or other
  misc_feature (320)..(320): n is a, c, g, or t
  modified_base (333)..(333): a, c, t, g, unknown or other
  misc_feature (333)..(333): n is a, c, g, or t
tcagcgagagataccacgaccggtgctcgatttagtacacgtgattagggattgggggcagggtgtacacctgtggttctcggggctgccctttggctttggagatggttttctcgatgggggctgggagggctttgttggagaccttgcacttgtactccttgccattcagccagtcctggtgcaggacggtgaggacgctgaccacgacggtacgtgctgttgtactgcctccgtcccgnggtcttggtccagccgtgggacggtccctgacgactctcttgtacgagggtctggtttctctttcagtgaccataacntggactgggtccncaggctccggaggggagggctgggagtggcgttggggctcctagtaagaaacgtagggttcgaccctaggtccaacgtaacccgaagaagtaatacgtcggacccgacgtacgtggtaggaagggcgaagacgtccacactctacgaagagatagtaactacaaacgtaattacgactagtactactaacaaagtacggaactaacgtacgtaaacggaaaaccgaacggaaacggtacgggtacgttacgtttagtttttacggaacgtaccgtaaaggaacggaaggtaaggtacgttaagtttcg

SEQ ID NO: 319079 - DNA, 675 bp, Homo sapiens
  misc_feature: GZ8MTXP02IY0NG.11.23.C01.1.454.CMB.2.raw
  modified_base (285)..(285): a, c, t, g, unknown or other
  misc_feature (285)..(285): n is a, c, g, or t
tcagcgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaaacgtaattcactgtatctaccaaatggacagtcagaaaaccgagacacggctgttattttgngcagagaaggaggtatagttgctctagagtggtgtcgtgtacttattacgttcgttacgggtttggacgtcgtcggggaccaagggaccaggtcagtcgtctcctcacgtccctaccacgaacgggccctacgtccggtcccttcccccgtcggaccctaccccgtccctacccgaaagccgacccgtaccgtcggtacgggggacctaaccgaccggccgggtcccccgtgggggtccctcggacccgtacgggttaccgaaacgggttacccttaaccgttcccgttacttcccgtccgttccggaccgttacgggaaccgggtccgggggccgttacggggaaccgtaaacgggggtaccccggtacgtaaacgtaggcgcgacgcg

SEQ ID NO: 319080 - DNA, 560 bp, Homo sapiens
  misc_feature: GZ8MTXP02GVJEZ.11.23.C01.1.454.CMB.2.raw
  modified_base (554)..(554): a, c, t, g, unknown or other
  misc_feature (554)..(554): n is a, c, g, or t
  modified_base (558)..(560): a, c, t, g, unknown or other
  misc_feature (558)..(560): n is a, c, g, or t
tcagcgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctcaaatggacagtctagaaaccgagacacggcgtgtattttgtgccagagaagaggatattgctctgatggtgtctgctattacgtcgtacggtttggacgtcgtcggggccaagggaccacgggtcatcgtcctcctcacgccctccaccgaacggggcccacgtccgtccttcccccgtcggccaccccgtcctcccaagacgcacccgtcgtgggggcacacggcggcccgtggggcctcgccgtggtccgaacggtacctacgttccgtatcccgttctcgctaggcgtcgggccgtggcgaacggccgcanagcnnn

SEQ ID NO: 319081 - DNA, 676 bp, Homo sapiens
  misc_feature: GZ8MTXP02GPSE8.11.23.C01.1.454.CMB.2.raw
  modified_base (287)..(287): a, c, t, g, unknown or other
  misc_feature (287)..(287): n is a, c, g, or t
  modified_base (320)..(320): a, c, t, g, unknown or other
  misc_feature (320)..(320): n is a, c, g, or t
  modified_base (446)..(446): a, c, t, g, unknown or other
  misc_feature (446)..(446): n is a, c, g, or t
  modified_base (672)..(675): a, c, t, g, unknown or other
  misc_feature (672)..(675): n is a, c, g, or t
tcagcgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctacaagagatgattcaacgtaattcactgtatctaccaaatggacagtctagaaaaccgagacacggcgttgtattttgngaccagaagaagaggatagttgctctgatggtntctgtctattacgtcgttaacggtttggacgttcgtcggggaccaagggaccacggtcacgttcgtcctcctcacgtccctacccaacgaaacgggccctaagttcccggttccctttccccccgnggtaccccacccccgttcccacccgaaacggtaccgcctaccccgtcggtacgggggacccaaacggcggtccccgggtcccccgttggggtacccgtcggtacccgttagggttacccgtaaaacgggtacctttaaacccgtttcccggttaacttcccgttaccgtccggtcgttacgggacggtccgggggtcctagggaccaacggggtccgactagtcgnnnng

SEQ ID NO: 319082 - DNA, 564 bp, Homo sapiens
  misc_feature: GZ8MTXP02HJRV4.11.23.C01.1.454.CMB.2.raw
  modified_base (283)..(283): a, c, t, g, unknown or other
  misc_feature (283)..(283): n is a, c, g, or t
  modified_base (561)..(561): a, c, t, g, unknown or other
  misc_feature (561)..(561): n is a, c, g, or t
  modified_base (563)..(564): a, c, t, g, unknown or other
  misc_feature (563)..(564): n is a, c, g, or t
tcagcgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctaccaaatggacagtctagaaaaccgagacacggctgtattttgngccagagaagagggatagttgctctgatggtgtctgcttattacgtctacggtttggacgtcgtaggggccaaagggaccacggtcattcgtcctcctcacgccctccaccacgggcccagtccgtcccttccccctggccaccgatccctaccaagacgccaccgtcgtcgggggacacgacggccgcccgtgggcctcggcctggtacaaacggctacgttccgtactcgtccgtcgcgtacgacgtccggctcggaacgaacgggcacagtacgngnn

SEQ ID NO: 319083 - DNA, 637 bp, Homo sapiens
  misc_feature: GZ8MTXP02GACKW.11.23.C01.1.454.CMB.2.raw
  modified_base (289)..(289): a, c, t, g, unknown or other
  misc_feature (289)..(289): n is a, c, g, or t
  modified_base (312)..(312): a, c, t, g, unknown or other
  misc_feature (312)..(312): n is a, c, g, or t
  modified_base (319)..(319): a, c, t, g, unknown or other
  misc_feature (319)..(319): n is a, c, g, or t
  modified_base (627)..(627): a, c, t, g, unknown or other
  misc_feature (627)..(627): n is a, c, g, or t
  modified_base (634)..(634): a, c, t, g, unknown or other
  misc_feature (634)..(634): n is a, c, g, or t
  modified_base (636)..(637): a, c, t, g, unknown or other
  misc_feature (636)..(637): n is a, c, g, or t
tcagcgagagataccacgaccggtgctcgatttagtacacgtgattagggattgggggcagggtgtacacctgtggttctcggggctgccctttggctttggagatggttttctcgagtgggggctggagtggcttgggcgctctagaaacaaggttgccagtcataccacagaatatgccgcgactgtgaatggcagagtcaccatctacaagagatgattacaaacgtaattcactgtatctacaaatggacagtcagaaaaccgagaacgacgggctgttatttgngaccaggagaagaggatatgctngatggtntctgtctattacgttgtacggtttggaccgttcggtcggggaccgtaaaggggaccctacggtcaacgtccgtcctccgtcgacgcccctaccgaaaccgtacgggccctagtcccggtcccttcccccgtggcccctacccccgtcctacccgaaacgtccacccgtaccgtccgggtacgggggacctacggacggccccggtccgggtcggccctcgggcccttagggtaccgaacggtacctaccgtttccgtacttcccgtccgtccgcgttaggaccggcggggtctacggaacgacgggcncgaagtncnn

SEQ ID NO: 319084 - DNA, 695 bp, Homo sapiens
  misc_feature: GZ8MTXP02II5HD.11.23.C01.1.454.CMB.2.raw
  modified_base (268)..(268): a, c, t, g, unknown or other
  misc_feature (268)..(268): n is a, c, g, or t
  modified_base (276)..(276): a, c, t, g, unknown or other
  misc_feature (276)..(276): n is a, c, g, or t
  modified_base (279)..(279): a, c, t, g, unknown or other
  misc_feature (279)..(279): n is a, c, g, or t
  modified_base (287)..(287): a, c, t, g, unknown or other
  misc_feature (287)..(287): n is a, c, g, or t
  modified_base (307)..(307): a, c, t, g, unknown or other
  misc_feature (307)..(307): n is a, c, g, or t
  modified_base (315)..(315): a, c, t, g, unknown or other
  misc_feature (315)..(315): n is a, c, g, or t
  modified_base (319)..(319): a, c, t, g, unknown or other
  misc_feature (319)..(319): n is a, c, g, or t
tcagcgagagataccacgaccggtgctcgatttagtacacgtgattagggattgggggcagggtgtacacctgtggttctcggggctgccctttggctttggagatggtttttctcgatgggggctggagtggcttgggcgctctagaaacaaggttgccagtcataccacagaatatgccgcgactgtagaagggcagagtcaccatctacaagagatgtattcaaacgaattcactgtatctaccaatggacagtacagaaacganacgacggngtnttatttgngcagagaagaggatatgctngagtggtntgtntacttattacgtcgttaggttggacgtcggtcgggaccgaacggaccgacgtactacgttccgtctcctacaccgtccctacccgaacgaaccggccctacgtccgtcccttccccgtcgcccaccccgttcctacccgtacgaccgacccgtacccgtaccgggtaccggggaccctaaccggaccggtccccggtccccggttaggggtccccgttaccggtacccggttaccgggtttaaccgaaacggttacccttaaccccgtttacggttacccttaccgttccgtcgtaccgttacggaaccgggcccggggtaaacggttcggaacccggtaacggacccggaccgtaaggtacggactacgtacgcg

SEQ ID NO: 319085 - DNA, 545 bp, Homo sapiens
  misc_feature: GZ8MTXP01D8FUL.44.55.E11.1.454.CMB.2.raw
  modified_base (347)..(347): a, c, t, g, unknown or other
  misc_feature (347)..(347): n is a, c, g, or t
  modified_base (354)..(354): a, c, t, g, unknown or other
  misc_feature (354)..(354): n is a, c, g, or t
  modified_base (425)..(425): a, c, t, g, unknown or other
  misc_feature (425)..(425): n is a, c, g, or t
tcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctggggggtcccagagactctcctgtgcagcctctgggctcaccgtcagcagcaactacatgagttgggtcccgccagggctccgaggggaagggggctgggagtgggtctcgagtcatttanactggtnatttcacataactacgcagactccgtgaacgggccattcacatctcaggacaattccaggaacacggttancttacaaatgaacaactgaagaggcgacgacacggcctctattactgtgcgagaccaaagttcggcgtcgttcgggagttggttaattattcgtttgactttcgtcggggcctaacgggg

SEQ ID NO: 319086 - DNA, 580 bp, Homo sapiens
  misc_feature: GZ8MTXP01ED0OR.44.55.E11.1.454.CMB.2.raw
  modified_base (351)..(351): a, c, t, g, unknown or other
  misc_feature (351)..(351): n is a, c, g, or t
  modified_base (493)..(493): a, c, t, g, unknown or other
  misc_feature (493)..(493): n is a, c, g, or t
  modified_base (527)..(527): a, c, t, g, unknown or other
  misc_feature (527)..(527): n is a, c, g, or t
tcagacagtatatacacgaccggtgctcgatttagcactcgcacgttgggtttggggagaggagcccagcactgggattccgaggtgtttccattcggtgatcagcactgaacacagaggaatcaccatggagttttggctgagctgggttctccttgttggacttttaaaaggtgtccagtgtgaggtgcggctgatggagtctggaggaggcttagtccagccgtggggggtcccagagactctcctgtgcagccctctgggctcaccgtcagcagcaactacatgagttgggtccgccaggctccgaggggaagggctgggagtgggtctcagtcatttatactggtntatttcactataactacgcagacctccgtgaacggggccattccacatctaccgagggacaattacccgaaggtaacctacggtttatcttacaaattcgaaacaacctggacgaggacgacgacacggccgtctattaccngtcgcgaagacgaagttccggacgtcgttcgggngtttggtttaatttagttcggtttcgactttcggtcgggggcctaaccggggg

SEQ ID NO: 319087 - DNA, 562 bp, Homo sapiens
  misc_feature: GZ8MTXP01C4OS3.44.55.E11.1.454.CMB.2.raw
  modified_base (335)..(335): a, c, t, g, unknown or other
  misc_feature (335)..(335): n is a, c, g, or t
  modified_base (347)..(347): a, c, t, g, unknown or other
  misc_feature (347)..(347): n is a, c, g, or t
  modified_base (515)..(515): a, c, t, g, unknown or other
  misc_feature (515)..(515): n is a, c, g, or t
tcagacagtatatacacgaccggtgctcgatttagcactcgcacgttgggtttgggggagaggagcccagcactgggattccgaggtgtttccattcggtgatcagcactgaacacagaggactcaccatggagttttggctgagcgtggttcgtccttagttggacttttaaaaggtgtccagtgtgaggtgcggctgatggagtctggaggaggcttagtccagccgtggggggtcccagagactctcctgtgcagcctctgggctcaccgtcagcagcaactacatgagttggtccgccaggctccgaggggaaggggctgggagtgggtcncgagtcatttanactggtgatttcacataactacgcagactccgtgaagggccattcaccatctccagggacaagttccaagggaactaacggtttatacttacaaaattgaacgaacctacgaagaggacgacgacgacggaccgtctatactgtgcgagacgaagcggcgcgttcggngttaggttaagttagttcgtttgtcgttcgtcgggttcgtaaccggg

SEQ ID NO: 319088 - DNA, 527 bp, Homo sapiens
  misc_feature: GZ8MTXP01D3T51.44.55.E11.1.454.CMB.2.raw
  modified_base (342)..(342): a, c, t, g, unknown or other
  misc_feature (342)..(342): n is a, c, g, or t
  modified_base (419)..(419): a, c, t, g, unknown or other
  misc_feature (419)..(419): n is a, c, g, or t
tcagacagtatatacacgaccggtgctcgatttagcactcgcacgttgggtttgggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctggggggtcccagagactctcctgtgcagcctctggctcaccgtcagcagcaactacatgagttgggtccgccagggctccaggggaaggggctggagtgggtctcagtcatttanactggtgatttcacataactacgcagactccgtgaagggccgattcaccatctccagggacattcagacacggttancttacaaatgaacaacctgagaggcgagacacggccgtctattactgtgcagacaagttcgcgcttcggagttggttaatattcgttgattcgtggggcctaacgggg

SEQ ID NO: 319089 - DNA, 565 bp, Homo sapiens
  misc_feature: GZ8MTXP01BF7EF.44.55.E11.1.454.CMB.2.raw
  modified_base (298)..(298): a, c, t, g, unknown or other
  misc_feature (298)..(298): n is a, c, g, or t
  modified_base (337)..(337): a, c, t, g, unknown or other
  misc_feature (337)..(337): n is a, c, g, or t
  modified_base (489)..(489): a, c, t, g, unknown or other
  misc_feature (489)..(489): n is a, c, g, or t
  modified_base (491)..(491): a, c, t, g, unknown or other
  misc_feature (491)..(491): n is a, c, g, or t
  modified_base (512)..(512): a, c, t, g, unknown or other
  misc_feature (512)..(512): n is a, c, g, or t
tcagacagtatatacacgaccggtgctcgatttagcactcgcacgttgggtttggggagaggagcccagcactgggattccgaggtgtttccattcggtgatcagcactgaacacagaggactcaccatggagtttttggctgagcgtggttcgtcctaggtggactttaaaaggtgtcagtgtgaggtgcggctgatggagtctggaggaggcttaggtccagccgtggggggtcccagagactctcctgtgcagccctgtgggctcaccgtcagcagcaactacatgagttggccnccaggctcgaggggagggcgtggaggtgggtcgtcagtntattatactcggtgtattctactactaactacgcgacgacgtaccgtgacgggacgacttacaccatctacgacggacaactaccagaactacgttacttacttactaatacgaacgaactagagagacgacgacgacgcgtctatatgtgngngacgaagcggcgccgttcggnggttaggttaagtttacttcgtttgtacgttacgtcgggttccggtaaccggg

SEQ ID NO: 319090 - DNA, 449 bp, Homo sapiens
  misc_feature: GZ8MTXP01D0CLU.44.55.E11.1.454.CMB.2.raw
  modified_base (288)..(288): a, c, t, g, unknown or other
  misc_feature (288)..(288): n is a, c, g, or t
  modified_base (443)..(449): a, c, t, g, unknown or other
  misc_feature (443)..(449): n is a, c, g, or t
tcagacagtatatacacgaccggtgctcgatttagcactcgcacgttgggtccgccaggctccagggaaggggctggagtgggtctcagtcatttatactggtgatttcacatactacgcagactccgtgaagggccgattcaccatctccagggacaattccaggaacacggtttatcttcaaatgaacaacctgagaggcgacgacacggccgtctattactgtgcgagacaagtcggcgctcgggagtggttattattcgtttgactctggggccagggaacccnggtcaccgtcgcctccgcctcaccaagggcccatcggtctccccctggcaccctcctccaagcgcacctctgggggcaccagcggccctgggcctgccctggtcaagggactacttccctatatactgtctgagcgggctgggcaggcgcatagnnnnnnn

SEQ ID NO: 319091 - DNA, 579 bp, Homo sapiens
  misc_feature: GZ8MTXP01D4EY8.44.55.E11.1.454.CMB.2.raw
  modified_base (299)..(299): a, c, t, g, unknown or other
  misc_feature (299)..(299): n is a, c, g, or t
  modified_base (344)..(344): a, c, t, g, unknown or other
  misc_feature (344)..(344): n is a, c, g, or t
  modified_base (351)..(351): a, c, t, g, unknown or other
  misc_feature (351)..(351): n is a, c, g, or t
  modified_base (434)..(434): a, c, t, g, unknown or other
  misc_feature (434)..(434): n is a, c, g, or t
  modified_base (442)..(442): a, c, t, g, unknown or other
  misc_feature (442)..(442): n is a, c, g, or t
  modified_base (491)..(491): a, c, t, g, unknown or other
  misc_feature (491)..(491): n is a, c, g, or t
tcagacagtatatacacgaccggtgctcgatttagcactcgcacgttgggtttggggagaggagcccagcactgggattccgaggtgtttccattcggtgatcagcactgaacacagaggactcaccatggagttttggctgagcgtgggttctccttgttggactttaaaaggtgtccagtgtgaggtgcggctgatggagtctggaggaggcttagtccagccgtggggggtcccagagactctcctgtgcagcctctgggctcaccgtcagcagcaactacatgagttgggtcccncaggctccgagggggaagggctgggagtgggtctcagtcatttanactggtntatttcacataactacgcagctccgtgaacgggccattccaccatctaccgagggacaattcccgaaggtaactacggtttanccttaaanaatacgaaacacgtgaagacggacgacgacgacggtcctatacttacgngtgaacgagacgtacggttcggacgtcgttacgggttgttaggtttaatttcgttcgttgtacgttcgggtcggggaaccgtaacggg

SEQ ID NO: 319092 - DNA, 539 bp, Homo sapiens
  misc_feature: GZ8MTXP01CILQU.44.55.E11.1.454.CMB.2.raw
  modified_base (208)..(208): a, c, t, g, unknown or other
  misc_feature (208)..(208): n is a, c, g, or t
  modified_base (302)..(302): a, c, t, g, unknown or other
  misc_feature (302)..(302): n is a, c, g, or t
  modified_base (418)..(418): a, c, t, g, unknown or other
  misc_feature (418)..(418): n is a, c, g, or t
  modified_base (481)..(481): a, c, t, g, unknown or other
  misc_feature (481)..(481): n is a, c, g, or t
tcagacagtatatacacgaccggtgctcgatttagcactcgcacgttgggtttggggagcttcagctgtgggtagagaagacaggactcaggacgatctccagcatggccagcttccctctcctcctcaccctcctcactcactgtgcagggtcctgggcccagtctgtgatgtctcagccaccctcagcgtctcgggacccccgggnagggggtcaccatctcttgttctggaaggagtccaatatcggatcttatcctgtcaactggatcgggactccaggcacggcccccgatccttanctatgctactaatcagccggccctcgacgggggtcccctgacccgtattccctctggctccaagtcctggcacctcacgccctccctggccatccactcgggctccaggctgaagntggagggtgattattactggctagtccctatgacagcagcctcgagtggttgggtgttcgggnggtacggacgaagcgttacggcccgttcgtgggcaacgcccaggcctcgccccgtccg

SEQ ID NO: 319093 - DNA, 563 bp, Homo sapiens
  misc_feature: GZ8MTXP01ELFO2.44.55.E11.1.454.CMB.2.raw
  modified_base (301)..(301): a, c, t, g, unknown or other
  misc_feature (301)..(301): n is a, c, g, or t
  modified_base (428)..(428): a, c, t, g, unknown or other
  misc_feature (428)..(428): n is a, c, g, or t
  modified_base (469)..(469): a, c, t, g, unknown or other
  misc_feature (469)..(469): n is a, c, g, or t
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtggggggtcccagagactctcctgtgcagcctctgggctcaccgtcagcagcaactacatgagttgggtccnccaggctccgagggaaggggctgggagtgggtctcagtcatttatactggtgtatttcacataacctacgcagactccgtgaagggccattcacatctccagggacaattccagaactacggtttancttacaaatgaaacaactgagaggcgacgacacggcccgtntacttactgtgccgaagacgaaaggttcggacgtcttcgggattgggtttaattagtttccggtttgactttcgtcgggggccctaaccggggg

SEQ ID NO: 319094 - DNA, 550 bp, Homo sapiens
  misc_feature: GZ8MTXP01AR63G.44.55.E11.1.454.CMB.2.raw
  modified_base (400)..(400): a, c, t, g, unknown or other
  misc_feature (400)..(400): n is a, c, g, or t
  modified_base (429)..(429): a, c, t, g, unknown or other
  misc_feature (429)..(429): n is a, c, g, or t
  modified_base (503)..(503): a, c, t, g, unknown or other
  misc_feature (503)..(503): n is a, c, g, or t
tcagacagtatatacacgaccggtgctcgatttagcactcgcacgttgggtttgggggagaggagcccagcactgggattccgaggtgtttccattcggtgatcagcactgaacacagaggactcaccatggagttttggatgagctgggttctccttgttggacttttaaaaggtgtccagtgtgaggtgcggctgatggagtctggaggaggcttagtccagccgtggggggtcccagagactctcctgtgcagccctctgggctcaccgtcagcagcaactacatgagttgggtccgccaggcctccgaggggaagggctgggagtggggtctcgagttcatttatacgtggtgatttcactataactacgcagactccgtgaagggccattcaccntcctcagggacattccagtaacacgttancttacaaatgaacaactgagacgcgacgacgacggccgtctatactgtgcaagacaagttcggacgcttcgggngttgggtttaattagttcgtttgaccgttcgtcggggcctaacgggg

SEQ ID NO: 319095 - DNA, 552 bp, Homo sapiens
  misc_feature: GZ8MTXP01A8EKR.44.55.E11.1.454.CMB.2.raw
  modified_base (259)..(259): a, c, t, g, unknown or other
  misc_feature (259)..(259): n is a, c, g, or t
  modified_base (296)..(296): a, c, t, g, unknown or other
  misc_feature (296)..(296): n is a, c, g, or t
  modified_base (439)..(439): a, c, t, g, unknown or other
  misc_feature (439)..(439): n is a, c, g, or t
  modified_base (487)..(487): a, c, t, g, unknown or other
  misc_feature (487)..(487): n is a, c, g, or t
  modified_base (508)..(508): a, c, t, g, unknown or other
  misc_feature (508)..(508): n is a, c, g, or t
  modified_base (520)..(520): a, c, t, g, unknown or other
  misc_feature (520)..(520): n is a, c, g, or t
tcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtggggggtcccagagactctcctgtgcagcctngggctcaccgtcagcagcaactacatgagttgggccnccgaggctccgaggggaaggggctgggagtgggtctcgagtcatttatactggtgtatttcactataacctacgcagacctccggtagaacggggcccattcacccatcctcgagggacaattccaagggaactacggtttancttacaaatcgaaacactagagaggtcgacgacgacggctctatacgngtgcagacaagcgcgcttggngttggttaattntttcgttgacgttcgtggggttcccaacgggg

SEQ ID NO: 319096 - DNA, 570 bp, Homo sapiens
  misc_feature: GZ8MTXP01DBUAH.44.55.E11.1.454.CMB.2.raw
  modified_base (347)..(347): a, c, t, g, unknown or other
  misc_feature (347)..(347): n is a, c, g, or t
  modified_base (354)..(354): a, c, t, g, unknown or other
  misc_feature (354)..(354): n is a, c, g, or t
  modified_base (430)..(430): a, c, t, g, unknown or other
  misc_feature (430)..(430): n is a, c, g, or t
tcagacagtatatacacgaccggtgctcgatttagcactcgcacgttgggtttgggggggagaggagcccagtactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtgggggtcccagagactctcctgtgcagcctctgggctcaccgtcagcagcaactacatgagttgggtccgccaggctccgaggggaaggggctgggagtgggtctcgagtcatttanactggtnatttcacatactaacgcaagactccgtgaacgggccattcaccatctccagggacattccaggaactacggtttancttacaaatagaacaaccgtgagaggcgacgacacggccgttactattactgtgcgaagcaaggtcggcgcgtcgggagttggtttacttaatttccggttttgacgtttcggttcgggggcccaacgggggtaaccccg

SEQ ID NO: 319097 - DNA, 422 bp, Homo sapiens
  misc_feature: GZ8MTXP01DF8VN.44.55.E11.1.454.CMB.2.raw
  modified_base (415)..(422): a, c, t, g, unknown or other
  misc_feature (415)..(422): n is a, c, g, or t
tcagacagtatatacacgaccggtgctcgatttagcactcgcacgctggagtgggtctcagtcatttatactggtgatttcacatactacgcagactccgtgaagggccgattcaccatctccagggacaattccaggaacacggtttatcttcaaatgaacaacctgagaggcgacgacacggccgtctattactgtgcgagacaagtcggcgctcggagtggttattattcgtttgacttcgtggggccaggggaaccctggtcaccgtcgcctccgcctccaccaaggcccatcggtctccccctggcaccctcctccaagacgcacctctgggggcacagccggccctgggctgcctcggtcaaggactactcctaaatatctgtctgagcgggctggcaaggcgcatagnnnnnnnn

SEQ ID NO: 319098 - DNA, 642 bp, Homo sapiens
  misc_feature: GZ8MTXP01BT6MP.44.55.E11.1.454.CMB.2.raw
  modified_base (276)..(276): a, c, t, g, unknown or other
  misc_feature (276)..(276): n is a, c, g, or t
  modified_base (282)..(282): a, c, t, g, unknown or other
  misc_feature (282)..(282): n is a, c, g, or t
  modified_base (286)..(286): a, c, t, g, unknown or other
  misc_feature (286)..(286): n is a, c, g, or t
  modified_base (310)..(310): a, c, t, g, unknown or other
  misc_feature (310)..(310): n is a, c, g, or t
  modified_base (315)..(315): a, c, t, g, unknown or other
  misc_feature (315)..(315): n is a, c, g, or t
  modified_base (327)..(327): a, c, t, g, unknown or other
  misc_feature (327)..(327): n is a, c, g, or t
tcagacagtatatacacgaccggtgctcgatttagcactcgcacgttgggtttggggagaggagcccagcactgggattccgaggtgtttccattcggtgatcagcactgaacacagaggactcaccatggagtttttggctgagcgtggttcgtcctaggtggactttaaaagtgtccagtgtgaggtgcggctgatggagtctggaggaggcttagtccagccgtggggggtcccagagactctcctgtgcagcctctggctcaccgtcagcanacacanatgngtcggtcgcgcgcgcgagggaggngtggnggtggtctcatntattatacgtcgtgtattactactactaactacgcgacgtaccgtccggtacggacgggtaccgtactacctacctactaccgtaccgacggtaacgtaacgttaccgtaacggtaaccgttaacgtttaacgttacttaactaaacgtaacgtaaaccgtaacgtacggacggacggacggaccgaccgaccggtaccgtacttacgttacgtcgtcgaacgacgacgtacggttcggtcggtcggttacggttaggttaggtttaagtttacgtttcgtttcgttacgttcggttcgggttccggtaaccggg

SEQ ID NO: 319099 - DNA, 533 bp, Homo sapiens
  misc_feature: GZ8MTXP01ARFFV.44.55.E11.1.454.CMB.2.raw
  modified_base (396)..(396): a, c, t, g, unknown or other
  misc_feature (396)..(396): n is a, c, g, or t
  modified_base (416)..(416): a, c, t, g, unknown or other
  misc_feature (416)..(416): n is a, c, g, or t
  modified_base (452)..(452): a, c, t, g, unknown or other
  misc_feature (452)..(452): n is a, c, g, or t
  modified_base (459)..(459): a, c, t, g, unknown or other
  misc_feature (459)..(459): n is a, c, g, or t
tcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtggggggtcccagagactctcctgtgcagcctctgggctcaccgtcagcagcaactacatgagttgggtccgccaggctccgaggggaaggggctgggagtgggtctcgagtcatttatactggtgatttcacataactacgcagactccgtgaagggccattcacatcncaggacatccagacagttancttacaatgaacactgagagcgacgacacggccgtntattacngtgcgagacaggttcggacgcttcggagttgggttaattagttcgtttgacgtttcgtcggggccgtaacgggg

SEQ ID NO: 319100 - DNA, 586 bp, Homo sapiens
  misc_feature: GZ8MTXP01DFPRW.44.55.E11.1.454.CMB.2.raw
  modified_base (343)..(343): a, c, t, g, unknown or other
  misc_feature (343)..(343): n is a, c, g, or t
tcagacagtatatacacgaccggtgctcgatttagcactcgcacgttgggtttgggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtgggggtcccagagactctcctgtgcagcctctgggctcaccgtcagcagcaactacatgagttgggtccgccaggctccgaggggaagggctgggagtgggtctcagtcatttanactggtgatttcacataactacgcagactccgtgaacgggcccgattccacctatcctaccgaagggaccaaattcccaagggaactacggtttacctttacaaattcgaaacaacctggaagaggacgaacgacacggccgtctattacctgtgcgaagaccaaggttcggacgtcgttacgggagttgggtttaatttacgtttcggttttgactttcggtcgggggccctaaaccggggg

SEQ ID NO: 319101 - DNA, 624 bp, Homo sapiens
  misc_feature: GZ8MTXP01A2GBE.44.55.E11.1.454.CMB.2.raw
  modified_base (304)..(304): a, c, t, g, unknown or other
  misc_feature (304)..(304): n is a, c, g, or t
tcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtcgtggaggaggcttagtccagccgtgggggtcccagagactctcctgtgcagcctcgtgggctcaccgtcagcagacaactacatgagttcgggtcccnccaggcctccgagggggaaggggctgggaggtgggtctcgagtctatttatctggtgtatttcacataaacctacgcagacctccgtaggaacgggccaattccaccatccgtacccgaagggaaccaagttacccgaaggtaaactacggtttaatcttaacaaatacgaaacaaccgtaggaacgacgggcgaacgacgaccggtaccgttctattaccgtggtcgaacgtaagaaccgaaggttccggacgtcgttacgggttgttgggttttaatagtttcgttagtaccgttcgggttcgggcccgtaaccgggg

SEQ ID NO: 319102 - DNA, 696 bp, Homo sapiens
  misc_feature: GZ8MTXP01C7ZA6.44.55.E11.1.454.CMB.2.raw
  modified_base (380)..(380): a, c, t, g, unknown or other
  misc_feature (380)..(380): n is a, c, g, or t
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggtacttttaaaggtgtccagtgtgaggtgcggctgatggagtcgtggaggaggcttagtccaggccgtgggggtcccagagactctcctgtgcagccctcgtgggcctcaccggtcagcagcaactacagtgtaggttcgggtcccgccgaggccgtaccggagggggaacggggcgtgggaggttcgggtctcgtagttctatttatacgtggtntatttcaactactaaccgtacgcacgtaccgtccggtagggaacgggtccgtacttaccacctatcccgtacgacgggaacctaacgttacccgaaggtaaccttacggtttactaccttaacaaaacgttacgaaaccgtaaccgtaggaacggacggaccgaaccgaccgaccggtcccgttacttacgtttacctggtacggaacgaacggaacgtaacgggttcggtaccgtcgttcgggttaggtttacggttttaatttacgtttcggttttcgacccgtttcgggtccggggttaaccgtaacccgggg

SEQ ID NO: 319103 - DNA, 553 bp, Homo sapiens
  misc_feature: GZ8MTXP01ALA8Y.44.55.E11.1.454.CMB.2.raw
  modified_base (424)..(424): a, c, t, g, unknown or other
  misc_feature (424)..(424): n is a, c, g, or t
  modified_base (429)..(429): a, c, t, g, unknown or other
  misc_feature (429)..(429): n is a, c, g, or t
  modified_base (457)..(457): a, c, t, g, unknown or other
  misc_feature (457)..(457): n is a, c, g, or t
  modified_base (465)..(465): a, c, t, g, unknown or other
  misc_feature (465)..(465): n is a, c, g, or t
  modified_base (474)..(474): a, c, t, g, unknown or other
  misc_feature (474)..(474): n is a, c, g, or t
tcagacagtatatacacgaccggtgctcgatttagcactcgcacgttgggtttgggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctggggggtcccagagactctcctgtgcagcctctgggctcaccgtcagcagcaactacatgagttggtccgcaggctccgaggggaaggggctgggagtgggtctcagtcatttatactggtgatttcacataactacgcagactccgtgaacggggccatcaccatctcgaggacaattcccaggaacacggtttancttanaaatgaaacaactgagacggcgacgacncgggcctntattactgngcgaagacaaggttcggacgtcgttcgggagttggttaatttattccggtttagcgtttcgtcgggggccctaacgggg

SEQ ID NO: 319104 - DNA, 568 bp, Homo sapiens
  misc_feature: GZ8MTXP01D2OJI.44.55.E11.1.454.CMB.2.raw
  modified_base (343)..(343): a, c, t, g, unknown or other
  misc_feature (343)..(343): n is a, c, g, or t
  modified_base (350)..(350): a, c, t, g, unknown or other
  misc_feature (350)..(350): n is a, c, g, or t
  modified_base (431)..(431): a, c, t, g, unknown or other
  misc_feature (431)..(431): n is a, c, g, or t
  modified_base (487)..(487): a, c, t, g, unknown or other
  misc_feature (487)..(487): n is a, c, g, or t
  modified_base (512)..(512): a, c, t, g, unknown or other
  misc_feature (512)..(512): n is a, c, g, or t
tcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtggggggtcccagagactctcctgtgcagcctctgggctcaccgtcagcagcaactacatgagttggccgccaggctccgaggggaagggctgggagtgggtctcagtcatttanactggtntatttcactataactacgcagactccgtagaacggggccattaccacatctaccaggacaacttccaggaacctaggttancttacaaatcgaaacaacctgaacgaggaccgaacgaccgacggcctctattaccnggtgaacgtagacaagttcgggacncgttcggagttcggttaattagtttcgtttgacttcggtcggggccgtaaccgggg

SEQ ID NO: 319105 - DNA, 413 bp, Homo sapiens
  misc_feature: GZ8MTXP01C9AEM.44.55.E11.1.454.CMB.2.raw
  modified_base (409)..(413): a, c, t, g, unknown or other
  misc_feature (409)..(413): n is a, c, g, or t
tcagacagtatatacacgaccggtgctcgatttagcactcgcacgctggagtgggtctcagtcatttatactggtgatttcacatactacgcagactccgtgaagggccgattcaccatctccagggacaattccaggaacacggtttatcttcaaatgaacaacctgagaggcgacgacacggccgtctattactgtgcgagacaagtcggcgctcggagtggttattattcgtttgacttctggggccagggaaccctggtcaccgtcgcctcgctcacaaggcccatcggtcttccccctggcaccctcctccaagagcacctctgggggcacagcggccctgggctgcctggtcaaggctactccctaatataactgtctgagcgggctgggcaaggcgcatagnnnnn

SEQ ID NO: 319106 - DNA, 605 bp, Homo sapiens
  misc_feature: GZ8MTXP01BVVRY.44.55.E11.1.454.CMB.2.raw
  modified_base (260)..(260): a, c, t, g, unknown or other
  misc_feature (260)..(260): n is a, c, g, or t
  modified_base (428)..(428): a, c, t, g, unknown or other
  misc_feature (428)..(428): n is a, c, g, or t
tcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtgggggtcccagagactctcctgtgcagcctcgngggctcaccgtcagcagcaactacatgagttgggtccgcaggctccgaggggaagggctggagtgggtctcgagtctatttatactggtgtatttcactataactacgcagactccgtagaacgggccattcacatcacgaggacaattccgaagaactacggtttancgttacaaattcgaaactaaccgtggaagacgggaccgacgaccgacggtaccgtcttaagttacctggtcgaaccgaagacgtaaaggttccggcgtcgttcgggttgttacgggtttaattacggttttcggtttacggaccgtttcgggtaacgggggcccgtaaacccggggg

SEQ ID NO: 319107 - DNA, 709 bp, Homo sapiens
  misc_feature: GZ8MTXP01EJVIM.44.55.E11.1.454.CMB.2.raw
tcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggaattttaaaaggtgtccagtgtgaggtgcggctgatggagtctggaggaggcttagtccagccgtggggggtcccagagactctcctgtgcagcctcgtgggcctcaccgtcagcagcaactacagtgaggttcgggtcccgccgaggcctaccggagggggaacggggctgggagtgggtctcgagttctatttatacgtggtgtatttacactactaactacgctagtaccgtccggtaggaacgggcctagtttccaacctagtcctacccggaaggggtaacctaaacgtttaccccgaaagggtaaaccgtacgggttttaactaccgttaacaaaagttcggaaacctaaaccgttagggaacggacgggaccggaaaccggaacccgtaccgggtaccccgttacgttaacgtttaaccgtggttacgaaccggaacgacgtaacgggttccgggacgtccgttacggggttagtttggtttaattacgtttcggttttacggacgtttacgggtccgggggttaaccctaacccggggg

SEQ ID NO: 319108 - DNA, 578 bp, Homo sapiens
  misc_feature: GZ8MTXP01BON90.44.55.E11.1.454.CMB.2.raw
  modified_base (522)..(522): a, c, t, g, unknown or other
  misc_feature (522)..(522): n is a, c, g, or t
tcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtggggggtcccagagactctcctgtgcagcctctgggctcaccgtcagcagcaactacatgagttgggtcccgccaggctccgagggggaagggggctgggagtggggtctcgagtcatttatactggtgatttcactataactacgcagacctccgtgaagggccgattcaccatctaccgagggacaattcccgaggtaactacggtttatcttacaaattcgaacaaccgtgacgaggcgacgacgacggccgtctattacctgtgcgtagacgaaggttcggcgcttcgggngttgggtttaatttagtttccggtttgtacctttcggtcgggggcccgtaacgggg

SEQ ID NO: 319109 - DNA, 595 bp, Homo sapiens
  misc_feature: GZ8MTXP01C12PG.44.55.E11.1.454.CMB.2.raw
  modified_base (263)..(263): a, c, t, g, unknown or other
  misc_feature (263)..(263): n is a, c, g, or t
tcagacagtatatacacgaccggtgctcgatttagcactcgcacgttgggtttggggggagaggagcccagcactgggattccgaggtgtttccattcggtgatcagcactgaacacagaggactcaccatggagttttggctgagcgtgggttctccttgttggacttttaaaaggtgtccagtgtgaggtgcggctgatggagtctggaggaggcttagtccagccgtggggggtcccagagactctcctgtgcagccctntgggctcaccgtcagcagcaactacatgagttggccgccaggctcgaggggaagggctgggagtgggtctcgagtctatttatacgtggtgtattttccactataaactacgcagacctccggtagaacgggcctattccaccatcctaccgagggacctaaattcccgaaggtaactacggtttatcttacaaaatcgaaacaaccctggaacgaggcgaacgacgacgggtccctactattactgtgcgaagaccgaagttcgggcgcgttcgggttgttggtttaattagtttcggtttgacgtttcggtaacggggcccgtaacgggg

SEQ ID NO: 319110 - DNA, 551 bp, Homo sapiens
  misc_feature: GZ8MTXP01EG9DB.44.55.E11.1.454.CMB.2.raw
  modified_base (429)..(429): a, c, t, g, unknown or other
  misc_feature (429)..(429): n is a, c, g, or t
  modified_base (504)..(504): a, c, t, g, unknown or other
  misc_feature (504)..(504): n is a, c, g, or t
tcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtggggggtcccagagactctcctgtgcagcctctgggctcaccgtcagcagcaactacatgagttgggtccgccaggctccgaggggaaggggctgggagtgggtctcagtcatttatactggtgatttcactataactacgcagactccgtgaacgggccgattcacatctcgagggacaattccaggtaactacggtttancttacaaatgaaacaactgagacggcgacgcacggccgtctattacctgtgcgagacaagttcggcgcgttcggngttggttaatttagttcgtttgacgttcgtcggggccgtaaccgggg

SEQ ID NO: 319111 - DNA, 654 bp, Homo sapiens
  misc_feature: GZ8MTXP01AR55G.44.55.E11.1.454.CMB.2.raw
  modified_base (357)..(357): a, c, t, g, unknown or other
  misc_feature (357)..(357): n is a, c, g, or t
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagcgtggttctccttggttggacttttaaaggtgtccagtgtgaggtgcggctgatggagtcgtggaggaggcttagtccaggccgtgggggtcccagagactctcctgtgcagcctgtgggctcaccgtcagcagcaactacatgagttgggccgccgaggctccgaggggaaggggctggagtgggtctcagtctaatttatacgtggtntatttcacataactacgcagacctccggtagaacggggcctaattccaaccctattcccgtaccgaagggacctaaagttaccccgaagggtaacctacggtttactacttaacaaattacgaaaccttaacccgtgaaggacgggaccgaacgacccgaaccgggtccttacgtattaaccgtggtgccgtaaggactaaacgggttcgggccgcgttccggggttagtttacgggtttaatttagttttccggtttagtacccgtttggtaacccgggggttccgtaacccgggg

SEQ ID NO: 319112 - DNA, 562 bp, Homo sapiens
  misc_feature: GZ8MTXP01C1ARK.44.55.E11.1.454.CMB.2.raw
  modified_base (428)..(428): a, c, t, g, unknown or other
  misc_feature (428)..(428): n is a, c, g, or t
  modified_base (473)..(473): a, c, t, g, unknown or other
  misc_feature (473)..(473): n is a, c, g, or t
  modified_base (551)..(551): a, c, t, g, unknown or other
  misc_feature (551)..(551): n is a, c, g, or t
tcagacagtatatacacgaccggtgctcgatttagcactcgcacgttgggcttgggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtggggggtcccagagactctcctgtgcagcctctgggctcaccgtcagcagcaactacatgagttggcccgccaggctccgaggggaaggggctggagttgggctcgagtcatttatacctggtgtatttcactaatactcgcagacctccgtgaacgggccattcacatctcaggacaattccaggaactacggttancttacaaatggaaacaccgtgacgaggccgacgacacggtccgtnttactacgtggtcgcgttagacaaggtccgggcgttcgttcgggagttgggtttattaacgttcgtttgactttcggnggggtaacccg

SEQ ID NO: 319113 - DNA, 643 bp, Homo sapiens
  misc_feature: GZ8MTXP01EGM9Q.44.55.E11.1.454.CMB.2.raw
  modified_base (289)..(289): a, c, t, g, unknown or other
  misc_feature (289)..(289): n is a, c, g, or t
  modified_base (292)..(292): a, c, t, g, unknown or other
  misc_feature (292)..(292): n is a, c, g, or t
  modified_base (302)..(302): a, c, t, g, unknown or other
  misc_feature (302)..(302): n is a, c, g, or t
  modified_base (305)..(305): a, c, t, g, unknown or other
  misc_feature (305)..(305): n is a, c, g, or t
  modified_base (316)..(316): a, c, t, g, unknown or other
  misc_feature (316)..(316): n is a, c, g, or t
  modified_base (321)..(321): a, c, t, g, unknown or other
  misc_feature (321)..(321): n is a, c, g, or t
tcagacagtatatacacgaccggtgctcgatttagcactcgcacgttgggtttgggggggagaggagcccagcactgggattccgaggtgtttccattcggtgatcagcactgaacacagaggactcaccatggagtttttggctgagcgtggttcgtccttagttggacttttaaaaggtgtccagtgtgaggtgcggctgatggagtctggaggaggcttagtccagccgtgggggtcccagagactctcctgtgcagccctgtgggctcaccgcagcagcaactantgngtcggcgcgngcncggagggaggngtggngtcggtctcgtagttctatttagtacgtgtatattacactactaaccacgcacgtaccgtcgggtaggaacgggcctactccacctactccgacgaggactaacgttaccgaacgtaacttacgtttactacttaactaaactacgaaacgtaacgtaggacggacggaccgaccgtaccgtaccggtaccgttacttacgttacgtgtcggaacgtaacgacgacggttccggacggtcggttagggttcggtttaggtttaacgttttacgtttcgtttcggtaccggtttcgggtaaccggggttaaccggtaaccggg

SEQ ID NO: 319114 - DNA, 740 bp, Homo sapiens
  misc_feature: GZ8MTXP01A5GFP.44.55.E11.1.454.CMB.2.raw
  modified_base (264)..(264): a, c, t, g, unknown or other
  misc_feature (264)..(264): n is a, c, g, or t
  modified_base (356)..(356): a, c, t, g, unknown or other
  misc_feature (356)..(356): n is a, c, g, or t
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggtacttttaaaaggtgtccagtgtgaggtgcggctgatggagtctggaggaggcttagtccagccgtgggggtcccagagactctcctgtgcagcctcgnggctcaccgtcagcagcaactacagtgagttgggcccgccgaggcctccgaggggaagggctggagtgggtctcagtcatttatacgtggtntatttcaactataaacctacgcaagtaccctccggtaggaaacgggccgaattccaacccattccgacccgaaggggtaaccctaaagtttaccccgaaagggtaaacccttacgggttttaactccgtttaacaaaattcggaaaaccaaccgttaggaaacggaacgggaccgaaccgaaaccgacccgggtacccggtttacttaaacgtttaccggttacggtacggaacccggtaaaggttaaacccggaaagggttcccggggaacggtacccgtttacggggggttagtttttacggggttttaaattttcgttttaacccggggttttaggacccgttttcgggtccggggggttaaccccgttaaacccgggggg

SEQ ID NO: 319115 - DNA, 560 bp, Homo sapiens
  misc_feature: GZ8MTXP01CGHAH.44.55.E11.1.454.CMB.2.raw
  modified_base (344)..(344): a, c, t, g, unknown or other
  misc_feature (344)..(344): n is a, c, g, or t
  modified_base (351)..(351): a, c, t, g, unknown or other
  misc_feature (351)..(351): n is a, c, g, or t
  modified_base (427)..(427): a, c, t, g, unknown or other
  misc_feature (427)..(427): n is a, c, g, or t
  modified_base (515)..(515): a, c, t, g, unknown or other
  misc_feature (515)..(515): n is a, c, g, or t
tcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtggggggtcccagagactctcctgtgcagcctctgggctcaccgtcagcagcaactacatgagttgggtccgccaggctccgaggggaaggggctggagtgggtctcgagtcatttanactggtnatttcacataacctacgcagactccgtgaacgggccattcaccatctcagggacaattccaggaactacggtttancttacaaatgaaaccaacgtgaagaggcgaacgacgacggtccgtctaagttactggtgaaccgagaccaaggttcggcgcgttgggngttgggttaattagttcgtttgacttcgtggggcccgtaacgggg

SEQ ID NO: 319116 - DNA, 586 bp, Homo sapiens
  misc_feature: GZ8MTXP01A1YYT.44.55.E11.1.454.CMB.2.raw
  modified_base (446)..(446): a, c, t, g, unknown or other
  misc_feature (446)..(446): n is a, c, g, or t
  modified_base (451)..(451): a, c, t, g, unknown or other
  misc_feature (451)..(451): n is a, c, g, or t
tcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtggggggtcccagagactctcctgtgcagcctctgggctcaccgtcagcagcaactacatgagttgggtccgcaggctccgagggaagggctgggagtgggtctcagtcatttatacgtggtgtatttcactataaactacgcagacctcccggtagaacggggccgattccacctatcctaccgagggaccaattcccgaaggtaactacggtttancttanaaatcgaaacacgtgagacggcgaacgacacggtccgtcttacttacgtggtcgcgaagactaaggttcggacgtcttacgggttgttgggtttaattagtttcgtttgacgtttcgtcggggcccgtaacgggg

SEQ ID NO: 319117 - DNA, 596 bp, Homo sapiens
  misc_feature: GZ8MTXP01DBUGG.44.55.E11.1.454.CMB.2.raw
  modified_base (342)..(342): a, c, t, g, unknown or other
  misc_feature (342)..(342): n is a, c, g, or t
  modified_base (438)..(438): a, c, t, g, unknown or other
  misc_feature (438)..(438): n is a, c, g, or t
tcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtggggggtcccagagactctcctgtgcagccctctgggctcaccgtcagcagcaactacatgagttggtccgcaggctccgaggggagggctggagtgggtctcgagtctatttanactggtgtatttcactataacctacgcagacctccggtagaacgggccgattccaccatctccgagggacaattacccgaggtaactacggtttancttacaaacttacgaaacaacccgtgaacggaggacgagtcggacaaccgggtccgttactacttactggtcgcggaagacgaaggtccggcgcgttcggttagttcgggtttatttaagtttccggtttagttaccgtttcggcgggggtaaccccg

SEQ ID NO: 319118 - DNA, 573 bp, Homo sapiens
  misc_feature: GZ8MTXP01ETF1M.44.55.E11.1.454.CMB.2.raw
  modified_base (300)..(300): a, c, t, g, unknown or other
  misc_feature (300)..(300): n is a, c, g, or t
tcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtggggggtcccagagactctcctgtgcagcctctgggctcaccgtcagcagcaactacatgagttgggtccnccaggctccgaggggaaggggctgggagtgggtctcgagtcatttatacgtggtgtatttcactataacctacgcagactccggtgaacggggccattcaccatctcgagggacaattcccaggtaactacggtttatcttacaaatgaaacaacctgaagacggcgacgacgacggccgtctattactgtgcgtaagacgagttcggcgtcgttcgggagttgggtttaattagtttcgtttgaccgtttcggtcggggccgtaaccggggg

SEQ ID NO: 319119 - DNA, 545 bp, Homo sapiens
  misc_feature: GZ8MTXP01BNIJZ.44.55.E11.1.454.CMB.2.raw
  modified_base (419)..(419): a, c, t, g, unknown or other
  misc_feature (419)..(419): n is a, c, g, or t
  modified_base (423)..(423): a, c, t, g, unknown or other
  misc_feature (423)..(423): n is a, c, g, or t
  modified_base (457)..(457): a, c, t, g, unknown or other
  misc_feature (457)..(457): n is a, c, g, or t
  modified_base (497)..(497): a, c, t, g, unknown or other
  misc_feature (497)..(497): n is a, c, g, or t
tcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtggggggtcccagagactctcctgtgcagcctctgggctcaccgtcagcagcaactacatgagttgggtccgccaggctccgaggggaaggggctgggagtgggtctcagtcatttatactggtgatttcacataactacgcagactccgtgagggccattcacatctcaggacaattccagaacacggttancttnaaatgaacaactgagaggcgacgacacggccgtntattactgtgaaccgagacaaggttcggacgcgttcgggngttgggttaattagtttcggtttgactttgtcgggggcctaacggggg

SEQ ID NO: 319120 - DNA, 702 bp, Homo sapiens
  misc_feature: GZ8MTXP01CU3YD.44.55.E11.1.454.CMB.2.raw
  modified_base (259)..(259): a, c, t, g, unknown or other
  misc_feature (259)..(259): n is a, c, g, or t
tcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcgactgatggagtctggaggaggcttagtccagccgtgggggtcccagagactctcctgtgcagcctcngggctcaccgtcagcagcaactacatgagtggtccgccaggctccgagggaaggggctgggagtgggtctcgagtctatttatactggtgatttcacataactacgcaagactccggtagaacgggcccgaattccaaccctatccgtacccgagggaacaaacttaccgaagggtaaacctaacgggtttttaatcctttaacaaaattacggaaacgtaaacccgttagggaaagacggggacaaacccggaccgtaaccggggtaccccgtttataaactttaaccgtacggttggaaccgggtaagaccggtaaaacggttcccggggtaaccggccgtttaccgggggagtttcgggggttttaaatttaaggttttccgggttttacgggaaccgtttttccgggttaacggggggaacccgttaaaacccgggggg

SEQ ID NO: 319121 - DNA, 826 bp, Homo sapiens
  misc_feature: GZ8MTXP01CJHXN.44.55.E11.1.454.CMB.2.raw
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggtacttttaaaggtgtccagtgtgaggtgcggctgatggagtcgtggaggaggcttagtccgaggccgtgggggtcccagacgactctccgtgtcgcacgcctcgtcgggcctccgaccgtcagcagacaaactacagtggaggttcgggcccgccgagggccgtaccggaagggggaacggggcgtggggaggttgggtctcgtaggtctaagtttatacgtgggttatattttccaacgtaattaaacccgtaacgcctaaacggtacccgttaccgggtacgggaaacggggtccctaaatttccaaacttcctaacgttcccgtaaccggaaacgggtaaaccctaaacgtttaccccgaaagggtaaacccgtttaacgggtttaaacttaccctttaaagaaaaacgttcggggaaaaaccctaaaccgttagggaaacgggtaacgggaacccggaaaccggaaccgtaaacccggggtcccctttaactttaacgtttaccgggtggttaacggaaacccgaagggttaaaccggaaaccgggttccgggaccgggttaccgtttcgggggttacgttttaaggggttttattttaaccgggttttcgggtttacggttaaccgttttccgggggttccgggggtaacccgggg

SEQ ID NO: 319122 - DNA, 566 bp, Homo sapiens
  misc_feature: GZ8MTXP01AMY7O.44.55.E11.1.454.CMB.2.raw
  modified_base (367)..(367): a, c, t, g, unknown or other
  misc_feature (367)..(367): n is a, c, g, or t
  modified_base (459)..(459): a, c, t, g, unknown or other
  misc_feature (459)..(459): n is a, c, g, or t
  modified_base (467)..(467): a, c, t, g, unknown or other
  misc_feature (467)..(467): n is a, c, g, or t
tcagacagtatatacacgaccggtgctcgatttagcactcgcacgttgggtttggggagcttcagctgtgggtagagaagacaggactcaggacgatctccagcatggccagcttccctctcctcctcaccctcctcactcactgtgcagggtcctgggcccagtctgtgatgtctcagccaccctcagcgtcgtcgggaccccccgggcgagggggtcaccatctcttgttctggaaggaagtccaatatcggattcttatcctgtacaactggtatcggggacctcccgaggccaccggccccccgactccttatctatgactactaatcagccgccctcgacggggtccctgcccgtattcccnctggcctccaagtcctggccactacgacggcctaccgtggcctattcccttgactctaccagtctaggagtatgaggctgattaccagtgtncagctagngggatagacgacggccggaacggcgtggggtcgttcggggcggacgggacgtaaggttcgcccgttcgtaaggcaacgccgaggcctccgccccgtcgg

SEQ ID NO: 319123 - DNA, 684 bp, Homo sapiens
  misc_feature: GZ8MTXP01EYAMY.44.55.E11.1.454.CMB.2.raw
tcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggtacttttaaaaggtgtccagtgtgaggtgcggctgatggagtcgtggaggaggcttagtccagccgtgggggtcccagagactctcctgtgcagcctgtgggcctcaccgtcagcagacaactacagtggagttcgggtcccgccaggcctccggagggggaacggggctgggtaggtcgggtctacgtagttctaatttagtacgttggtgtatttcaactacttaaaccgtacgccgtaagtaccgttacccgggtaggaaaccgggtccgtattacccgaccctagtcctaccggaagggtactaacgttacccggaaagtaaccgtacggtttataccgtaactaaatacgaaaccgaacgttggaacgtacgggaccgaaccgaccgtaccgggtaccttctaagttacctggtacgaacgaagaaccggaacggttcgcggtacgttcggttagggttacgtttaattagtttcggtttacgaccgttcgggtaacggggttaaccgtaaccgggg

SEQ ID NO: 319124 - DNA, 570 bp, Homo sapiens
  misc_feature: GZ8MTXP01EJ39I.44.55.E11.1.454.CMB.2.raw
  modified_base (444)..(444): a, c, t, g, unknown or other
  misc_feature (444)..(444): n is a, c, g, or t
  modified_base (490)..(490): a, c, t, g, unknown or other
  misc_feature (490)..(490): n is a, c, g, or t
  modified_base (499)..(499): a, c, t, g, unknown or other
  misc_feature (499)..(499): n is a, c, g, or t
  modified_base (519)..(519): a, c, t, g, unknown or other
  misc_feature (519)..(519): n is a, c, g, or t
  modified_base (526)..(526): a, c, t, g, unknown or other
  misc_feature (526)..(526): n is a, c, g, or t
tcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtcgtggaggaggcttagtccagccgtgggggtcccagagactctcctgtgcagcctcgtgggctcaccgtcagcagcaactacatgagttgggccgccaggctccgaggggaagggctgggagtgggtctcgagttctatttatacgtggtgtatttcacataaactacgcagactccgtagaacgggccgtattccacctatcctaccagggaacaattacccaaggtaactacggtttancttacaaatgaaacaactggaacgacggcgaaccgacgacggcctntaattacgngtgaagagacaagttcggcncgttggnttggtttaattattcggtttgactttcgtggggccctaacgggg

SEQ ID NO: 319125 - DNA, 714 bp, Homo sapiens
  misc_feature: GZ8MTXP01BWW2H.44.55.E11.1.454.CMB.2.raw
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtggggggtcccagagactctcctgtgcagcctctgggctcaccgtcagcagcaactacatgaggttcgggtccgccagggcctccgagggggaagggggctgggagtgggtctcgagtctatttatacgtggtgtatttcactataacctacgcagtacctccggtaggaacggggcccgtattccacccattcctacccgaaggggtaacctaaagtttaccccgaaagggtaaacccttacgggttttaactacctttaacaaaattcggaaacctaaacccgttggaaacggacgggaccgaacccggaaccgaccgggtacccggttactaacgtttaaccgtgggttacggaacccggtaaggaaccgtaaacgggttccgggaccggtcccgttacgggggttacgtttaggggtttaactttacgtttcggtttttacggaccgttttccgggtcgggggttccccgtaaaccggggg

SEQ ID NO: 319126 - DNA, 780 bp, Homo sapiens
  misc_feature: GZ8MTXP01DWQ1B.44.55.E11.1.454.CMB.2.raw
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtcgtggaggaggcttagtccaggccgtgggggtcccagagactctctgtgcagcctgtgggctcaccgtcagcagacaactacatgaggttcgggtcccgccgaggcctaccggagggggaagggggctgggagtgggtctcgagttctaatttatacgtggtgtatttcaactataaacctacgcaaacgtaccgttcccgggtaagggaaacggggtccccgtaaatttacccaaccctaagttaccccggtacccggggggtaaacctaaaaccgttttaccccggaaaacggggtaaaccctttaaccggggtttttaaacttacccgttaaaccctaaaaagttaacgggaaaaccctaaaacccggggttagggaaacgggaaccggggacccggaaaccggaaccgaccgggtacccgtttacttaacgttaccgtaggtacggaccggtaaaggaacgttaaagggtccgggacgtcggtacgggttaggtttgggtttaactttaaggtttaccgttttggtaccgtttcgggttacgggggtaacccgttaacggggtaaccccg

SEQ ID NO: 319127 - DNA, 554 bp, Homo sapiens
  misc_feature: GZ8MTXP01A0IEL.44.55.E11.1.454.CMB.2.raw
  modified_base (345)..(345): a, c, t, g, unknown or other
  misc_feature (345)..(345): n is a, c, g, or t
  modified_base (465)..(465): a, c, t, g, unknown or other
  misc_feature (465)..(465): n is a, c, g, or t
tcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtggggtgcggctgatggagtctggaggaggcttagtccagcctggggggtcccagagactctcctgtgcagcctctgggctcaccgtcagcagcaactacatgagttgggtccgccaggctccgaggggaaggggctggagtggggtctcagtcatttanactggtcgatttcacatactaacgcaagactccgtagaaggggccattcaccatctccagggacaattccaaggaactacggtttatcttacaaatgaacaaccgtgagaggcgacgacncggccgtctattactgtgcgaagacaaggtcgcgctcggaggttggttattaagttgtttgacttgcgggggtccaaggggtaaccccg

SEQ ID NO: 319128 - DNA, 693 bp, Homo sapiens
  misc_feature: GZ8MTXP01B8T6V.44.55.E11.1.454.CMB.2.raw
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtggggggtcccagagactctcctgtgcagcctctgggctcaccgtcagcagcaactacatgagttggtccgccaggctccgaggggaaggggctgggagtgggtctcgagtcatttatacgtggtgtatttcacataaacctacgcaagacctccggtagaacgggcccgtattccgaccctatccgtcccgaaggggtacctaaacgtttacccgaaaggggtaaaccttaaccggggttttaacttaccgtttaaccaaaaacgttcgggaaaacctaaacccgttgggaaacgggaacgggaccgaaaccggaaaccgaccgggtaccccgttacttaacgttaaccgtggtgaaccggaagaacgaaacgggttccggaccggtcttacggggttattcggggtttaatttacgtttcgttttcgacgtttcgtaacgggggttcccgtaaacccggggg

SEQ ID NO: 319129 - DNA, 693 bp, Homo sapiens
  misc_feature: GZ8MTXP01EE2CW.44.55.E11.1.454.CMB.2.raw
  modified_base (363)..(363): a, c, t, g, unknown or other
  misc_feature (363)..(363): n is a, c, g, or t
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtgggggtcccagagactctcctgtgcagccctcgtggcctcaccgtcagcagcaaactacatgaggttcgggtccgccagggctaccgaggggaaggggctgggagtgggtctcgagtctatttatacgtggtntactttcactataacctacgcagtaacgtccgtagggaacgggtccattaccacgtatccgtaccgaagggaacctaagtttacccgaaggtaaaccttacgggtttaactaccgttaacgaaaacttacgaaaaccgtaaccgttagggaacggacgggaccgaaccgaaccgtaccggtaccgtttctaacgttacgtcggtggaacgtaaggaccgtaaacggttccgggacgtccggttgggttaaggtttcgggttttaaattttcgttttccggttttcgtaccggttttccggtaacggggggttaaccccgtaacccggggg

SEQ ID NO: 319130 - DNA, 621 bp, Homo sapiens
  misc_feature: GZ8MTXP01DDU5L.44.55.E11.1.454.CMB.2.raw
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtgggggtcccagagactctcctgtgcagccctctgggctcaccgtcagcagcaactacatgaggttcgggtcccgccagggcctccgagggggaaggggctgggagtcgggtctcgagttctatttatacgttggtgtatttcactataacctacgcagacctccggtaggaacgggtccgattccaccatcctaccgagggacaatttacccgaaggtaactacggtttatccttaacaaatcgaaacgaacctggaacgaggacgaccgacgaccggaccttctacttacgtggtgaacgtaagaccgaagggttcggcgtcgttcgggttagttcggtttaatttacgtttcggtttgaccgtttcggtcgggggcccgtaaccggggg

SEQ ID NO: 319131 - DNA, 653 bp, Homo sapiens
  misc_feature: GZ8MTXP01ENX13.44.55.E11.1.454.CMB.2.raw
tcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtgggggtcccagagactctcctgtgcagcctcgtggctcaccgtcagcagcaactacatgagttggccgccgaggctaccgaggggaaggggctgggagtgggtctcgagttcatttagtacgtggtgtatttcaactataaacctacgctagaccgtccggtggaaacggggcccatttaccaccctattcctacccgaagggacctaaagtttacccgaaagggtaaacctacgggttttataccttaacaaaattcggaaactaacccgttggaaacgacgggaccgaaccgaccgaccgggacccgttacttaacgttacgtggtgccgaaggttaccaaacgggttccggcgtcgttacgggttgttgggtttaacttaggtttcgtttcggtacgtttcggtcgggggccctaaccggggg

SEQ ID NO: 319132 - DNA, 673 bp, Homo sapiens
  misc_feature: GZ8MTXP01CJJOC.44.55.E11.1.454.CMB.2.raw
  modified_base (303)..(303): a, c, t, g, unknown or other
  misc_feature (303)..(303): n is a, c, g, or t
  modified_base (430)..(430): a, c, t, g, unknown or other
  misc_feature (430)..(430): n is a, c, g, or t
  modified_base (599)..(599): a, c, t, g, unknown or other
  misc_feature (599)..(599): n is a, c, g, or t
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagcgtgggttctccttgttggacttttaaaaggtgtccagtgtgaggtgcggctgatggagtcgtggaggaggcttagtccagccgtgggggtccagagactctcctgtgcagcctgtggctcaccgtcagcagcaactacagtgaggttcgggcccnccgaggcctccggagggggaagggctgggaggtgggtactcgagttctaatttagtacgtggttgtatttcaactacttaactacgcacgtaccgtccggtaggaacggggtcctattaccgacctntcctaccgagggaacctaacgttaccgaagggtaactacggtttacacgttaacaaagtacgaaacgtaaccgtaggaaggacggccaaaccggacgaccgggtcccttataacttaccggtgcggaacggacgaacggaaacggttccgggtacgtacgtttccgggnggtttagggttttaatttcgttttcggtttacgtaccggtttcggtccggggggttaacccgtaaacccggggg

SEQ ID NO: 319133 - DNA, 653 bp, Homo sapiens
  misc_feature: GZ8MTXP01EUL7W.44.55.E11.1.454.CMB.2.raw
  modified_base (591)..(591): a, c, t, g, unknown or other
  misc_feature (591)..(591): n is a, c, g, or t
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtgggggtcccagagactctcctgtgcagcctcgtgggctcaccgtcagcagcaactacatgagttcgggtccgccaggctccgaggggagggctgggagtgggtctcgagtcatttagactggtgtatttcactattaacctacgcagacctcccggtagaaacggggtccgaatttccaccctatcctaccgagggaaccaaatttcccgaaggtaaacctacggttttaatacctttaacaaaacgttcgaaacctaaaccgtggaacgacggggacgaaacccgaccgaacgggtcccgttataacgttacgtggtggaaccgaagaaccgaaagggttccgggacgtccgttaggggngtttagggttaatttacgttcgttttggactttcggtcgggggttaacccgtaacccggggg

SEQ ID NO: 319134 - DNA, 551 bp, Homo sapiens
  misc_feature: GZ8MTXP01APPOC.44.55.E11.1.454.CMB.2.raw
  modified_base (469)..(469): a, c, t, g, unknown or other
  misc_feature (469)..(469): n is a, c, g, or t
  modified_base (532)..(532): a, c, t, g, unknown or other
  misc_feature (532)..(532): n is a, c, g, or t
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtggggggtcccagagactctcctgtgcagcctctgggctcaccgtaagcagcaactacatgagttggccgcaggctccgaggggacggggctgggagtgggtctcgagtcatttatactggtgatttcactatactaacgcaagctcggtgaacgggccattcacatctcgagggacaatccaggactacggttatcttacaatcgaacaacgtgagagcgagcacggccgtctataccngtgccgaagacaacggtcggcgcgtcgggttagttgggtttattaagttcgtttgaccttggnggggtccaaggggtaaccc

SEQ ID NO: 319135 - DNA, 870 bp, Homo sapiens
  misc_feature: GZ8MTXP01EH0FO.44.55.E11.1.454.CMB.2.raw
  modified_base (252)..(252): a, c, t, g, unknown or other
  misc_feature (252)..(252): n is a, c, g, or t
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggtacttttaaaggtgtccagtgtgaggtgcggctgatggagtcgtggaggagcttagtccagccgtgggggtccagagactctctgtncacgcctcgtggcctcgaccgtcagcagacaactacagtggtaggttcgggcccgcgacggcgtaccggaagggggaacgggggtcgtgggtaggtcgggtctcgtaggttctaagttttacgtacgttggtagtacttttacgaaccttaacgttaaacccgttaacggcctaaggtaccccgttaccggggtacgggtaaaccggggtcccgtaaatttaccccaaacccttacgtttacccgtacccggaaacggggtaaaccctaaacggtttaaccccgaaaggggttaaaccctttaaccgggttttaactaccctttaaaccgaaaaaagttccggtaaaaaaccctaaacccggttggaaaacggggaccgggtaacccggaaaacccggtaaaccccgtaccggggggtttaacccctttaaccctttaaagttttaccggttaccgggttggaaacccgggtaaggaaaacccggtaaccggggtttaccggggcccggtacggtttaaccgggggttaggtttttaaggggttttaacttttacggttttccggttttcggtaaccgtttccggggtaaccgggggaaccccgtttaaacccggggg

SEQ ID NO: 319136 - DNA, 665 bp, Homo sapiens
  misc_feature: GZ8MTXP01DS4HT.44.55.E11.1.454.CMB.2.raw
  modified_base (253)..(253): a, c, t, g, unknown or other
  misc_feature (253)..(253): n is a, c, g, or t
  modified_base (359)..(359): a, c, t, g, unknown or other
  misc_feature (359)..(359): n is a, c, g, or t
tcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtcgtggaggaggcttagtccagccgtggggggtcccagagactctcctgtncagcctctgggctcaccgtcagcagcaactacatgagttgggccgccaggctccgaggggaaggggctgggagtggggtctcgagttctaagtttatacgtgggtntactttcactataaaccgttacgcgaacgtaccttcccgggtaggaaccgggggtccctaatttacccaaccctattcccgtaccggaagggacctaaacgtttacccgaagggtaaacctaacgggttttatacctttacgaaaacttcggaaaacctaaaccgttggaaggacgggacgaacccgacgacccgggtaccttcgtattaccgtgtcgaacgaacgacgtaacggttcggcgtcgttcgggagttgggtttaattagtttcggttacgcgtttcggtcggggcccgttaaccgggg

SEQ ID NO: 319137 - DNA, 663 bp, Homo sapiens
  misc_feature: GZ8MTXP01CTBVF.44.55.E11.1.454.CMB.2.raw
  modified_base (194)..(194): a, c, t, g, unknown or other
  misc_feature (194)..(194): n is a, c, g, or t
  modified_base (516)..(516): a, c, t, g, unknown or other
  misc_feature (516)..(516): n is a, c, g, or t
  modified_base (555)..(555): a, c, t, g, unknown or other
  misc_feature (555)..(555): n is a, c, g, or t
  modified_base (567)..(567): a, c, t, g, unknown or other
  misc_feature (567)..(567): n is a, c, g, or t
  modified_base (620)..(620): a, c, t, g, unknown or other
  misc_feature (620)..(620): n is a, c, g, or t
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctggttctccttgttggtactttaaaggtgtcagtgtgaggtgcggntgatggagtcgtggaggaggcttagtccaggccgtgggggtcccagagactctctgtgcagcctcgtgggctcaccgtcagcagacaactacagtgagttcggcccgcgaggcctaccgaagggggaaggggtcgtagggaggttgggtctcgtaggttactaatttagtacgttgggttatattttcaactacgttaaacctaaccgccgaaaggtacccttacccgggtaggaaccgggcccgtaattcccgaacccttaatcccgtaccgaagggacctaaagttaccccgaaaggtactaaccggtttataccttaanaaaatcgaaaccacgtaggaacgagggaccaaccgaacncgggtacccttntagtacgtgacgaacgagttacgagttcggactcgttaggttgttacggtttntttacgtttcgtcgtacgttcgggtaacgggccgtaaccgggg

SEQ ID NO: 319138 - DNA, 449 bp, Homo sapiens
  misc_feature: GZ8MTXP01CO8MS.44.55.E11.1.454.CMB.2.raw
  modified_base (438)..(449): a, c, t, g, unknown or other
  misc_feature (438)..(449): n is a, c, g, or t
tcagacagtatatacacgaccggtgctcgatttagcactcgcacgttgggtccgccaggctccagggaaggggctggagtgggtctcagtcatttatactggtgatttcacatactacgcagactccgtgaagggccgattcaccatctccagggacaattccaggaacacggtttatcttcaaatgaacaacctgagaggcgacgacacggccgtctattactgtgcgagacaagtcggcgctcggagtggttattattcgtttgacttctggggccagggaccctggtcaccgtcgcctccgcctccaccaaggcccatcgtctcccctgcaccctcctccaagcgcacctctgggggcaccagcggccctgggctcgcctggtcaagggactacgtcctatatactgtctgagcgggctggcaagggcgcatagnnnnnnnnnnnn

SEQ ID NO: 319139 - DNA, 599 bp, Homo sapiens
  misc_feature: GZ8MTXP01C66LT.44.55.E11.1.454.CMB.2.raw
  modified_base (335)..(335): a, c, t, g, unknown or other
  misc_feature (335)..(335): n is a, c, g, or t
  modified_base (433)..(433): a, c, t, g, unknown or other
  misc_feature (433)..(433): n is a, c, g, or t
  modified_base (494)..(494): a, c, t, g, unknown or other
  misc_feature (494)..(494): n is a, c, g, or t
tcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtggggggtcccagagactctcctgtgcagcctctgggctcaccgtcagcagcaactacatgagttgggtcccgccgaggctccgaggggaaggggctgggagtgggtcncgagtctatttatactggtgatttcacataactacgcagacctccgtgaacggcgattcacctatctccagggacaattccaggtaactacggtttancttacaaaatcgaaactaacctgaagaggcgaacgaccgacggtacccgtctagttaccgngtcggcgtaagacgaaaggttcggacggtccgttagggttgtttaggtttaagtttatttccggttttaggaccgtttcgggttcgggggcccgtaaaccggggg

SEQ ID NO: 319140 - DNA, 677 bp, Homo sapiens
  misc_feature: GZ8MTXP01A39KA.44.55.E11.1.454.CMB.2.raw
  modified_base (349)..(349): a, c, t, g, unknown or other
  misc_feature (349)..(349): n is a, c, g, or t
  modified_base (358)..(358): a, c, t, g, unknown or other
  misc_feature (358)..(358): n is a, c, g, or t
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagcgtggttcgtcctaggtggactttaaaggtgtcagtgtgaggtgcggctgatggagtctggaggaggcttagtccagccgtgggggtcccagagactctcctgtgcagcctcgtgggctcaccgtcagcagcaactacatgaggttcgggccgccaggctccgagggggaggggctgggagtgggtctcgagttctatttanacgttggtntatttcactataaacctacgcagtacctccggtaggaacgggcctattccaccctatccgtaccgaagggaacctaagtttacccgaaagggtaacctaacgggttttaactacctttaaacaaacgtacgaaaccgtaacgtaggaacggacggaccgaaccgtaccgaccggtaccttacgttaacgttacgtggtacgaacggtaacggaacgtacgggttccggtaccgtcggttagggttacggtttaggttttaactttacggtttcggtttacgtaccggtttacgggtccgggggttaacccgtaacgggg

SEQ ID NO: 319141 - DNA, 582 bp, Homo sapiens
  misc_feature: GZ8MTXP01C5BSG.44.55.E11.1.454.CMB.2.raw
tcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctggggggtcccagagactctcctgtgcagcctctgggctcaccgtcagcagcaactacatgagttggtccgccaggctccgaggggaaggggctgggagtgggtctcgagttcagtttatacgttgggtgtatttcactataactacgcagactccggtagaggggcctattccaccatctcgagggacaatcaaggaactacggttatcttacaaatcgaaactaacctgaacgaggaccgaacgacacggccgtactattactgtggaacgagacgaagttcggacggtcttcgggttgttggtttaattacgtttcggtttggacgtttcgtcgggggttcctaaccggggg

SEQ ID NO: 319142 - DNA, 570 bp, Homo sapiens
  misc_feature: GZ8MTXP01AYBEG.44.55.E11.1.454.CMB.2.raw
  modified_base (272)..(272): a, c, t, g, unknown or other
  misc_feature (272)..(272): n is a, c, g, or t
  modified_base (358)..(358): a, c, t, g, unknown or other
  misc_feature (358)..(358): n is a, c, g, or t
  modified_base (442)..(442): a, c, t, g, unknown or other
  misc_feature (442)..(442): n is a, c, g, or t
  modified_base (484)..(484): a, c, t, g, unknown or other
  misc_feature (484)..(484): n is a, c, g, or t
  modified_base (522)..(522): a, c, t, g, unknown or other
  misc_feature (522)..(522): n is a, c, g, or t
tcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctggggggtcccagagactctcctgtgcagcctcgtgggctcaccgtnagcagcaactacatgagttgggtcccgccaggctccgagggggaaggggctgggagtggggtctcgagtctaatttatacgtggtntatttcactataacctacgcagactccgtgaacggggccattcacatcctcgagggacagttaccaggtaactagttatcttanaaatgaaacactgagacggcacgcacgggcctactattaccngtggccgtaagaccaaggttcggaccgtcgttacgggnttggtttaattcgtttcgtttgacttcggtcggggttccgaaccgggg

SEQ ID NO: 319143 - DNA, 587 bp, Homo sapiens
  misc_feature: GZ8MTXP01DYN2K.44.55.E11.1.454.CMB.2.raw
  modified_base (356)..(356): a, c, t, g, unknown or other
  misc_feature (356)..(356): n is a, c, g, or t
  modified_base (446)..(446): a, c, t, g, unknown or other
  misc_feature (446)..(446): n is a, c, g, or t
tcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtgggggtcccagagactctcctgtgcagccctcgtgggctcaccgtcagcagcaactacatgagttgggtcccgccaggctccgaggggaaggggctgggagtgggtctcgagtcatttatactggtntatttcactataacctacgcagacctccggtagaacggggccattccaccatcctccgagggaccaagttccaaggtaactacggtttancttacaaattgaaacaacctgagaggcgaacgacacggaccgtctattacgtgtgaacgagacaaggttcgcgtcgttcgggttgttgggtttaatttagtttcggtttagaccgttcggttcgggggcccgtaaccgggg

SEQ ID NO: 319144 - DNA, 643 bp, Homo sapiens
  misc_feature: GZ8MTXP01AIH9D.44.55.E11.1.454.CMB.2.raw
  modified_base (275)..(275): a, c, t, g, unknown or other
  misc_feature (275)..(275): n is a, c, g, or t
  modified_base (288)..(288): a, c, t, g, unknown or other
  misc_feature (288)..(288): n is a, c, g, or t
  modified_base (301)..(301): a, c, t, g, unknown or other
  misc_feature (301)..(301): n is a, c, g, or t
tcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaggtgtccagtgtgaggtgcggctgatggagtcgtggaggaggcttagtccagccgtgggggtcccagagactctcctgtgcagcctcgtgggcctcaccgtnagcagcaactacntgagttcggtccnccgaggctccgaggggagggctgggagtgggtctcgagtctatttatcgtggtgtatttcgactataactacgcagtacctcccggagaacgggcctagttccaccgtatccgtaccgagggtaactaacgttacccgaggtaaaccgtacggtttaactcgtttaacaaagttcgaaacctaaccgtggaacgacgggaccgaacgaccgacggtccttacgtaattacgtcggtgaacgaagaccgaaggttccggacgtcggttacgggttgtttacgggtttaattgttttcggttacggtaccgtttccgggtcggggaaccccgttaacccggggg

SEQ ID NO: 319145 - DNA, 638 bp, Homo sapiens
  misc_feature: GZ8MTXP01BGK4C.44.55.E11.1.454.CMB.2.raw
  modified_base (264)..(264): a, c, t, g, unknown or other
  misc_feature (264)..(264): n is a, c, g, or t
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccaggccgtggggggtcccagagactctcctgtgcagccctntgggctcaccgtcagcagcaactacatgagttggtccgcaggctccgaggggaagggctgggagtgggtctcgagttcatttatactggtgtatttcgaactattaacctacgcagaccgtccggtaggaacggggccgtattccaccgtatccgtaccgaggggaaccaaagtttacccgaaggtaaactacggtttaatacttacaaaagtacgaaacgaacctaggaacgacgggacgaaccgacgaccgggtacccgttacttaagttacctggtacgaacgaagacgaaacgttcggacgtcgttcgggttgttagggtttaatttagtttcgtttggacctttcggtcggggttcccgtaaccggggg

SEQ ID NO: 319146 - DNA, 651 bp, Homo sapiens
  misc_feature: GZ8MTXP01DJDSW.44.55.E11.1.454.CMB.2.raw
  modified_base (481)..(481): a, c, t, g, unknown or other
  misc_feature (481)..(481): n is a, c, g, or t
  modified_base (542)..(542): a, c, t, g, unknown or other
  misc_feature (542)..(542): n is a, c, g, or t
tcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcgtctgatggagtctggaggaggcttagtccagccgtgggggtcccagagactctcctgtgcagcctctgggctcaccgtcagcagcaactacatgagtggccgcaggctccgaggggagggctgggagtgggtctcgagttctatttatacttggtgtactttcaactactaaccgtacgcacgtaccgtccggtaggaacggggtcctactttacccaaccctagttcccgtaccgaaggggtaacctaaacgttaccgaaagggtaacttaaccggtttataccttanaaaacttacgaaacgaaaccgtggaagacgggcgaaccgcgacggtccgttctaattacgngtgaacgaagacgtaacggttcggcgtccggttacgggttgtttagggtttaatttacgtttcggtttcggaccgtttcgggtaacgggggttcccgtaaacccggggg

SEQ ID NO: 319147 - DNA, 647 bp, Homo sapiens
  misc_feature: GZ8MTXP01C1BGT.44.55.E11.1.454.CMB.2.raw
  modified_base (297)..(297): a, c, t, g, unknown or other
  misc_feature (297)..(297): n is a, c, g, or t
  modified_base (341)..(341): a, c, t, g, unknown or other
  misc_feature (341)..(341): n is a, c, g, or t
  modified_base (349)..(349): a, c, t, g, unknown or other
  misc_feature (349)..(349): n is a, c, g, or t
tcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtcgtggaggaggcttagtccagccgtgggggtcccagagactctcctgtgcagcctcgtgggctcaccgtcagcagcaactacatgagttggccncaggctcgaggggagggctgggagtgggtctcgagtctatttanactgggtntatttcaacataacctacgcagactccgtagaacggggccattccaaccatcctaccgaagggactaaagttacccgaaacggtaaccgttacggtttactacgtaactaaagtacgaaacctaacgtaggaacgacgggaccgaaccgaccgaaccggtccgttacttaacgtaccttggcgaaccggaacgacggtaaacggttccgggacgtaccgttacgggttagtttacgggttttaatttacgtttcgtttcggaccgtttcgggtcggggttaacccggtaaacccgggg

SEQ ID NO: 319148 - DNA, 419 bp, Homo sapiens
  misc_feature: GZ8MTXP01D9G28.44.55.E11.1.454.CMB.2.raw
  modified_base (308)..(308): a, c, t, g, unknown or other
  misc_feature (308)..(308): n is a, c, g, or t
  modified_base (319)..(319): a, c, t, g, unknown or other
  misc_feature (319)..(319): n is a, c, g, or t
  modified_base (349)..(349): a, c, t, g, unknown or other
  misc_feature (349)..(349): n is a, c, g, or t
  modified_base (382)..(382): a, c, t, g, unknown or other
  misc_feature (382)..(382): n is a, c, g, or t
  modified_base (406)..(414): a, c, t, g, unknown or other
  misc_feature (406)..(414): n is a, c, g, or t
  modified_base (416)..(419): a, c, t, g, unknown or other
  misc_feature (416)..(419): n is a, c, g, or t
tcagacagtatatacacgaccggtgctcgatttagcactcgcacgctggagtgggtctcagtcatttatactggtgatttcacatactacgcagactccgtgaagggccgattcaccatctccagggacaattccaggaacacggtttatcttcaaatgaacaacctgagaggcgacgacacggccgtctattactgtgcgagacaagtcggcgctcggagtggttattattcgtttgacttctggggccaggggaactcggtcaccgtcgcctccgcctccaccaaggcccatcggtctcccctgcnccctcctccancgcacctcgtgggggcacagcggcctggcngcctggtcaaggctactcctaaatatctgtctnagcgggctggcaaggcgcgatagnnnnnnnnngnnnn

SEQ ID NO: 319149 - DNA, 633 bp, Homo sapiens
  misc_feature: GZ8MTXP01CZNJ1.44.55.E11.1.454.CMB.2.raw
  modified_base (349)..(349): a, c, t, g, unknown or other
  misc_feature (349)..(349): n is a, c, g, or t
tcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggtacttttaaaaggtgtccagtgtgaggtgcggctgatggagtcgtggaggaggcttagtccaggccgtgggggtcccagagactctcctgtgcagcctcgtgggctcaccgtcagcagcaactacatggagtggccgcaggctcgaggggaagggctggagtgggtctcgagtcatttagactggtntatttcacataactacgcagacgtccggtagaacgggctatcaccctattccaccgagggtacaaacgttcccgaaagggtaactaccgggttttaatacccgttaaaacaaaacgtacgtaaaccgtaaccggtaggaacggaacggaccgaaccgaccgtaccggtccttacttactacgtggtgaacgtacgaacgtacggttccggacgtacgttacgggttagtttacggtttaattacgtttcggttacgccgttcgggtaacgggaaccgtaacggg

SEQ ID NO: 319150 - DNA, 415 bp, Homo sapiens
  misc_feature: GZ8MTXP01BD9N4.44.55.E11.1.454.CMB.2.raw
  modified_base (405)..(405): a, c, t, g, unknown or other
  misc_feature (405)..(405): n is a, c, g, or t
  modified_base (410)..(415): a, c, t, g, unknown or other
  misc_feature (410)..(415): n is a, c, g, or t
tcagacagtatatacacgaccggtgctcgatttagcactcgcacgctggagtgggtctcagtcatttatactggttatttcacatactacgcagactccgtgaagggccgattcaccatctccagggacaattccaggaacacggtttatcttcaaatgaacaacctgagaggcgacgacacggccgtctattactgtgcgagacaagtcggcgctcggagtggttattattcgtttgacttcgtggggccagggaccctggtcaccgtcgcctcgcctccaccaggccatcggtctcccctggccaccctcctccaagacgcaccctcgtgggggcacgagccggccctgggctgcctggtccaaggctactcctataatactgtctgagcgggctggcaggcncatgnnnnnn

SEQ ID NO: 319151 - DNA, 674 bp, Homo sapiens
  misc_feature: GZ8MTXP01A0TBH.44.55.E11.1.454.CMB.2.raw
tcagacagtatatacacgaccggtgctcgatttagcactcgcacgttgggtttggggagcttcagctgtgggtagagaagacaggactcaggacgatctccagcatggccagcttccctctcctcctcaccctcctcactcactgtgcagggtcctgggcccagtctgtgatgtctcagccaccctcagcgtcgtcgggacccccgggcagggggtcaccatctcttgttctggaagagtccaatatcggatcttatcctgtcaactggatcgggactccgagccaccggccccccgatccttatctatgctactaatcagccgccctcgacgggtcccctgcccgtattcccctcgtggcctccaagtctggccactacgacggtcctaccgtcgggacctacgtccttgacttccctaccgtagtccgttagggagtacgttaggacggtccttaggtaactttaacgtacgttggtagtccgaggaccaggtttggggaacttacgggaccgtaacggggtacccgggtaaacggggtccggttgggggtacggtttccggggaccgttaagggaaccgggggtaaccttaacgggttccggaccccggttaaccgacgggttaaccgaccggaccccggttaacgggtcccgttcccggtcccccccggg

SEQ ID NO: 319152 - DNA, 634 bp, Homo sapiens
  misc_feature: GZ8MTXP01CHLIX.44.55.E11.1.454.CMB.2.raw
  modified_base (297)..(297): a, c, t, g, unknown or other
  misc_feature (297)..(297): n is a, c, g, or t
  modified_base (351)..(351): a, c, t, g, unknown or other
  misc_feature (351)..(351): n is a, c, g, or t
tcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtcgtggaggaggcttagtccagccgtgggggtcccagagactctcctgtgcagcctctgggctcaccgtcagcagcaactacatgagttggtccnccaggctcgaggggaagggctgggagtgggtctcgagtctatttatacgtggtnatttcactataaacctacgcaagtacctccggtaggaacgggcccgaattccaacctattccgtaccgaaggggtaactaaacgttacccgaaagggtaaacttaccgggtttaataccgttaacaaaagttcgaaaactaaccgtaggaacgacggacgaacgacgacgggacctctaagttctgtcgaacgaacgacgtaaggttccggcgtcgttacgggttgttacgggtttaatttacggttccgtttgaccgtttcggtcgggggccgtaaccgggg

SEQ ID NO: 319153 - DNA, 648 bp, Homo sapiens
  misc_feature: GZ8MTXP01DG69E.44.55.E11.1.454.CMB.2.raw
  modified_base (370)..(370): a, c, t, g, unknown or other
  misc_feature (370)..(370): n is a, c, g, or t
  modified_base (537)..(537): a, c, t, g, unknown or other
  misc_feature (537)..(537): n is a, c, g, or t
tcagacagtatatacacgaccggtgctcgatttagcactcgcacgttgggtttggggagaggagcccagcactgggattccgaggtgtttccattcggtgatcagcactgaaacacagaggactcaccatggagttttggctgagctgggttctccttgttggacttttaaaaggtgtccagtgtgaggtgcggctgatggagtcgtggaggaggcttagtccagccgtgggggtcccagagactctcctgtgcagcctgtgggctcaccgtcagcagccaactacatggaggttcgggtcccgccgagggcctaccggagggggaaggggtcgtgggagtcgggtctcgagttctatttatacgtggtntactttcacattaaccacgctagacccgtccgtaggaacgggtcccgtatttacccgacctattcctaccgaagggtacctaaagtttcccgaaagggtaacctacggtttactacgttacaaaatcgaaactaccgtagagacggcgaacgaccgtacggaccttnttacttacgtgtacgaacgtaagaacgtaaggttcggccgtcggttacggttaggtttgggtttaattacgtttcgtttgaccgttcggtcggggttccgtaaacccgggg

SEQ ID NO: 319154 - DNA, 629 bp, Homo sapiens
  misc_feature: GZ8MTXP01CUL5E.44.55.E11.1.454.CMB.2.raw
  modified_base (238)..(238): a, c, t, g, unknown or other
  misc_feature (238)..(238): n is a, c, g, or t
  modified_base (241)..(241): a, c, t, g, unknown or other
  misc_feature (241)..(241): n is a, c, g, or t
  modified_base (249)..(249): a, c, t, g, unknown or other
  misc_feature (249)..(249): n is a, c, g, or t
  modified_base (334)..(334): a, c, t, g, unknown or other
  misc_feature (334)..(334): n is a, c, g, or t
  modified_base (484)..(484): a, c, t, g, unknown or other
  misc_feature (484)..(484): n is a, c, g, or t
tcagacagtatatacacgaccggtgctcgatttagcactcgcacgttgggtttggggggagaggagcccagcactgggattccgaggtgtttccattcggtgatcatcactgaacacagaggactcaccatggactttgggctgagattgggttttcctcgttgcttcttttaagaggtggccagtgtcaggtgcagctagtggagtcgtgggggagagcggccagccgtggactccnganctctctgngcagcctcgtggattcatctcgaggacctatgccatgcacgtcgggtcccgcagcctacgaggcgaagggggctgggaggtgggngactaagttatactcaaggaagtagtacggaaaattgaaacgaaacacgttaaacgggagaccgtaccggaagggaacgggaccgtattccgaaccgtctaccgaagaacgaactaacgtaccgaacgaaacacaactcgacactcgtanactaaagtcaacctaacctacaactaaaggtacgaacggacgtaaccggtcttacgttacttattttacgttggttacgttaccgacgaacccggtaccccgtaacggaccggtacccgggttccccgtaacgtttcggaacccg

SEQ ID NO: 319155 - DNA, 590 bp, Homo sapiens
  misc_feature: GZ8MTXP01DHI50.44.55.E11.1.454.CMB.2.raw
  modified_base (240)..(240): a, c, t, g, unknown or other
  misc_feature (240)..(240): n is a, c, g, or t
  modified_base (251)..(251): a, c, t, g, unknown or other
  misc_feature (251)..(251): n is a, c, g, or t
  modified_base (281)..(281): a, c, t, g, unknown or other
  misc_feature (281)..(281): n is a, c, g, or t
  modified_base (285)..(285): a, c, t, g, unknown or other
  misc_feature (285)..(285): n is a, c, g, or t
  modified_base (291)..(291): a, c, t, g, unknown or other
  misc_feature (291)..(291): n is a, c, g, or t
  modified_base (294)..(294): a, c, t, g, unknown or other
  misc_feature (294)..(294): n is a, c, g, or t
  modified_base (306)..(306): a, c, t, g, unknown or other
  misc_feature (306)..(306): n is a, c, g, or t
  modified_base (308)..(308): a, c, t, g, unknown or other
  misc_feature (308)..(308): n is a, c, g, or t
  modified_base (311)..(311): a, c, t, g, unknown or other
  misc_feature (311)..(311): n is a, c, g, or t
  modified_base (316)..(316): a, c, t, g, unknown or other
  misc_feature (316)..(316): n is a, c, g, or t
  modified_base (327)..(327): a, c, t, g, unknown or other
  misc_feature (327)..(327): n is a, c, g, or t
  modified_base (428)..(428): a, c, t, g, unknown or other
  misc_feature (428)..(428): n is a, c, g, or t
  modified_base (435)..(435): a, c, t, g, unknown or other
  misc_feature (435)..(435): n is a, c, g, or t
  modified_base (453)..(453): a, c, t, g, unknown or other
  misc_feature (453)..(453): n is a, c, g, or t
  modified_base (493)..(493): a, c, t, g, unknown or other
  misc_feature (493)..(493): n is a, c, g, or t
tcagacagtatatacacgaccggtgctcgatttagcactcgcacgttgggtttggggagaggagcccagcactgggattccgaggtgtttccattcggtgatcagcactgaacacagaggactcaccatggagtttttggctgagcgtggttcgtcctaggttggactttaaaaggtgtcagtgtgaggtgcggctgatggagtctggaggaggcttagccagccgtgggggtcccaganctctcctgtgnagccctgtggctcacgtcagcagcaactangtgngtcgcncgngcacggaggagngnggngtgtngtagtctattntagtgtatattcaactactaactacgcgacgtaccgtcgtaggacggtctactccactatccgacgaacgtaactaacgtacgaagttaaccttacgttanactaaanaaagtacgaaacgtacgnggacgacggacgaacgacgtaccgtcttaagtcgttacgnggtagaacgaaggttacgacggttccggcgtgttagggttgtttagtttaacttcgtttcggttcgtacggtttcgggtccgggaaccgtaaccggg

SEQ ID NO: 319156 - DNA, 685 bp, Homo sapiens
  misc_feature: GZ8MTXP01AI12L.44.55.E11.1.454.CMB.2.raw
  modified_base (300)..(300): a, c, t, g, unknown or other
  misc_feature (300)..(300): n is a, c, g, or t
  modified_base (457)..(457): a, c, t, g, unknown or other
  misc_feature (457)..(457): n is a, c, g, or t
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtgggggtcccagagactctcctgtgcagcctctgggctcaccgtcagcagcaactacatgagttggtcccnccaggctaccgaggggagggctgggagtgggtctcgagtctatttatacgtggtgtatttcacataacctacgcagacctccgtaggaacgggccattccaacctatccgtacgaacgggaactaacgttacccgaagggtaacctacggttttaanacctttaacaaagtcgaaaccaacgtaggagaacgggaccgaacgaccgaacccgggtccttactaacgttaacctggtacgaaccggaaacgaaccggaaacgttcccggggacgtcccggttacgggggttaacgtttacggggttttaaacttttaggttaaccggtttttcgggaaccccgtttttgggtaacccggggggttaaccccgtaaaccccgggggg

SEQ ID NO: 319157 - DNA, 662 bp, Homo sapiens
  misc_feature: GZ8MTXP01C74HT.44.55.E11.1.454.CMB.2.raw
  modified_base (573)..(573): a, c, t, g, unknown or other
  misc_feature (573)..(573): n is a, c, g, or t
tcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaggtgtccagtgtgaggtgcggctgatggagtcgtggaggaggcttagtccaggccgtgggggtcccagagactctcctgtgcagcctcgtgggcctcgaccgtcagcagaccaaactacagtggtaggttcggggtccccgaccgaggggccgtaccggaagggggaacgggggcgtgggaggtcgggttctcgtagttactatttagtacgttggttagtatttccaacgtactaaaccgtacgcacgtacccgttaccgggtacggaacgggtccgtactccaacccgtatccgtaccgaggtaacctaacgttaccgaggtaacttacggttatactacaaagtcaaacgacctgaaggacggacgaaccgacgacggtacgttcttaagttacgtggngaaccgagacgtagggttccgagtcgttacgggttgtttaggtttaattcgtttcgttacgcgtttcgggtccgggaacgtaaccgggg

SEQ ID NO: 319158 - DNA, 605 bp, Homo sapiens
  misc_feature: GZ8MTXP01E4TOD.44.55.E11.1.454.CMB.2.raw
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtgggggtcccagagactctcctgtgcagcctctgggctcaccgtcagcagcaactacatgagtggccgccaggctccgagggagggctggagtgggtctcagtctatttatactggtgtatttcactataaactacgcacgtactccggtagaacgggccgaattcacccatcctaccgagggacaattaccgaaggtaactacggtttaatctaacaaatacgaaacaacctagaaggacggacgaacgaccgaaccggccgtacgtacttaactgtggaacgtaacgaacgaaacggttccgggacgtccgttacgggttggttaggtttaattagtttcgtttgtacgttcgtaacggggcccgtaaccgggg

SEQ ID NO: 319159 - DNA, 656 bp, Homo sapiens
  misc_feature: GZ8MTXP01AWDXB.44.55.E11.1.454.CMB.2.raw
  modified_base (262)..(262): a, c, t, g, unknown or other
  misc_feature (262)..(262): n is a, c, g, or t
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaggtgtccagtgtgaggtgcggctgatggagtcgtggaggaggcttagtccagccgtgggggtcccagagactctcctgtgcagcctcngggctcaccgtcagcagaactacatgagtcggtccgccgcggcgtcccgaggggaggggcgtggaggtggtcgtcagtcgtatttagtactggtgtattactacactactaaaccgcaacgacgtaccggtacgagggacccgtatcaccactcgtaccgaacgggacaactttaccgaacggtaacgttaccggtttacttacttactaaatacgtaaaccaccgtaacggaggacggaccgaacgtaccgaccggtaccgtccgtaattaccgtagtcggacgaacgtaacgacggtacggcccgtacggtcggttagggtttcggtttagttttaacgtttcggtttcggttagttccgggttcgggtcccgggttaacggtaaccccggg

SEQ ID NO: 319160 - DNA, 622 bp, Homo sapiens
  misc_feature: GZ8MTXP01EL6VZ.44.55.E11.1.454.CMB.2.raw
  modified_base (410)..(410): a, c, t, g, unknown or other
  misc_feature (410)..(410): n is a, c, g, or t
  modified_base (454)..(454): a, c, t, g, unknown or other
  misc_feature (454)..(454): n is a, c, g, or t
  modified_base (515)..(515): a, c, t, g, unknown or other
  misc_feature (515)..(515): n is a, c, g, or t
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaggtgtccagtgtgaggtgcggctgatggagtcgtggaggaggcttagtccagccgtgggggtcccagagactctcctgtgcagcctcgtgggctcaccgtcagcagcaactacatgaggttcggccgccaggctccgaggggaaggggctgggagtgggtctcgagttctatttatactggtgtatttcactataacctacgcagtacctccggtgaacggggtccgattccaccntcctaccgagggaccaactttaccgaaggtaacctacggtttancctttaacgaaaattcgaaacctaaccttggaacggacggacgaccgacgtacgggccttntaattactgtcgcgaacgttacgaggttccggcgtcttacggggttgtttgggtttaatttacgtttcggtttacggacgtttcgtcgggggccccgtaaccggggg

SEQ ID NO: 319161 - DNA, 655 bp, Homo sapiens
  misc_feature: GZ8MTXP01D5T4E.44.55.E11.1.454.CMB.2.raw
  modified_base (628)..(628): a, c, t, g, unknown or other
  misc_feature (628)..(628): n is a, c, g, or t
tcagacagtatatacacgaccggtgctcgatttagcactcgcacgttgggtttggggagcttcagctgtgggtagagaagacaggactcaggacgatctccagcatggccagcttccctctcctcctcaccctcctcactcactgtgcgagggtcctgggcccagtctgtgatgtctcacgcccaccctcagcgtccgtcgggaccccggcgagggggtcaccatctcttgttcgtaggaagtaagtaccaatatcggtattcttatcctgtacaacgtggtacgtcggggacctccgaacggccgaccccggtccccccgtactccttactcgtaatcgtactaactaactcacggcccggtccctcggaccgggtccctcgtcccgtacttccctcgtcggacctacccgtaagtccgtacggcctaacgttaacgacgggtcctaacccgtcggaccctaacttcccgtagacttccgcgtaagtcgtaggagtagtcggaaggtctagtaaactttcgtacgtgtcggacacggacaggttagggatacggacgtacggacccgggtaaggtcggtaagggtcggttacgggaggacggtaacgtagttcgacgttcgtggacncgtaccgacggctcccgcccgttaacg

SEQ ID NO: 319162 - DNA, 726 bp, Homo sapiens
  misc_feature: GZ8MTXP01CZF8Q.44.55.E11.1.454.CMB.2.raw
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgcgttctccttgttggacttttaaaaggtgtccagtgtgaggtgcggctgatggagtctggaggaggcttagtccagccgtgggggtcccagagactctcctgtgcagcctcgtgggactcaccgtcagcagcaactacatgagttcggcccgcgaggcctccggagggggaaggggctggaggtgggtctcgagtctatttataccttggtagtatttcactaattaactcgacagacctcggtagaacgggtcgacttccaccaatccgtacccgaagggtaccctaaagttccccgaaagggtaaaccttacggtttactactttaaccaaaagttcggggaaaacctaaacccgtagggaacggaacgggccgtaaaccggaccgtaaaacccggggttcccgttaacttaacttttaaccgggtggtaacggacggttaaacgaaccggttaacgggttcccggggtcggttacgggtttcggggttaggttttaacgggtttttaaacgttttcggttttccgggttttacggttaccggttttccggggttaacccggggggtaacccgg

SEQ ID NO: 319163 - DNA, 686 bp, Homo sapiens
  misc_feature: GZ8MTXP01DVJ0J.44.55.E11.1.454.CMB.2.raw
  modified_base (210)..(210): a, c, t, g, unknown or other
  misc_feature (210)..(210): n is a, c, g, or t
  modified_base (234)..(234): a, c, t, g, unknown or other
  misc_feature (234)..(234): n is a, c, g, or t
  modified_base (260)..(260): a, c, t, g, unknown or other
  misc_feature (260)..(260): n is a, c, g, or t
  modified_base (271)..(271): a, c, t, g, unknown or other
  misc_feature (271)..(271): n is a, c, g, or t
  modified_base (358)..(358): a, c, t, g, unknown or other
  misc_feature (358)..(358): n is a, c, g, or t
tcagacagtatatacacgaccggtgctcgatttagcactcgcacgttgggtttggggagcttcagctgtgggtagagaagacaggactcaggacgatctccagcatggccagcttccctctcctcctcaccctcctcactcactgtgcagggtcctgggcccagtctgtgatgtctcagcccaccctcagcgtcgtcgggacccccgggngagggggtcaccatctcttgttcnggaagagtcaatatcggatctatctntcaactggtancgggactcccgaggccaccggccccccgactccttatctatgactactaatcagccggccctcgacgggtcctcgcccgatttcccncgtgcctacaagtcgtgcactacgacggcctaccgtggacctatcccttgtactcgtccgtagtctaggagtgtaggaggtcttaaggaactttaccgtaacggtggttacgaccaaggtccgtaagtggggtaactacggaaccgaacggggtacccgggaaacggtccgggttaagggggttccgggttacggggggaaccgggttaacgggggtaaacccgtaacggggtttccgggttaccccgggttaccggtttaacgggtccgaacccggtaccccggtaacgggttccccggtccccggttccccccggtttaaccccgg

SEQ ID NO: 319164 - DNA, 733 bp, Homo sapiens
  misc_feature: GZ8MTXP01EG58Q.44.55.E11.1.454.CMB.2.raw
  modified_base (544)..(544): a, c, t, g, unknown or other
  misc_feature (544)..(544): n is a, c, g, or t
tcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcggctgagtggagtcgtggaggaggtcttagtccaggccggtgggggtcccagacgactctcctgtgcacgcctcgtgggctcgaccgtcagcagaccaactacagtggtacggttcgggtcccgaccgacggccgtaccgggaagggggaacggggtcgtaggggtacggttcgggttctacgtagttacttaagttttacgtacgttggtagtactttacaactacttaaaccgtacgcgtacgtaccgttaccgggtagggaaacggggtcctaactttacccaacctacgttcccgtaacggaacgggtaacctaaagtttacccgaaacgggtaaccttaacggtttanacttaaacaaagtacgaaaccgtacgtaggaacggacgaccgaaccgacgtaccggtaccttactacgttacgtcggacgaacgtaacgacgtaacggttcggacgtccggttagggttcgtttacggttttaaatttcgttcggtttacggaccgtttacgggtccggggaacccgttaacccggggg

SEQ ID NO: 319165 - DNA, 664 bp, Homo sapiens
  misc_feature: GZ8MTXP01C6RRM.44.55.E11.1.454.CMB.2.raw
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggtacttttaaaaggtgtccagtgtgaggtgcggctgatggagtcgtggaggaggcttagtccaggccgtgggggtcccagagactctcctgtgcagcctcgtggctcgaccgtcagcagacaactacagtgtaggttcgggtcccgccgaggcctaccggagggggaaggggcgtagggtaggttcgggtctcgagttactaagttttacgtaacgttgggtagtattttaccaactaacttaaaccgtacgcagtaccgtaccgggtaggaacgggccgtacttacccgacctatccgtaccgaagggtaactaacgtacccgaaaggtacctaacggtttatacgtacaaatcgaaaccgtacgtaggaacgacggacgaaccgacgacggtaccgtactagtaccgtgtcgaaccgtaagacgtagttcggacgtcgttaggttagttcgtttaattacgtttcgttcggcgttacggtcggggcccgtaaccgggg

SEQ ID NO: 319166 - DNA, 741 bp, Homo sapiens
  misc_feature: GZ8MTXP01BEWAP.44.55.E11.1.454.CMB.2.raw
  modified_base (290)..(290): a, c, t, g, unknown or other
  misc_feature (290)..(290): n is a, c, g, or t
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaggtgtccagtgtgaggtgcggctgatggagtcgtggaggaggcttagtccaggccgtgggggtcccagagactctcctgtgcagcctcgtgggctcaccgtcagcagacaactacntggaggttcgggcccgccgaggtccgtaccggaagggggaacgggggctaggggaggtcgggtctcgagttctaatttagtacgttggtgtactttacgaactaacgtaaaccgttaaccgcaacggtaaccgttcccgggtaagggaaccgggggtccctaaactttcccgaaacccttacgtaccgttacccggaaaggggtaacctaacgtttacccgaaacgggtaaaccttacgggtttaactacttaacgaaaagttacgaaaccgtaaccgtaggaaccgacgggaccgaacggacccgacgggtacccgttacttacgttaacgtcgtgaaccggaacgttaacgtaacggttcggaccggttcgttacggggttagtttacggttttaattacgtttcgtttaggaccgtttacgggtccgggttaacccggtaaaccgggg

SEQ ID NO: 319167 - DNA, 647 bp, Homo sapiens
  misc_feature: GZ8MTXP01EG6QD.44.55.E11.1.454.CMB.2.raw
  modified_base (265)..(265): a, c, t, g, unknown or other
  misc_feature (265)..(265): n is a, c, g, or t
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggtacttttaaaaggtgtccagtgtgaggtgcggctgagtggagtcgtggaggaggcttagtccagccgtgggggtcccagagactctcctgtgcagcctgngggctcaccgtcagcagcaactacatgagttgggccgcaggctccgaggggaagggctgggagtgggtctcgagttcatttatacgttggtgtactttcactataacctacgcacgtacctccggtagacgggcccgtattccaccatcctacgagggacctaaagtttcccgaagggtaacctaacggtttactacgttaacaaaagttcgaaactaaacccgttggaaacgacgggaccgaacgacccgtacggaccccgtttataagttaccgtggtaagccggtaagaaccgtaaggttccggaccggtcttacgggttgtttacgggtttaatttagtttcggttttcgacgtttccggtcgggggccctaacgggg

SEQ ID NO: 319168 - DNA, 709 bp, Homo sapiens
  misc_feature: GZ8MTXP01C0852.44.55.E11.1.454.CMB.2.raw
  modified_base (205)..(205): a, c, t, g, unknown or other
  misc_feature (205)..(205): n is a, c, g, or t
  modified_base (531)..(531): a, c, t, g, unknown or other
  misc_feature (531)..(531): n is a, c, g, or t
  modified_base (605)..(605): a, c, t, g, unknown or other
  misc_feature (605)..(605): n is a, c, g, or t
tcagacagtatatacacgaccggtgctcgatttagcactcgcacgttgggtttggggggagaggagcccagcactgggattccgaggtgtttccattcggtgatcagcactgaacacagaggactcaccatggtagttttggctgagtcgttgggtttcttcctttgttaggtaacttttaaaaggtgtcagtgtgaggtgcggntgatggagtcgtgggaggaggtcttagtccgaggtccggtcgggggtcccaggacgactctccgtgtgcagcctcgtcggctcgaccgtcagcacgacaactacagtggtacggtttcgggccccgaccgacgggccgtaccggaaggggggtaacggggtccgttagggggaggttcgggggttctacgtagttacgttaattttacgtacgttcggttgttactttcaacgtataaaccgtacgcaagtacctacggtaggaacggtccgtattcccaactatccgtacgaggtaacctaagtaccgaaggtaactacgtttanacttaacaaatacgaaactaaccgtggaaacgaccggacaacccgtacgaccggttaccctattaacgtttcgngtacggaaccgaagttacgtaacggccggtcgtcgttagggttagttcggtttaattacgtttcggttacgtcgttccggggtaacgggaacccgttaaccggg

SEQ ID NO: 319169 - DNA, 678 bp, Homo sapiens
  misc_feature: GZ8MTXP01B6L32.44.55.E11.1.454.CMB.2.raw
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtgggggtcccagagactctcctgtgcagcctcgtgggctcaccgtcagcagcaactacatgaggttcggcccgccaggctccgagggggaaggggctgggagtgggtctcgagttctatttactacgttggtgtatttcactattaacctacgcaacgtacctaccggtaggaacggggccctattaccgaccctataccgtacccgaagggtaacctaaacgttaccccgaagggtaaacctacggtttactactttaacaaaagtcgaaaccaaccgttggaacgacggaccgaaccgacgaccggtacccgttacttaagttaccgtggtcgaacggaagaaccgtaacgggttccggacgtcggttacgggttagtttggttttaaattcgtttccggttttggacccgtttcgggtaacgggggttaacccgtaaacccggggg

SEQ ID NO: 319170 - DNA, 778 bp, Homo sapiens
  misc_feature: GZ8MTXP01ECO3Y.44.55.E11.1.454.CMB.2.raw
  modified_base (354)..(354): a, c, t, g, unknown or other
  misc_feature (354)..(354): n is a, c, g, or t
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtgggggtcccagagactctcctgtgcagcctcgtgggctcaccgtcagcagcaactacatgaggttgggtccgccaggctccgaggggaagggctggagtgggtctcgagtcatttatactggtntatttcactataaacctacgcgtaacgtacgtccggtaggaacgggccgtaatttccgaaccctagttcctacccgaaggggtaacctaaacgtttacccgaagggtaaacctacgggttttaactaccgtttaacaaaattcggtaaaaccgtaaccccgttaggggaaacggtaaacggggaccggtaaacccggaaccgtacccggggtaccgtttaccgtttaaacgtttaaccgttcgggttacgggaacccgtaaagggttaacccgtaaacggggttccgggtaccggtaccggtttaacccgggggttaaggtttaccgggggtttttaaagttttaacgttttccggggtttttacggtaaacccgtttttccgggggtaaccggggggttaacccccgttaaaacccggggggg

SEQ ID NO: 319171 - DNA, 658 bp, Homo sapiens
  misc_feature: GZ8MTXP01BR87K.44.55.E11.1.454.CMB.2.raw
tcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtgggggtcccagagactctcctgtgcagcctctgggctcaccgtcagcagcaactacagtgaggttcggtccgcaggctccgaggggaagggctggagtgggtctcgagttctatttatcgtggtgtatttcactataaactacgcagtaccgtccgtaggaaacgggccgatttccaccctatacccgtaccgaaggggtaaccaaagtttaccccgaaagggtaaaccttacgggttttaactccttaacgaaaagttccgaaaaccgtaacccgtaggaacgacgggaccgaaccggacgtaccggtccgtacttattacgtggtcggaacgaaggttacccgaaagggttccgcgtacttccggggagttacgggttttaatagtttccggtttgaccgttcggtaacgggggttccgtaaccggggg

SEQ ID NO: 319172 - DNA, 666 bp, Homo sapiens
  misc_feature: GZ8MTXP01AD256.44.55.E11.1.454.CMB.2.raw
  modified_base (571)..(571): a, c, t, g, unknown or other
  misc_feature (571)..(571): n is a, c, g, or t
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtgggggtcccagagactctcctgtgcagcctcgtgggctcaccgtcagcagcaactacatggaggttcgggtcccgccgaggcctccggaagggggaagggggcgtggggaggtggggtctcgagttctatttatacgtggtcgtatttcaactataactacgcacgaccgttccggtaggaacgggtccgtattaccaccctagttccgtaccgaacgggaacctaaacgttaccgaaagggtaacctacgggttttactaccgtttaacaaaacgttacgaaactaaaccgtaggaaggaacggaccgaaccgaccgaccgggtcccttctaattaccgngtggaacgaagaacgtaaggttccggcgtcgttcgggttagtttgggtttaattgtttcgtttcgacgtttcggtcggggaaccgtaacccgggg

SEQ ID NO: 319173 - DNA, 721 bp, Homo sapiens
  misc_feature: GZ8MTXP01BNPGA.44.55.E11.1.454.CMB.2.raw
  modified_base (264)..(264): a, c, t, g, unknown or other
  misc_feature (264)..(264): n is a, c, g, or t
  modified_base (603)..(603): a, c, t, g, unknown or other
  misc_feature (603)..(603): n is a, c, g, or t
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtgggggtcccagagactctcctgtgcagccctcgngggctcgaccgtcagcagacaactacagtgaggttcgggtcccgccgagggccctacccggaaggggggaacgggggtcgtgggtaggtcggggtctcgagttactaattttatacgttggtgtactttcgactactaaacctacgcacgaccgtcccgggtagggaacggggcccgtagttcccaccgtaacgtccgtacccgaaggggaacctaacgtttacccgaagggtaaacctacgggttttactacttaactaaaagtcgaaaacgtacccgtgggaacgacgggtccgaaaccggaccgtaccgggtacccgttacttaaacgttttccgngggtcgaaccggaacgttaaacgaacgggttccggccggtacgttgggttacgttggtttaattacgtttcggttttggacctttcggggtaacgggggttaacccgtaacccggggg

SEQ ID NO: 319174 - DNA, 560 bp, Homo sapiens
  misc_feature: GZ8MTXP01ECN2H.44.55.E11.1.454.CMB.2.raw
  modified_base (348)..(348): a, c, t, g, unknown or other
  misc_feature (348)..(348): n is a, c, g, or t
  modified_base (431)..(431): a, c, t, g, unknown or other
  misc_feature (431)..(431): n is a, c, g, or t
  modified_base (498)..(498): a, c, t, g, unknown or other
  misc_feature (498)..(498): n is a, c, g, or t
  modified_base (506)..(506): a, c, t, g, unknown or other
  misc_feature (506)..(506): n is a, c, g, or t
tcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctgggggtcccagagactctcctgtgcagcctctgggctcaccgtcagcagcaactacatgagttggtccgcaggctccgaggggaagggctggagtgggtctcagttcatttatactggtntatttcactataactacgcagactccgtagaacgggccgattcaccatctcagggacagttaccaggaactacggttatctanaaatgaaacaactgagtacggcgaacgacacggtcctatatactgtgaacgagacgaagttcgggcncgttcggngttaggtttaattatttcggtttcgtacgtttcgtcggggttccgtaaccgggg

SEQ ID NO: 319175 - DNA, 623 bp, Homo sapiens
  misc_feature: GZ8MTXP01EPHBQ.44.55.E11.1.454.CMB.2.raw
  modified_base (261)..(261): a, c, t, g, unknown or other
  misc_feature (261)..(261): n is a, c, g, or t
  modified_base (343)..(343): a, c, t, g, unknown or other
  misc_feature (343)..(343): n is a, c, g, or t
  modified_base (350)..(350): a, c, t, g, unknown or other
  misc_feature (350)..(350): n is a, c, g, or t
  modified_base (398)..(398): a, c, t, g, unknown or other
  misc_feature (398)..(398): n is a, c, g, or t
tcagacagtatatacacgaccggtgctcgatttagcactcgcacgttgggtttgggggagaggagcccagcactgggattccgaggtgtttccattcggtgatcagcactgaacacagaggactcaccatggagttttggctgagcgtggttctccttagttggacttttaaaaggtgtcagtgtgaggtgcggctgatggagtctggaggaggcttagtccagccgtggggggtcccagagactctcctgtgcagcctcngggctcaccgtcagcagcaatacatgagttggccgcaggctccgagggggaaggggctgggagtggggtctcagtcatttanactggtntatcactataacacgcagtaccgtcggaggaacgggctattaccactntcctaccgaagggtaactaacgttaccgaacggtaaacttacgtttaactccttaaacgaaaatacgaaaccgtaacgtagggaacggaacggaccgaacgaccgtacggtaccgttacttaacttacgtcggtggaacgtaagaacgtacggttcggcgtacgttcgggttagttaggtttaattagtttcgttacgtcgttacgggtcgggaaccgtaacggg

SEQ ID NO: 319176 - DNA, 552 bp, Homo sapiens
  misc_feature: GZ8MTXP01E0OWX.44.55.E11.1.454.CMB.2.raw
  modified_base (255)..(255): a, c, t, g, unknown or other
  misc_feature (255)..(255): n is a, c, g, or t
  modified_base (308)..(314): a, c, t, g, unknown or other
  misc_feature (308)..(314): n is a, c, g, or t
  modified_base (316)..(316): a, c, t, g, unknown or other
  misc_feature (316)..(316): n is a, c, g, or t
  modified_base (318)..(318): a, c, t, g, unknown or other
  misc_feature (318)..(318): n is a, c, g, or t
  modified_base (320)..(320): a, c, t, g, unknown or other
  misc_feature (320)..(320): n is a, c, g, or t
  modified_base (322)..(322): a, c, t, g, unknown or other
  misc_feature (322)..(322): n is a, c, g, or t
  modified_base (324)..(325): a, c, t, g, unknown or other
  misc_feature (324)..(325): n is a, c, g, or t
  modified_base (328)..(328): a, c, t, g, unknown or other
  misc_feature (328)..(328): n is a, c, g, or t
tcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctgggggtcccagagactctcctgtgcacgnccgtcgtcggccgtccgaccgtacgacgacacgacaactacgtacgtagtacnnnnnnncncncncncnntcnctctctcgtcgtcgtacgtacgtacgtactctctacgtacgtcgtcgtacgtactacgtactacgtaccgtacgtacgtacgtacgtacgtaccgtaccgtaccgtaccgtaccgtaccgtaaccgtacgttaccgtaccgttaccgtaccgtaaccgttaccgttaccgttaccgtaaccgtacgtaaccgtaccgtacgttaacgtaaccgttaacgtaacg

SEQ ID NO: 319177 - DNA, 735 bp, Homo sapiens
  misc_feature: GZ8MTXP01AFF1Y.44.55.E11.1.454.CMB.2.raw
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggagcttagtccagccgtgggggtcccagagactctcctgtgcagcctcgtgggctcaccgtcagcagcaactacatggagttcggtcccgccgaggctccgaggggaggggctgggagtgggtctcgagtctatttatacgtcggtagtatttcacataaaccacgcagaccgtccgtaggaacgggtccgaacttccaacctactccgtacccgaaaggggtaacctaaacgtttaccccgaaagggtaaacccgttaaccgggtttttaactacccttttaaaccgaaaacgtttaccgggaaaaccctaaaacccgttagggaaaccgggtaaacggggacccgtaaaccggacccgtaccgggtaccccggttacttaacgtttaacccgtggttcgaacggaacgaccgtaaacggttccgggacggtccgttacggggttacggtttgggtttaactttacgtttaaccgggttttacggtaccgtttccggtcgggggttcccgtaaacccggggg

SEQ ID NO: 319178 - DNA, 659 bp, Homo sapiens
  misc_feature: GZ8MTXP01DXJWQ.44.55.E11.1.454.CMB.2.raw
  modified_base (266)..(266): a, c, t, g, unknown or other
  misc_feature (266)..(266): n is a, c, g, or t
  modified_base (481)..(481): a, c, t, g, unknown or other
  misc_feature (481)..(481): n is a, c, g, or t
  modified_base (547)..(547): a, c, t, g, unknown or other
  misc_feature (547)..(547): n is a, c, g, or t
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtcgtggaggaggcttagtccaggccgtgggggtcccagacgactctcctgtgcagcctcgnggctcaccgtcagcagacaactacagtgaggttcgggtcccgccgagggcctaccggaagggggaacgggggctggggtaggtcgggtctcgagtctaatttatacgtggtgtatttcactataaacctacgcaagacctcggtagaacgggccgtattaccacctaatcccgtacgaagggtacctaacttcccgaagggtaactacggtttanacctaactaaatcgaaacacgtgaacgtacggaccgacgaccgtacggcccgttactaagttacgnggtacgaacggtaacgaccgtaaggttccgggtccgtacgttcgggttagttcgggtttaaactttgttccggtttgtaaccgttcggtccgggggaaccctaacccggggg

SEQ ID NO: 319179 - DNA, 565 bp, Homo sapiens
  misc_feature: GZ8MTXP01EMC25.44.55.E11.1.454.CMB.2.raw
  modified_base (478)..(478): a, c, t, g, unknown or other
  misc_feature (478)..(478): n is a, c, g, or t
  modified_base (501)..(501): a, c, t, g, unknown or other
  misc_feature (501)..(501): n is a, c, g, or t
  modified_base (505)..(505): a, c, t, g, unknown or other
  misc_feature (505)..(505): n is a, c, g, or t
  modified_base (516)..(516): a, c, t, g, unknown or other
  misc_feature (516)..(516): n is a, c, g, or t
tcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtggggggtcccagagactctcctgtgcagccctctgggctcaccgtcatcagcaactacatgaggttgggtcccgccaggcctccggagggggaaggggcgtgggaggtcgggtctcgacgttattaagtagtgacgtgggagtagcacaaagctcgcgacgtccgtggaacgggcacttcaccatcctacagacgaacaaaccggccaaaggaccacgctgtaactctgggaactaaagtgaactagtccnggagacgccggaggacacgggtntgtnttatacgttgngacaaggcggccgggtggcggggtggttcggggagttgcttaagttaac

SEQ ID NO: 319180 - DNA, 459 bp, Homo sapiens
  misc_feature: GZ8MTXP01DOCPG.44.55.E11.1.454.CMB.2.raw
  modified_base (196)..(196): a, c, t, g, unknown or other
  misc_feature (196)..(196): n is a, c, g, or t
  modified_base (448)..(459): a, c, t, g, unknown or other
  misc_feature (448)..(459): n is a, c, g, or t
tcagacagtatatacacgaccggtgctcgatttagcactcgcacgctggagtgggtctcagtcatttatactggttatttcacatactacgcagactccgtgaagggccgattcaccatctccagggacaattccaggaacacggtttatcttcaaatgaacaacctgagaggcgacgacacggccgtctattacngtgcgagacaagtcggcgctcggagtggttattattcgtttgacttcgtggggccaggggaaccctggtccaccgtcgcctccgcctccaccacgggcccacgtcggtccttcccccgtcggccaccctccctccaacgacgccacctcgtgggggcacgacgccggcccgtgggctcgccgtcggtaccaacgggtactaccttcctataacttactggtctgagcgggcgtgggcgaaggcgacagtagnnnnnnnnnnnn

SEQ ID NO: 319181 - DNA, 664 bp, Homo sapiens
  misc_feature: GZ8MTXP01DPY7H.44.55.E11.1.454.CMB.2.raw
  modified_base (260)..(260): a, c, t, g, unknown or other
  misc_feature (260)..(260): n is a, c, g, or t
tcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtcgtggaggagcttagtccagccgtgggggtcccagagctctcctgtgcagccctcgnggcctcaccgtcagcagcaactacagtggacgttcgggtcccgccgagggcctccggaagggggaaggggctgggaggtcgggtctcgagttctagtttatacgtggtgtatttacactactaacctacgcacgtaccgtaccggaggaaccgggccgtattcccgactaacgttcccaaccgagggacctaagtttaccccgaagggtaacctacggtttataccttaacaaagtcgaaactaccgtgaacgacggacgaacgaccgtacggtacccttatacgttaccgtgcggaacgaacggacaacgggttcggaccgtcggttcgggttgtttggtttaacttacgtttccgggtttacgcccgtttacgggttccgggggaaccccttaaaccggggg

SEQ ID NO: 319182 - DNA, 738 bp, Homo sapiens
  misc_feature: GZ8MTXP01DYT7G.44.55.E11.1.454.CMB.2.raw
  modified_base (398)..(398): a, c, t, g, unknown or other
  misc_feature (398)..(398): n is a, c, g, or t
tcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggtacttttaaaggtgtccagtgtgaggtgcggctgagtggagtcgtgggaggaggtcttagtccaggtccgtcgggggtcccagagactctcctgtgcagcctcgtgggcctcaccgtcagcagacaactacagtggtacggttcgggtcccgaccgacgggccgtaccgggaagggggaaacgggggtcgtaggggtaggttcggggttctcgtagttctatttagtacgttggtntattttcactataacctacgcgtagtaccgtccggtaggaacgggtccgtacttccacctactccgtaccgaaggtaactaacgttaccgaacggtaacttacggtttaactactaactaaacgtacgaaacgtaaccgtagaacggaacggaccgaaccgtaccgtaccggtaccgttacttaacgttacgtacggtcggaacggtaacgaaccggtaaacgggttccggaccggttcgggttacgggttagggtttacgggttttaacccgtttaggttttccggttttacggtaccggtttcgggttaaccgggggttaacccggttaacccggggg

SEQ ID NO: 319183 - DNA, 675 bp, Homo sapiens
  misc_feature: GZ8MTXP01D8HIR.44.55.E11.1.454.CMB.2.raw
  modified_base (345)..(345): a, c, t, g, unknown or other
  misc_feature (345)..(345): n is a, c, g, or t
  modified_base (353)..(353): a, c, t, g, unknown or other
  misc_feature (353)..(353): n is a, c, g, or t
  modified_base (463)..(463): a, c, t, g, unknown or other
  misc_feature (463)..(463): n is a, c, g, or t
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagcgtgggttctccttggttggacttttaaaaggtgtccagtgtgaggtgcggttgatgtagtcgtggaggaggcttagtccagccgtgggggtcccagagactctcctgtgcagcctctgggctcacgtcagcagcaactacatgagttcggccgcaggctcgaggggagggctggagtgggtctcgagttctatttanacgtggtntactttcacatactaacgcaagactcccgtagaacgggcctattccacctatctaccgagggtactaacgttacgaaacgggtaacttaccggttttatacccttaaaanaaacgtaacgaaaccgtaacggtaggaacggaaccggaccgaaccgtaacccgtaccggtaccgttaacttacgttacgtcggtacggacggaaacgtacggttacggtccgggacgtacggttacgggttagttttcggttttaatttaaccggtttcggtttcgttaccggttcgggttccgggggtaacccgttaaccggggtaacccg

SEQ ID NO: 319184 - DNA, 700 bp, Homo sapiens
  misc_feature: GZ8MTXP01AODQL.44.55.E11.1.454.CMB.2.raw
  modified_base (262)..(262): a, c, t, g, unknown or other
  misc_feature (262)..(262): n is a, c, g, or t
  modified_base (336)..(336): a, c, t, g, unknown or other
  misc_feature (336)..(336): n is a, c, g, or t
  modified_base (352)..(352): a, c, t, g, unknown or other
  misc_feature (352)..(352): n is a, c, g, or t
tcagacagtatatacacgaccggtgctcgatttagcactcgcacgttgggtttggggagaggagcccagcactgggattccgaggtgtttccattcggtgatcagcactgaacacagaggactcaccatggagttttggctgagcgtggttcgtccttaggtggactttaaaaggtgtccagtgtgaggtgcggctgatggagtctggaggaggcttagtccagccgtggggggtcccagagactctcctgtgcagcctcgnggctcacgtcagcagcaactacatgagttggcccgcaggctccggagggtagggctggagtcgggtctcgagtntagtttacagtcggtntatttcaactattaacccaggcaaagtcccttcgggacggtaacggggccctaaatttccaaacccgttactacccgtacggaacgggtaacctaacggttaacccgggtaaactttacggtttaactaccgttaaacgaaacgtaacgtaaaccgtaaccggtaacggtaacgggaacggaaccggaaccggaaccgtaccggtaccgttacgttacgttacgtacggtacggacggaacgaacggacggtacgggttcggtcggtacggttaggttaggtttacgtttaacgtttacggtttcgttacggttcgggttacgggtaaccggttaaccgggtaaccgg

SEQ ID NO: 319185 - DNA, 620 bp, Homo sapiens
  misc_feature: GZ8MTXP01BRJQU.44.55.E11.1.454.CMB.2.raw
  modified_base (368)..(368): a, c, t, g, unknown or other
  misc_feature (368)..(368): n is a, c, g, or t
  modified_base (473)..(473): a, c, t, g, unknown or other
  misc_feature (473)..(473): n is a, c, g, or t
  modified_base (527)..(527): a, c, t, g, unknown or other
  misc_feature (527)..(527): n is a, c, g, or t
tcagacagtatatacacgaccggtgctcgatttagcactcgcacgttgggtttgggggggaggaggagcccagcactgggattccgaggtgtttccattcggtgatcagcactgaacacagaggactcaccatggagttttggctgagctgggttctccttgttggactttaaaaggtgtccagtgtgaggtgcggctgatggagtctggaggaggcttagtccagccgtgggggtcccagagactctcctgtgcagcctcgtgggcctcaccgtcagcagcaactacatggaggttcgggcccgccgaggcctaccggagggggaagggggctgggagtgggtctcgagttctatttatacgtggtntatttacactactaaacctacgcacgtaccttccgggtaggaacggggcctattcccaccgtatccgtacgagggactaattacccgaggtaacctacggtttanctacaaatcgaaacaccgtagagacggacgaccgacaccggtctactattacgngtgaacgtacgacaacggttcggcgtcgttcggttagttcggttaatttcgtttgttcggtacgtttcgggtcgggggaaccgtaacccgggg

SEQ ID NO: 319186 - DNA, 745 bp, Homo sapiens
  misc_feature: GZ8MTXP01AP4F8.44.55.E11.1.454.CMB.2.raw
  modified_base (300)..(300): a, c, t, g, unknown or other
  misc_feature (300)..(300): n is a, c, g, or t
tcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggtacttttaaaaggtgtccagtgtgaggtgcggctgatggagtcgtggaggaggcttagtccagccgtgggggtcccagagactctcctgtgcagcctcgtgggctcgaccgtcagcagcaactacatgagttggtccncgaggctcgaggggagggctgggagtgggtctcgagtctatttatacgtggtgtatttcaacgtataaactaccgctaggtaccgtccggtaggacgggtccagttcccaacctatcccgtaccgaggggtaacctaagtttaccccgaaagggtaaccgttaaccgggttttaacttaccgttaacgaaaacgtttacggaaacccgtaaaccccggtttaggaaaccgggacgggtaccggaaaccggaacccggtaacccggggtacccggtttaccttaaacgtttaccgttcgggttcggtaaccgggaaacgttaccgggtaaacggttccgggtaccgtaccggttccggggttagtttaccgggtttaaatttcggtttaacccggttttagacccgtttacgggtccggggggttaacccgttaaaccccgggggg

SEQ ID NO: 319187 - DNA, 737 bp, Homo sapiens
  misc_feature: GZ8MTXP01BET0C.44.55.E11.1.454.CMB.2.raw
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggtacttttaaaaggtgtccagtgtgaggtgcggctgatggagtcgtggaggaggcttagtccaggccgtgggggtcccagacgactctcctgtcgcacgcctcgtgggctcaccgtcagcagcaactacacgtggaggttcgggcccgcgacggcctccggaggggagggctgggagtgggtctcgagtctattagtacgtggtagtatttcaactactaacctacgcgtacgtacctcccggtaggaaacgggtcccgtaattacccaacctacgtaccgtaccgaacgggtaacctaaacgttacccgaaacgggttaaccgttaacgggttttaactccttaaacgtaaaagtaccgtaaaaccgtaacccgttaggaaacgggaccgggaaaccgaaccggaacccgtaacccggggttacccttaaccgtttaacttaaccggtggttaccggaacggaacgttaaaccgacgggttccgggaccgtcggttaccgggttagtttacggtttaagtttacgtttcggtttacgtaccggttcggtcggggttcccgtaaacccggggg

SEQ ID NO: 319188 - DNA, 640 bp, Homo sapiens
  misc_feature: GZ8MTXP01AXL24.44.55.E11.1.454.CMB.2.raw
  modified_base (298)..(298): a, c, t, g, unknown or other
  misc_feature (298)..(298): n is a, c, g, or t
  modified_base (332)..(332): a, c, t, g, unknown or other
  misc_feature (332)..(332): n is a, c, g, or t
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtgggggtcccagagactctcctgtgcagcctctgggctcaccgtcagcagcaactacatgagttggccnccgagctccgagggagggctgggagtcgggtctnagtcatttatactggtagtatttcacactaactacgcagacctccgtagaacgggcctaattcaacctatacctccgagggaactaacttaccgaaggtaactaacggtttataccttaacaaagtacgaaactaacccgtggaacgacgggccgaacggaccgacggggtaccccttagtaactttaccgtaggttcggaacggaacgaccgaaacggttcgggccggtacgttccgggttgttacgggtttaattacgtttcggtttacgaccgtttaccggtcgggggttcccgtaaaccggggg

SEQ ID NO: 319189 - DNA, 621 bp, Homo sapiens
  misc_feature: GZ8MTXP01DLIRI.44.55.E11.1.454.CMB.2.raw
  modified_base (297)..(297): a, c, t, g, unknown or other
  misc_feature (297)..(297): n is a, c, g, or t
tcagacagtatatacacgaccggtgctcgatttagcactcgcacgttgggtttgggggggagaggagcccagcactgggattccgaggtgtttccattcggtgatcagcactgaacacagaggacctcaccatggagttttggctgagctgggttctccttgttggacttttaaaaggtgtccagtgtgaggtgcggctgatggagtctggaggaggcttagtccagcctgggggtcccagagactctctgtgcagcctctggctcacgtcagcagcaactacatgagttgggcccncgagcacgaggggaggtcgtggagtgggtctcgtagtctaatttacgtacgtcggtactatttacaacgtaactaaaccgtacgcgaacgtaccgtaccggtacggaacgggtaccgtacgttacctacctactaccgtaccgaacggaacgtaaactaacgaacggtaacgtaacgttaacttactaactaaactaagtaacgaactagagacggacgacgacgacgtacgtctacgtacgtcgtgcgaacgacgacgcgtcggtcgttcggttcgttagttaattacgtttcgttcgtacgttcgtcgggttccggtaacgg

SEQ ID NO: 319190 - DNA, 654 bp, Homo sapiens
  misc_feature: GZ8MTXP01EJ2LR.44.55.E11.1.454.CMB.2.raw
  modified_base (278)..(278): a, c, t, g, unknown or other
  misc_feature (278)..(278): n is a, c, g, or t
  modified_base (381)..(381): a, c, t, g, unknown or other
  misc_feature (381)..(381): n is a, c, g, or t
  modified_base (443)..(443): a, c, t, g, unknown or other
  misc_feature (443)..(443): n is a, c, g, or t
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaggtgtccagtgtgaggtgcggctgatggagtcgtggaggaggcttagtccgagccgtcgggggtcccagagactctcctgtgcacgcctcgtggctcgaccgtnagcagacaactacagtgtaggttcgggtcccgccgtaggcctaccggagggggaagggcgtgggaggttcgggtctcgagttactagtttagtacgttgggtntactttcaactagtaacctacgcgacgtacgtccggtaggaacgggcctatttaccaccctntaccgtaccgaagggaacctaagttacccggaaaggtaacttacggtttatactaactaaaagtcgaaacgtacctagggacgacgggaccgaccgacgtccgggtacttcttaaacttggtgtacggaacgaagttacgaacggttcgcgtacgttaggttgttagggttcttagttcgttgccgttacggtcggggaaccgtaaccggg

SEQ ID NO: 319191 - DNA, 735 bp, Homo sapiens
  misc_feature: GZ8MTXP01C3CAC.44.55.E11.1.454.CMB.2.raw
  modified_base (275)..(275): a, c, t, g, unknown or other
  misc_feature (275)..(275): n is a, c, g, or t
  modified_base (307)..(307): a, c, t, g, unknown or other
  misc_feature (307)..(307): n is a, c, g, or t
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggtacttttaaaaggtgtcagtgtgaggtgcggctgatggagtcgtggaggaggcttagtccagccgtgggggtccagagactctcctgtgcagcctcgtgggctcaccgtnacgcagacaactacatgagttggccgcaggcncgaggggagggctgggagtgggtctcgagtctaatttagtacgtggtgtatttcaactataaacctaacgcaacgtaccttccgggtaggaacggggtccgtaacttccaacccgtattccgaacccggaagggaaacctaaagtttaccccgaaaagggtaaaccttaacgggtttttaacacgtttaaactaaaacgttaacggaaaaccctaaaccgtttaagggaaacggaaccggggaacccgaaccggtaaaccgaccgggggttaccccgttacttaaacgtttaaaccgttggtacggaaccggaagttaaaccgaaacgggttcccgggaaacgtccgggttacgggttggtttaacgggtttaatttacgtttcccgtttagaccgttttcgggcggggttaacccgtaaacccgggg

SEQ ID NO: 319192 - DNA, 701 bp, Homo sapiens
  misc_feature: GZ8MTXP01BJ39A.44.55.E11.1.454.CMB.2.raw
  modified_base (602)..(602): a, c, t, g, unknown or other
  misc_feature (602)..(602): n is a, c, g, or t
tcagacagtatatacacgaccggtgctcgatttagcactcgcacgttgggtttggggagaggagcccagcactgggattccgaggtgtttccattcggtgatcagcactgaacacagaggactcaccatggagttttggctgagctgagttctccttgttggtacttttaaaggtgtccagtgtgaggtgcggctgatggagtcgtggaggaggtcttagtccgaggccggtcggggggtcccaggacgactctcctgtgcacgcctcgtcggctcgaccgtcagcagacaactacagtgtacggttcgggtcccgccgacggtccgtaccggagggggaagggcgtgggaggttcgggtctcgtagttctagtttacgtaccgttggttatacgtttacaactaagttaacctcgactacggtaccttaccggtagggaacggggcctacttacccaacctatccgtaccggaagggtacctaaacgttacccgaaaggtaaacctttacggtttaactactttaaacaaacgttacggaaacctaaccgtaggaacgggacgaccgaaccgaccgtaccggtccttacttagtttaccgnggtaacgacgttagaccgaaggtccgggcttcggttacgggttagtttggtttaatttcgtttcccggttgttaccgtttcggttcggggtaaccccgg

SEQ ID NO: 319193 - DNA, 722 bp, Homo sapiens
  misc_feature: GZ8MTXP01EJ2TF.44.55.E11.1.454.CMB.2.raw
tcagacagtatatacacgaccggtgctcgatttagcactcgcacgttgggtttgggggggagaggagcccagcactgggattccgaggtgtttccattcggtgatcagcactgaacacagaggactcaccatggagttttggatgagctgggttctccttgttggtacttttaaaggtgtccagtgtgaggtgcggctgagtggagtcgtggaggaggtcttagtccaggccggtgggggtcccagagactctcctgtgcacgcctcgtgggcctcgaccgtcagcagaccaactacagtggtacggttcgggtcccgccgacggtccgtaccgggaagggggaacgggggtcgtagggtaggtcgggttctacgtagttctagtttacgtacgtggtagtactttacaactactaaaccgtacgcgacgtaccgtaccggtacggaacgggtccgtacttacccacctaatccgtaacccggaagggaaccttaacgtttaacccggaaaggttaaaccgttacggttttaacctacgttaaacgaaaacgttccgaaaccgtaaaccgtgggaaaccgggacggaccgaaccgaccgtaccggtacccgttattacgttacgtggcgaacgtaagacgtacgggttcgcggtacgttgggttgtttaggtttcttaggtttcgttacgacgttcggggtcggggttaacccgtaaccggg

SEQ ID NO: 319194 - DNA, 629 bp, Homo sapiens
  misc_feature: GZ8MTXP01A5OPE.44.55.E11.1.454.CMB.2.raw
  modified_base (304)..(304): a, c, t, g, unknown or other
  misc_feature (304)..(304): n is a, c, g, or t
  modified_base (368)..(368): a, c, t, g, unknown or other
  misc_feature (368)..(368): n is a, c, g, or t
  modified_base (390)..(390): a, c, t, g, unknown or other
  misc_feature (390)..(390): n is a, c, g, or t
  modified_base (456)..(456): a, c, t, g, unknown or other
  misc_feature (456)..(456): n is a, c, g, or t
  modified_base (461)..(461): a, c, t, g, unknown or other
  misc_feature (461)..(461): n is a, c, g, or t
tcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtcgtggaggaggcttagtccagccgtggggggtcccagagactctcctgtgcagcctcgtgggcctcaccgtcagcacgcaacacagtgaggttcggtcccncgaggcctccgagggggaacggggcgtgggaggtcgggtctcgagtcgtatttagtacttggtntatttcgaactataacctacgnagtactccggtagaacggggtctattccactatccgtccgaggactatcccgaagtaactagttancttanaaatgaaacacgtaggagacgggaccaacgaccaccggaccgttcttaaactccgtagtggaacccgtaagttaccggtaacggccggacgggtccttacggggttagtttgggtttaatttcggttcggtttacggctttccgggtaaggggaacccgtaaccgggg

SEQ ID NO: 319195 - DNA, 622 bp, Homo sapiens
  misc_feature: GZ8MTXP01B6WC7.44.55.E11.1.454.CMB.2.raw
  modified_base (350)..(350): a, c, t, g, unknown or other
  misc_feature (350)..(350): n is a, c, g, or t
tcagacagtatatacacgaccggtgctcgatttagcactcgcacgttgggtttgggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctggggggtcccagagactctcctgtgcagcctctgggctcaccgtcagcagcaactacatgagttgggtcccgccaggctccaggggaaggggctggagtgggtctcagtcatttatactggtnatttcacataactacgcagactcccgtgaaggggcccatttccacctatcctcaggggacaacgttaccaggtaaacacggtttaaactcgtttaccaaattagaaaccgaaacccttaggaaagacgggacgaaccgtacgaaccgggacccggtcctaaggtttaaccctgtacggcgtaacggacgaaacgttcggggacgcgttaccggagggttcgtttaagttacttcggtttttagaccgtttacgtggggttcccgaaccgggg

SEQ ID NO: 319196 - DNA, 761 bp, Homo sapiens
  misc_feature: GZ8MTXP01DXK7U.44.55.E11.1.454.CMB.2.raw
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggtacttttaaaaggtgtccagtgtgaggtgcggctgagtggagtcgtggaggaggtcttagtccaggccgtgggggtcccagagactctcctgtgcacgcctcgtcggctcgaccgtcagcacgactaaactacagtggtacggttcgggtcccgaccgacgggtccgtaccgggaagggggaacgggggtcgtaggggtaggttcggggttctcgtagttacttaagtttacgtacgtttggtagttactttacgaactactaaaccgtacgcgtaacggtacccgtccgggtaggaaccgggtccgtaattccaacttacgtcctaccggaagggtaacttaacgttacccgtaggtaaaccttacggttttactacttaaacaaaagttaccgaaacgtaacccgtaggaaacggtacgggaccgaaccggtaccgtaccggggttacccttacttacgttaaccgtgggacggaacggtaacgacgggtaacggttccgggaccgtcggttacgggttaggtttacggtttaactttaggtttccggttttaggacccgttttcgggaacgggggttcccgttaaacccgggg

SEQ ID NO: 319197 - DNA, 725 bp, Homo sapiens
  misc_feature: GZ8MTXP01B9Q1L.44.55.E11.1.454.CMB.2.raw
  modified_base (194)..(194): a, c, t, g, unknown or other
  misc_feature (194)..(194): n is a, c, g, or t
tcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcggntgatggagtcgtggaggaggcttagtccaggccggtgggggtacccagacgactctcgtgtgcacgtcctcgcgggcctcgaccgtcagcagacaactacagtgaggttcggccgcgagccgtacggagggggacggcgtagggaggtggtctcgtagttactatttacgtacgttggtagttactttcaaactaacttaaccgaaccggcgtaacgtaacccggttccggtaacgggtaaccggggtaccctacgtttacccaaccgtacttaccgaccccgggaaagggtacctaaagttaccccggtaaggtaaaacccgttacgggtttaaactcctttaaacgaaagttaacggaaacctaaaccgtaggggaaccgaacggggacctaaccggaccgtcggtacccgttattacgtaacggttgcggaacgaacggacgtaagggttccgcccggtgacggggttagttacgggttaatcgttttccggtagtcggttaccggtggggaacccttaacccggggg

SEQ ID NO: 319198 - DNA, 647 bp, Homo sapiens
  misc_feature: GZ8MTXP01EDZ9A.44.55.E11.1.454.CMB.2.raw
  modified_base (265)..(265): a, c, t, g, unknown or other
  misc_feature (265)..(265): n is a, c, g, or t
  modified_base (461)..(461): a, c, t, g, unknown or other
  misc_feature (461)..(461): n is a, c, g, or t
  modified_base (499)..(499): a, c, t, g, unknown or other
  misc_feature (499)..(499): n is a, c, g, or t
  modified_base (547)..(547): a, c, t, g, unknown or other
  misc_feature (547)..(547): n is a, c, g, or t
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggtacttttaaaggtgtccagtgtgaggtgcggctgagtggagtcgtggaggaggtcttagtccagccgtgggggtccagagactctcctgtgcagcctcgnggctccaccgtcagcagacaaactacgagtggtacggttcggggtccccgaccgacgggccgtaccggggaaggggggtaacgggggcgtgggggtacggttcgggggtttctacgtagttactaagtttagtacgttgggtattatttacactactaaaccacgcagtacctccagtacgaacgggctactcacntcacgaggactacgtacaggtaactcgttatacttaanaattacgaaactaacgtgaacggacggacgacgtacgaccgtccgttntaagttcgtgtcggacttaagaacgttggccgggcgttcgttcgggttaggttcgtttattaagtttcggttgttaccgttcgggttccggggtaacccg

SEQ ID NO: 319199 - DNA, 675 bp, Homo sapiens
  misc_feature: GZ8MTXP01A1N1B.44.55.E11.1.454.CMB.2.raw
  modified_base (264)..(264): a, c, t, g, unknown or other
  misc_feature (264)..(264): n is a, c, g, or t
  modified_base (479)..(479): a, c, t, g, unknown or other
  misc_feature (479)..(479): n is a, c, g, or t
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaggtgtccagtgtgaggtgcggctgatggagtcgtggaggaggcttagtccagccgtgggggtcccagacgactctcctgtgcagccctgngggcctcaccgtcagacagacaacgtacagtggaggttcgggtcccgccgaggcctaccggagggggaacgggggctggggacgtgggtctcgagttctatttatacgttggtgtatttcactacttaaacacgcagacctcggtaggaacgggcctattcccacctatccacgagggaacctaacgttaccgaaaggtaacctacggtttaacnccgtttaacaaagttccgaaacctacgtagaacgacgggtacaaccgaccgtccggccttacgttactacgtgtagcggtaacgacgtaaacggttccgggacgtccgttacgggggttagtttggggtttaaacttcgggttttcgtttacgggacttttcccggggtaacgggggttccccgtaaacccggggg

SEQ ID NO: 319200 - DNA, 628 bp, Homo sapiens
  misc_feature: GZ8MTXP01CJ10Q.44.55.E11.1.454.CMB.2.raw
  modified_base (255)..(255): a, c, t, g, unknown or other
  misc_feature (255)..(255): n is a, c, g, or t
  modified_base (303)..(303): a, c, t, g, unknown or other
  misc_feature (303)..(303): n is a, c, g, or t
  modified_base (420)..(420): a, c, t, g, unknown or other
  misc_feature (420)..(420): n is a, c, g, or t
  modified_base (507)..(507): a, c, t, g, unknown or other
  misc_feature (507)..(507): n is a, c, g, or t
  modified_base (515)..(515): a, c, t, g, unknown or other
  misc_feature (515)..(515): n is a, c, g, or t
tcagacagtatatacacgaccggtgctcgatttagcactcgcacgttgggtttgggggggagaggagcccagcactgggattccgaggtgtttccattcggtgatcagcactgaacacagaggactcaccatggagtttggctgagctgggttctccttgttggtacttttaaaaggtgtccagtgtgaggtgcggctgatggagtcgtggaggaggcttagtccagccgtgggggtcccagagactctcctgtncagcctgtgggcctcgaccgtcagcagcaactacatgagttcgggccncgaggctccggagggggaaggggctgggagtcgggtctcgtagtctaagtttatacgtcggttagtatttccaatactaaactacgcagtaccgtcgtaggaaccgggcattccacnttccacgaggacaattacgaggaactacggtttatctaacaaatacgaaacaacgtggagacggccacgtacgaccggtacccgttntaatttcnggtggaaccgagaaccgtaaagggcccggtacgtccggttacgggttgttacggggttttaattaacgtttcgttttacggactttcggggtccgggaacccgtaaaccgggg

SEQ ID NO: 319201 - DNA, 811 bp, Homo sapiens
  misc_feature: GZ8MTXP01DL9PR.44.55.E11.1.454.CMB.2.raw
  modified_base (276)..(276): a, c, t, g, unknown or other
  misc_feature (276)..(276): n is a, c, g, or t
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggactttaaaggtgtccagtgtgaggtgcggctgatggagtcgtggaggaggcttagtccgagccgtgggggtcccagagactctctgtgcacgcctcgtgggcctcaccgtnagcagacaactacagtcggtaggttcgggtcccgaccgacggtcctaccggaagggggaacggggcgtaggggacggtcgggttctaccgtagttaccttaatttacgtaccgttaggttacggtaacttttaccgaacctaacgttaaacccgtaaccggaacgtaacgggtaaccccgttacccgggtaacgggtaaaccgggggtccccgttaaacttacccgaacccctagtttacccgtacccggaaaggggttaaccctaaacgtttacccggaaacggttaaacccttacgggtttaacttaccttaaacgaaaacgttaccgaaaactaaacccggttggaaaccggaccgggaccgaaccgaccgtaccgggtacccgttcttaacgttaacgcggtaccgaacggaacgttacgtaacgggccggtaccgtccggttaacgggttgtttaacgggttttaactttacggttttccggtttaacgtaccgtttcggggtaaccgggggcccgttaaaccccggggg

SEQ ID NO: 319202 - DNA, 590 bp, Homo sapiens
  misc_feature: GZ8MTXP01DZ5SZ.44.55.E11.1.454.CMB.2.raw
  modified_base (358)..(358): a, c, t, g, unknown or other
  misc_feature (358)..(358): n is a, c, g, or t
  modified_base (489)..(489): a, c, t, g, unknown or other
  misc_feature (489)..(489): n is a, c, g, or t
  modified_base (529)..(529): a, c, t, g, unknown or other
  misc_feature (529)..(529): n is a, c, g, or t
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtgggggtcccagagactctcctgtgcagcctctgggctcaccgtcagcagcaaactacatgagttggtccgccagggctccgaggggaagggggctggggagtgggtctacgagtcatttatactggtntatttacacataaactacgcagactccgtgaagggccattccacatctccagggacaattaccagggaaacctacggttatacttacaaatagaacgaaactgaagaggaccgaacgacacgggtaccctntattaactgtgaagagacaaaggttcggcgtccgacgggngttagggtttaaattcgtttaacgtttggtaacttccgtcgggggttcccgtaaccggggg

SEQ ID NO: 319203 - DNA, 610 bp, Homo sapiens
  misc_feature: GZ8MTXP01BN3IJ.44.55.E11.1.454.CMB.2.raw
  modified_base (261)..(261): a, c, t, g, unknown or other
  misc_feature (261)..(261): n is a, c, g, or t
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtgggggtcccagagactctcctgtgcagcctntgggctcaccgtcagcagcaactacatgagttgggtcccgcaggctccgaggggaaaggggctgggagtgggtctcagtcatttatactcggtgactttcactataaacctacgcagtactcgtgaacgggccgattcacatctaccagggacaaattacccgaaggtaacctacggtttaatccttaaacaaatacgaaacgaactaggaacgacgacgaaccgaacgtaccggtacctactaacttacgtgtgaacgaacgaacgtaacgttcggacgtcgttacgggttagttaggtttaatttacgttcgtttacgtaccgttcggtaacggggaacgtaacggg

SEQ ID NO: 319204 - DNA, 767 bp, Homo sapiens
  misc_feature: GZ8MTXP01AOH45.44.55.E11.1.454.CMB.2.raw
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggtacttttaaaaggtgtccagtgtgaggtgcggctgatggagtcgtggaggaggtcttagtccgaggccgtgggggtcccagagactctcctgtgcacgcctcgtcgggctccgaccgtcagcacgacaaactacagtggtaggttcgggtcccgccgacggtcctaccgggaagggggaagggggtcgtgggggaacggttcgggtcctacgtacggttctaattttagtacgttgggtagtacttttcaactacttaaaccgaccgcgtaacggtaccgttccgggtaacgggaacggggtccctaagtttacccaccctacgttcccgttaacccggaacggggtaaccttaaacgttacccgaaagggtaaacccgttaaccgggttttaactaccgtttaacaaacgttacgaaccgtaaaccgtaggaacggacgggacgaacccgtacgacccggttaccgtacgttacttacggtcgtcggaacggaacgaccggtaaaggttccgggtacgtccgttaggggttgtttaggtttaatttacgtttcggtttacggtaccgtttacgggtccggggttaaccgtaaacccggggg

SEQ ID NO: 319205 - DNA, 640 bp, Homo sapiens
  misc_feature: GZ8MTXP01BSLYK.44.55.E11.1.454.CMB.2.raw
  modified_base (488)..(488): a, c, t, g, unknown or other
  misc_feature (488)..(488): n is a, c, g, or t
  modified_base (599)..(599): a, c, t, g, unknown or other
  misc_feature (599)..(599): n is a, c, g, or t
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtgggggtcccagagactctcctgtgcagccctctgggcctcaccgtcagcagacaactacagtgaggttcgggtcccgccgaggcctccggagggggaagggggctgggaggtgggtctcgagttctatttatacgtggtgtatttcgactataaacctacgcgacgacgtccgtaggaaacggggtcccgaattcccaacctagtcctaccgaagggtaacaaacgttaccgaaagggtaaaccttccgggttttaanacctttaacaaaagttccgaaaaccgtaaaccgttggaaacggacgggaccgaacgaccgacggtacccgttactagtactgcgaacgagacaggttcgcgcgttaggttnttggttaattagttcgttgacgttggtcgggcgtaaccggg

SEQ ID NO: 319206 - DNA, 820 bp, Homo sapiens
  misc_feature: GZ8MTXP01DFIMQ.44.55.E11.1.454.CMB.2.raw
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctggttctccttgttggacttttaaaggtgtccagtgtgaggtgcggctgatggagtcgtggaggaggcttagtccagccgtgggggtcccagagactctcctgtgcagcctcgtggctcaccgtcagcagacaactacagtggtaggttcgggtcccgaccgaggcctaccggaagggggaacggggtcgtaggggtacggttcggggttacctcgtacgttactaagttttacgttaccgttagggttacgttacttttaccgaaacctaacgttaaacccgttaacggccgtaaacggtaacccgttacccgggttaggggaaaccggggtccccgtaactttacccaaacccgttaacgttaccccgtaaccggaaacggggtaaacccttaaacgtttaccccggaaacgggttaaacccgttaaccgggtttttaactaccctttaaacgaaaacgtttaccgaaaaccgtaaaccccggttggaaaccggtacgggacccgtaaaccgaccccgtaccggggttacccttaccgttaagtttacccgtggtcggtaaccggaacgaaacgtaaccgggttccggacggtcccgttagggttacgtttaggtttaattacgtttcggttttacgaccgttttcgggaacggggcccgtaacccgggg

SEQ ID NO: 319207 - DNA, 714 bp, Homo sapiens
  misc_feature: GZ8MTXP01B2AG3.44.55.E11.1.454.CMB.2.raw
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggtacttttaaaaggtgtccagtgtgaggtgcgggctgatggagtcgtggaggaggcttagtccgagtccgtgggggtcccagagactctcctgtgcagcctcgtgggctcaccgtcagcagcaaactacagtggaggttcgggtcccgccgaggccgtaccggaagggggaagggcgtgggtagtcgggtctcgagtctatttatacgttcggtagtatttccaatacgttaactaccgctaacggtaccgtccggtaggaacgggtccgtaattcccgaaccctatccgtacgaagggaactaacgttaccgaacgggtaactacggtttaacaccgtttaacaaattacgaaaccgtaaccgtggaacgacgggaccaaacggacccgtacgggtaccccttattaacgttaaccgttggcggaacccgaaagaaccgtaaggttccggccgtaccggttcggggttatttacggggttttaaacttacggttttccgttttacggaccgttttccggggccgggggttaacccgttaaacccggggg

SEQ ID NO: 319208 - DNA, 685 bp, Homo sapiens
  misc_feature: GZ8MTXP01A4Z6Y.44.55.E11.1.454.CMB.2.raw
  modified_base (266)..(266): a, c, t, g, unknown or other
  misc_feature (266)..(266): n is a, c, g, or t
tcagacagtatatacacgaccggtgctcgatttagcactcgcacgttgggtttgggggggaggaggagcccagcactgggattccgaggtgtttccattcggtgatcagcactgaacacagaggactcaccatggagttttggctgagctgggttctccttgttggacttttaaaaggtgtccagtgtgaggtgcggctgatggagtcgtggaggaggcttagtccaggccgtgggggtcccagagactctcctgtgcagcctcgngggctcaccgtcagcgagacaactacagtggacggtttcgggcccgccgaggcctccggaggggaaggggctgggagtgggtctcagtctagtttatacgtggtgtacttcacactaaactacgcacgaccttacggagggtaaacgggccgttactttacccacctatacccgtacgaacggggtacctaaacgtttccccgaaagggttaaaccttacgggtttaacttacttacgtaaaatcgaaacgtaactagggaagaccggacgaccgacgtaccggtacccgttcttacgtaacgttcgacgcgtaaagaccggttaagccgggcgtaacttccggggttagtttaccggttttaagttagttttcccggttaacgtcgttaccggggtccggggaacggtaaacccgggg

SEQ ID NO: 319209 - DNA, 744 bp, Homo sapiens
  misc_feature: GZ8MTXP01BJYXP.44.55.E11.1.454.CMB.2.raw
  modified_base (301)..(301): a, c, t, g, unknown or other
  misc_feature (301)..(301): n is a, c, g, or t
  modified_base (393)..(393): a, c, t, g, unknown or other
  misc_feature (393)..(393): n is a, c, g, or t
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggctgagtggagtcgtggaggaggcttagtccaggccggtgggggtcccagacgactcgtcctgtgcacgtcctgtcggcctcgaccgtcacgcacgactaactacngtcggaggttcgggtcccgacgtacggccgtaccggagggggaacgggcgtgggaggtcggtctcgagttctagtttaagtcgtggttagtntttaccaatactaacgtacgcgtacgtaccgtccgtaggaacgggccgtaacttcccacctaactccgtaccggaggtaaacctaacgtttaccggaaaggtaactttacgggttacctaacgttaaacgtaaattaccggaaactaaaccggtagggtaaaggaccgggtaaccgaaccggtaacccgaccggggttacccttagttaacttaacccgttgggacgttaacgggtaaacgacccggtaagggttcccgggtacggtacgttaccggggttggtttacgggtttaacttaggtttccggtttcgaacggtttcggggtaacgggttaaccggtaacccggg

SEQ ID NO: 319210 - DNA, 710 bp, Homo sapiens
  misc_feature: GZ8MTXP01DH5LB.44.55.E11.1.454.CMB.2.raw
  modified_base (300)..(300): a, c, t, g, unknown or other
  misc_feature (300)..(300): n is a, c, g, or t
  modified_base (303)..(303): a, c, t, g, unknown or other
  misc_feature (303)..(303): n is a, c, g, or t
  modified_base (357)..(357): a, c, t, g, unknown or other
  misc_feature (357)..(357): n is a, c, g, or t
tcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtggggggtcccagagactctcctgtgcagccctcgtgggctcgacgtcagcagcaactacatgagttggccncgngctcgagggaagggctggagtgggtctcgtagtctaatttagtacgttcgggtntaacgtttcaacgtactaaccgttaacgcgtagtacccgtaccggtagaaacggggccgtaattcccaccgtattccgtaccgaaggggtacctaaagtttaccgaaggttaaacctacgggtttaactacgttaaccaaaagtcggaaacctaaacccgttggaacgacgggaccgtaaccggaacgaccgggtaacccgttattaacgtttaaccgtgggtacgtaacggaacggttaaccgaaacgggttccgggaccgtcgggttaccgggttagggtttagggtttaatttacgtttccggttttagggaccttttccgggtaacgggggccccttaaaaccgggggg

SEQ ID NO: 319211 - DNA, 737 bp, Homo sapiens
  misc_feature: GZ8MTXP01BD7HO.44.55.E11.1.454.CMB.2.raw
  modified_base (263)..(263): a, c, t, g, unknown or other
  misc_feature (263)..(263): n is a, c, g, or t
  modified_base (271)..(271): a, c, t, g, unknown or other
  misc_feature (271)..(271): n is a, c, g, or t
  modified_base (623)..(623): a, c, t, g, unknown or other
  misc_feature (623)..(623): n is a, c, g, or t
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggtacttttaaaggtgtccagtgtgaggtgcggctgagtggagtcgtggaggaggtcttagtccgagtccggtgggggtcccagacgactctcctgtgcngtcctcgnggctcaccgtcagcagacaactacagtggtacggttcgggtcccgccgacgggtccgtaccgggagggggaacggggtcgtaggggtacggtcgggtctcgtagttctattacgtacgtggtcttatttcaactactaacctacgcgtacgtaaccgttccggtaggtaacgggccgtaacttacccaactacgttcccgtaaccgagggtaacctaaacgttacccgaaaggttaaccgttacggtttataccttaaacggaaaacttacggaaacccgtaaccgttaggggaaaccgaacggggaccgaaaccgtaccgtaccgggtacccgttacttaaccgtttacgnggtcgaacggtaacacggtaacggttccggaccgtggttacgggttagtttcggttaactttacggtttcgttacggtacgtttcccgggcggggttaacccgtaacccggggg

SEQ ID NO: 319212 - DNA, 522 bp, Homo sapiens
  misc_feature: GZ8MTXP02J0RTA.44.55.E11.1.454.CMB.2.raw
  modified_base (341)..(341): a, c, t, g, unknown or other
  misc_feature (341)..(341): n is a, c, g, or t
tcagacagtatatacacgaccggtgctcgatttagcactcgcacgttgggtttgggggagaggagcccagcactgggattccgaggtgtttccattcggtgatcagcactgaacacagaggactcaccatggagttttggctgagcgtgggttctccttgttggacttttaaaaggtgtccagtgtgaggtgcggctgatggagtctggaggaggcttagtccagcctgggggtcccagagactctcctgtgcagcctctgggctcaccgtcagcagcaactacatgagttgggtccgccaggctccagggaaggggctggagtgggtctcagtcatttanactggtgatttcacatactacgcagactccgtgaagggccgattcaccatctccaggacatccagacacgttatcttcaaatgaacaactgagaggcgacgacacggcgtctattactgtgcgagacaacgtcgcgctcggagtggtaattagttcgtttgacttcgtcggggctacgggg

SEQ ID NO: 319213 - DNA, 546 bp, Homo sapiens
  misc_feature: GZ8MTXP02IPPM8.44.55.E11.1.454.CMB.2.raw
  modified_base (474)..(474): a, c, t, g, unknown or other
  misc_feature (474)..(474): n is a, c, g, or t
tcagacagtatatacacgaccggtgctcgatttagcactcgcacgttgggtttgggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctgggggtcccagagactctcctgtgcagcctctgggctcaccgtcagcagcaactacatgagttgggtccgccaggctccgaggggaaggggctgggagtggggtctcagtcatttatactggtgatttcactatacctacgcagactccggtgaagggccgattcaccatctccagggacattccaggaactacggttatcttacaaatgaaacaactgagaggcgacgacacggccgtctattacngtgcgagacaaagtcggacgcgtcggagttggttaattagttcgtttagactttcgtgggggcctaacgggg

SEQ ID NO: 319214 - DNA, 546 bp, Homo sapiens
  misc_feature: GZ8MTXP02FIVIX.44.55.E11.1.454.CMB.2.raw
  modified_base (352)..(352): a, c, t, g, unknown or other
  misc_feature (352)..(352): n is a, c, g, or t
  modified_base (468)..(468): a, c, t, g, unknown or other
  misc_feature (468)..(468): n is a, c, g, or t
tcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcggctgatgggagtctggaggaggcttagtccagcctggggggtcccagagactctcctgtgcagcctctgggctcaccgtcagcagcaactacatgagttgggtccgccaggctccaggggaaggggctgggagtgggtctcgagtcatttatactgggtntattcactatactacgcagactcgagaaggcatcacatctacgaggacaatcgagaactacgttatctacaaatgaaacacgtgagaggacgacgacgacggccgtactatactgngacgagacaacggtcggcgcgtacggagttaggttaattacgtttcggttcgactttcggtcggggaccgtaacgggg

SEQ ID NO: 319215 - DNA, 571 bp, Homo sapiens
  misc_feature: GZ8MTXP02IR34N.44.55.E11.1.454.CMB.2.raw
  modified_base (349)..(349): a, c, t, g, unknown or other
  misc_feature (349)..(349): n is a, c, g, or t
tcagacagtatatacacgaccggtgctcgatttagcactcgcacgttgggtttggggagaggagcccagcactgggattccgaggtgtttccattcggtgatcagcactgaacacagaggactcaccatggagtttttggctgagcgtggttcgtcctaggttggacttttaaaaggtgtccagtgtgaggtgcggctgatgggagtctggaggaggcttagtccagcctgggggtcccagagactctcctgtgcagcctctgggctcaccgtcagcagcaactacatgagttggccgccaggctccaggggaagggctggagtgggtctcagtcatttatactgggtntattcactatactacgcagactccggtagacggggcctattccacctatcctccgagggactaattccgaacggaactacgttatcttacaaatacgaaacaactagagaggaccgacgacgacggcgtactacttacgtgtacgacgagacgacgtcggcgtcgtcggtaggttgttaagttacgtttcgtttacgtacgttcggtcgggtaccgtacggg

SEQ ID NO: 319216 - DNA, 554 bp, Homo sapiens
  misc_feature: GZ8MTXP02H4Y8I.44.55.E11.1.454.CMB.2.raw
  modified_base (297)..(297): a, c, t, g, unknown or other
  misc_feature (297)..(297): n is a, c, g, or t
  modified_base (345)..(345): a, c, t, g, unknown or other
  misc_feature (345)..(345): n is a, c, g, or t
  modified_base (393)..(393): a, c, t, g, unknown or other
  misc_feature (393)..(393): n is a, c, g, or t
  modified_base (538)..(538): a, c, t, g, unknown or other
  misc_feature (538)..(538): n is a, c, g, or t
tcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtgggggtcccagagactctcctgtgcagcctctgggctcaccgtcagcagcaactacatgagttgggtccnccagggcctccgaaggggaaggggctggagtgggtctcagtcatttanactggtgatttcacatactacgcagactccgtgaagggccattcacanctccagggacaaattccaaggaactaacggtttatcttacaaaatgaaacaacctgaagaggcgaacgaacgacggtccgtataattactgagcgaagacaaagtcggcgactcggagtggttaattactcgtttagactttcgnggggtacccaacgggg

SEQ ID NO: 319217 - DNA, 535 bp, Homo sapiens
  misc_feature: GZ8MTXP02H8Q5G.44.55.E11.1.454.CMB.2.raw
  modified_base (416)..(416): a, c, t, g, unknown or other
  misc_feature (416)..(416): n is a, c, g, or t
  modified_base (461)..(461): a, c, t, g, unknown or other
  misc_feature (461)..(461): n is a, c, g, or t
  modified_base (480)..(480): a, c, t, g, unknown or other
  misc_feature (480)..(480): n is a, c, g, or t
tcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctgggggtcccagagactctcctgtgcagcctctgggctcaccgtcagcagcaactacatgagttgggtccgccaggctccaggggaaggggctgggagtgggtctcagtcatttatactggtgatttcacatactacgcagactccgtgaaggcgattcacatctccaggacaattccaggaacacgttancttacaaatgaacaacctgagaggcacgacacggccgtctatacngtgcgagacaaagtcggcnccgtacggagttcggttaattattcgtttcgactttcgttgggggaccaacgggg

SEQ ID NO: 319218 - DNA, 537 bp, Homo sapiens
  misc_feature: GZ8MTXP02FK9N8.44.55.E11.1.454.CMB.2.raw
  modified_base (292)..(292): a, c, t, g, unknown or other
  misc_feature (292)..(292): n is a, c, g, or t
  modified_base (343)..(343): a, c, t, g, unknown or other
  misc_feature (343)..(343): n is a, c, g, or t
tcagacagtatatacacgaccggtgctcgatttagcactcgcacgttgggtttgggggagaggagcccagcactgggattccgaggtgtttccattcggtgatcagcactgaacacagaggactcaccatggagttttggctgagcgtggtgtcctagtggactttaaagtgtcagtgtgaggtgcggctgatggagtctggaggaggcttagtccagcctggggggtcccagagactctcctgtgcagcctctgggctcaccgtcagcagcaactacatgagttgggtccnccaggctccgagggaaggggctggagtgggtctcagtcatttatactggtnatttcactatactacgcagactccgtgaagggccgattcaccatctccagggacaaattccaggaacacggtttatcttcaaaatgaacaaccagagaggacgacgacacgcgtctattatgtgcgagagaaagcggcgcgtcggagtaggttaagttatttacgtttggtacttcgttgggtcgtaaccgggg

SEQ ID NO: 319219 - DNA, 567 bp, Homo sapiens
  misc_feature: GZ8MTXP02HTFWG.44.55.E11.1.454.CMB.2.raw
  modified_base (466)..(466): a, c, t, g, unknown or other
  misc_feature (466)..(466): n is a, c, g, or t
  modified_base (473)..(473): a, c, t, g, unknown or other
  misc_feature (473)..(473): n is a, c, g, or t
tcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctgggggtcccagagactctcctgtgcagcctctgggctcaccgtcagcagcaactacatgagttggtccgccaggctccgaggggaagggctggagtgggtctcagtcatttatactggtgtatttcactatacctacgcagactccgtgaacggggccattcacctatcctcagggacaattccgaggaactacggttatcttacaaatgaaacaactgagaggcgacgacgacgccgtntacttcngtgcgagacaacgtcgggacgccgtacgggtagttagggtttaatttacgttacgtttcggacgtttccggtacgggggtacctaacccggggg

SEQ ID NO: 319220 - DNA, 540 bp, Homo sapiens
  misc_feature: GZ8MTXP02IVKW3.44.55.E11.1.454.CMB.2.raw
  modified_base (421)..(421): a, c, t, g, unknown or other
  misc_feature (421)..(421): n is a, c, g, or t
  modified_base (489)..(489): a, c, t, g, unknown or other
  misc_feature (489)..(489): n is a, c, g, or t
tcagacagtatatacacgaccggtgctcgatttagcactcgcacgttgggtttgggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctgggggtcccagagactctcctgtgcagcctcgtgggctcaccgtcagcagcaactacatgagttggtccgcaggctccgaggggaagggctggagtgggtctcgagtcatttatactggtgatttcacatactacgcagactccgtagaaggcgattcacatctccagggacaattcgaggaactacggtttancttacaaatgaaacactgagaggcacgacacggcgtactattactagtcgacgagacgaacgtcggcncgtcggagttggttaattacttcggttgacttcggtcggggacctaacggg

SEQ ID NO: 319221 - DNA, 544 bp, Homo sapiens
  misc_feature: GZ8MTXP02GB7LH.44.55.E11.1.454.CMB.2.raw
  modified_base (343)..(343): a, c, t, g, unknown or other
  misc_feature (343)..(343): n is a, c, g, or t
  modified_base (351)..(351): a, c, t, g, unknown or other
  misc_feature (351)..(351): n is a, c, g, or t
  modified_base (423)..(423): a, c, t, g, unknown or other
  misc_feature (423)..(423): n is a, c, g, or t
  modified_base (462)..(462): a, c, t, g, unknown or other
  misc_feature (462)..(462): n is a, c, g, or t
  modified_base (468)..(468): a, c, t, g, unknown or other
  misc_feature (468)..(468): n is a, c, g, or t
tcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctgggggtcccagagactctcctgtgcagcctctggctcaccgtcagcagcaactacatgagttgtgtcccgccaggcctccgagggaaggggctggagtgggtctcagtcatttanacctggtnatttcactatactcgcagactccgtgaacgggccattcaccatctccagggacaatcccaggaacaggttancttacaaatgaaacactgagaggcgacgacacggccgtntatacngtcgacgagactaaggtcggcgtactcgggaagtgggtttaatttattccgtttgaactttccggtggggtacccg

SEQ ID NO: 319222 - DNA, 400 bp, Homo sapiens
  misc_feature: GZ8MTXP02GD3HA.44.55.E11.1.454.CMB.2.raw
  modified_base (279)..(279): a, c, t, g, unknown or other
  misc_feature (279)..(279): n is a, c, g, or t
  modified_base (287)..(287): a, c, t, g, unknown or other
  misc_feature (287)..(287): n is a, c, g, or t
  modified_base (395)..(400): a, c, t, g, unknown or other
  misc_feature (395)..(400): n is a, c, g, or t
tcagacagtatatacacgaccggtgctcgatttagcactcgcacgctggagtgggtctcagtcatttatactggtgatttcacatactacgcagactccgtgaagggccgattcaccatctccagggacaattccaggaacacggtttatcttcaaatgaacaacctgagaggcgacgacacggccgtctattactgtgcgagacaagtcggcgctcggagtggttattattcgtttgacttctggggccagggaaccctggtcacgtcgctcgctccncaggccancgctcccctgcacctcctccagagcacctctggggcacagcggccctgggctgcctggtcaaggactacttcctatatctgtctgagcgggctggcaaggcgcatagnnnnnn

SEQ ID NO: 319223 - DNA, 557 bp, Homo sapiens
  misc_feature: GZ8MTXP02FJVIR.44.55.E11.1.454.CMB.2.raw
  modified_base (428)..(428): a, c, t, g, unknown or other
  misc_feature (428)..(428): n is a, c, g, or t
tcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctgggggtcccagagactctcctgtgcagcctctgggctcaccgtcagcagcaactacatgagttgggtccgccaggctccgaggggaaggggctggagtgggtctcgagtcatttatactggtgatttcacatactacgcagactccgtgaacgggccgattcaccatcctcagggacaattcccaggaactacggtttancttacaaatcgaaacaacctgagaggcgacgacacggcgtcattacgtgtgcgagaccaagtccggcgcgtcggtagtcgggttaatttacgtttcggtttcgacgtttcgtcgggggcctaacggggg

SEQ ID NO: 319224 - DNA, 596 bp, Homo sapiens
  misc_feature: GZ8MTXP02HJAHZ.44.55.E11.1.454.CMB.2.raw
  modified_base (433)..(433): a, c, t, g, unknown or other
  misc_feature (433)..(433): n is a, c, g, or t
  modified_base (439)..(439): a, c, t, g, unknown or other
  misc_feature (439)..(439): n is a, c, g, or t
  modified_base (491)..(491): a, c, t, g, unknown or other
  misc_feature (491)..(491): n is a, c, g, or t
tcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctgggggtcccagagactctcctgtgcagcctctgggctcacccgtcagcagcaactacatgagttcggccgccaggctccgaaggggaaggggctgggagtgggtctcagtctatttatacgtggtgtatttcacatactagcagactccgtagaacgggccattccacatcctaccgaggacaattccaaggaactacggtttancttaanaaatgaaacacgtagaagacggacgacgacgtaccggccttacttattacgnggtacgacggaacgaaccgaacggtccggacgtcgtacggtaaggttaggtttaactttacgtttcggttacgtaccgtttcgggaccggggtaccgaaccgggg

SEQ ID NO: 319225 - DNA, 533 bp, Homo sapiens
  misc_feature: GZ8MTXP02FW5J1.44.55.E11.1.454.CMB.2.raw
  modified_base (349)..(349): a, c, t, g, unknown or other
  misc_feature (349)..(349): n is a, c, g, or t
  modified_base (386)..(386): a, c, t, g, unknown or other
  misc_feature (386)..(386): n is a, c, g, or t
  modified_base (389)..(389): a, c, t, g, unknown or other
  misc_feature (389)..(389): n is a, c, g, or t
  modified_base (414)..(414): a, c, t, g, unknown or other
  misc_feature (414)..(414): n is a, c, g, or t
  modified_base (487)..(487): a, c, t, g, unknown or other
  misc_feature (487)..(487): n is a, c, g, or t
  modified_base (520)..(520): a, c, t, g, unknown or other
  misc_feature (520)..(520): n is a, c, g, or t
tcagacagtatatacacgaccggtgctcgatttagcactcgcacgttgggtttgggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctgggggtcccagagactctcctgtgcagcctctgggctcaccgtcagcagcaactacatgagttgggccgccaggctccgaggggaaggggctggagtgggtctcgagtcatttatactggtnatttcacatactacgcagactcgtgaaggcattcacntcncaggacaatccaggaacaggtttancttacaaaatgaaacctaacctgaagaggacgacgacgacggccgttctattactgtgcgagacaagtcggcncgtcggagtggttaattatcgtttgactttcgnggggcctaacggg

SEQ ID NO: 319226 - DNA, 557 bp, Homo sapiens
  misc_feature: GZ8MTXP02JYQ5J.44.55.E11.1.454.CMB.2.raw
  modified_base (435)..(435): a, c, t, g, unknown or other
  misc_feature (435)..(435): n is a, c, g, or t
tcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctggggggtcccagagactctcctgtgcagcctctgggctcaccgtcagcagcaactacatgagttggtccgccaggctccgaggggaaggggctgggagtgggtctcgagtcatttatactggtgatttcactatactacgcagactccgtgaacgggccgattccaccatcctacccgagggacaagttccaggaactacggtttancttacgaaatgaaacactgagaggcgacgacacggccgtctatacgtgtgcgagacaagtcggcgcgtcggagttggttaattagtttccgtttgtaccgttcgtcgggggacctaacgggg

SEQ ID NO: 319227 - DNA, 575 bp, Homo sapiens
  misc_feature: GZ8MTXP02GQSSV.44.55.E11.1.454.CMB.2.raw
  modified_base (438)..(438): a, c, t, g, unknown or other
  misc_feature (438)..(438): n is a, c, g, or t
tcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtggggggtcccagagactctcctgtgcagcctctgggctcaccgtcagcagcaactacatgagttgggtccgccaggcctccgaggggaaggggctgggagtgggtctcagtcatttatactggtgatttcacatactacgcagactccgtagaacgggccgattccaccatcctaccgagggacaaagttccaaggtaactacggtttaanccgttacaaaattgaaacacctagagacgggcgaacgacgacggcgtactattactgtgacgagacaggtcggcgcgtacgggagttggttaatttacgttcgtttacgacgtttcgtcgggggtacctaaccgggg

SEQ ID NO: 319228 - DNA, 588 bp, Homo sapiens
  misc_feature: GZ8MTXP02JL1YG.44.55.E11.1.454.CMB.2.raw
  modified_base (278)..(278): a, c, t, g, unknown or other
  misc_feature (278)..(278): n is a, c, g, or t
  modified_base (280)..(280): a, c, t, g, unknown or other
  misc_feature (280)..(280): n is a, c, g, or t
  modified_base (360)..(360): a, c, t, g, unknown or other
  misc_feature (360)..(360): n is a, c, g, or t
tcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctgggggtcccagagactctcctgtgcagcctctgggctcaccgtaccccgnanacaactacatgaggtcggccgcgaggcctacggaggggagggcgtgggaggtgggtctcgtagtctatttatacgtggtntattcactatacacgcacgactccgtagacggcctatccacatcacgaggactaatcaagaactacgttatactacaaatacaaacacgtagagacggacgacgacgaccggtccgtactatacgtgtacgacgagaacgtaacggtccggacgtccgtacgggtagttaggtttaatttacgtttacggtttacgtaccgtttcggtacggggtacccgtaacgggg

SEQ ID NO: 319229 - DNA, 544 bp, Homo sapiens
  misc_feature: GZ8MTXP02JD20Q.44.55.E11.1.454.CMB.2.raw
  modified_base (424)..(424): a, c, t, g, unknown or other
  misc_feature (424)..(424): n is a, c, g, or t
tcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctgggggtcccagagactctcctgtgcagcctctgggctcaccgtcagcagcaactacatgagttgggtccgccaggctccgaggggaaggggctggagtgggtctcagtcatttatactggtgatttcacatactacgcagactccgtagaaggggccatcaccatctccgagggacaattccaggaactacggtttancttacaaatgaaacacctgacgaggcgacgacacggccgtactattactgtgcgagacaacggtcggcgtctcgggagtggtttaatagtttcgttgacgttcgtcggggcctaacgggg

SEQ ID NO: 319230 - DNA, 532 bp, Homo sapiens
  misc_feature: GZ8MTXP02GD8VW.44.55.E11.1.454.CMB.2.raw
  modified_base (421)..(421): a, c, t, g, unknown or other
  misc_feature (421)..(421): n is a, c, g, or t
  modified_base (464)..(464): a, c, t, g, unknown or other
  misc_feature (464)..(464): n is a, c, g, or t
tcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctgggggtcccagagactctcctgtgcagcctctgggctcaccgtcagcagcaactacatgagttgggtccgcaggctccgaggggaaggggctggagtgggtctcagtcatttatactggtgatttcacatactacgcagactccgtgaaggcgattcaccatcctcagggacaattccaggaacacggtttanctacaaatgaaacactgagagcacgacacggccgtctattacngtgcgagacaaggtcgcgcctacggagtgttaacgttattcgtttgacttcgtcggggcctaacgggg

SEQ ID NO: 319231 - DNA, 607 bp, Homo sapiens
  misc_feature: GZ8MTXP02GOAHD.44.55.E11.1.454.CMB.2.raw
  modified_base (233)..(233): a, c, t, g, unknown or other
  misc_feature (233)..(233): n is a, c, g, or t
  modified_base (249)..(249): a, c, t, g, unknown or other
  misc_feature (249)..(249): n is a, c, g, or t
  modified_base (280)..(280): a, c, t, g, unknown or other
  misc_feature (280)..(280): n is a, c, g, or t
  modified_base (290)..(290): a, c, t, g, unknown or other
  misc_feature (290)..(290): n is a, c, g, or t
  modified_base (303)..(303): a, c, t, g, unknown or other
  misc_feature (303)..(303): n is a, c, g, or t
  modified_base (305)..(305): a, c, t, g, unknown or other
  misc_feature (305)..(305): n is a, c, g, or t
tcagacagtatatacacgaccggtgctcgatttagcactcgcacgttgggtttggggggagaggagcccagcactgggattccgaggtgtttccattcggtgatcagcactgaacacagaggactcaccatggagttttggctgagcgtggttgcctaggtggactttaaagtgtcagtgtgaggtgcggctgatggagtctggaggaggcttagtccagcctgggggtccgngagactctcctgtgcncgctcgtggctcacgtcagcagcacacatgngtggtcgcgngcgcgaggagggngnggtggtggtcgtcgagtctattatacgtcgtgtattactactactactacgcacgtacgtaccgtacgacggtacgtactactacctactactacgacggaacgtaactacgacgtaacgtaacgttacttacttactaaagtaacgtaactaacgtacgaggacggacgaaccgacgaccggaccgtacgtacgttacgtacgtcgtacgacgacgaacggtacggtacggtcgtacggtaggttaggttaacgtttacgtttacggtttacgttacgttacggtcgggtaccggtaccgg

SEQ ID NO: 319232 - DNA, 552 bp, Homo sapiens
  misc_feature: GZ8MTXP02JNCPV.44.55.E11.1.454.CMB.2.raw
  modified_base (296)..(296): a, c, t, g, unknown or other
  misc_feature (296)..(296): n is a, c, g, or t
  modified_base (346)..(346): a, c, t, g, unknown or other
  misc_feature (346)..(346): n is a, c, g, or t
  modified_base (390)..(390): a, c, t, g, unknown or other
  misc_feature (390)..(390): n is a, c, g, or t
tcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctgggggtcccagagactctcctgtgcagcctctgggctcaccgtcagcagcaactacatgagttgggtccncaggctccgaggggaagggctggagtgggtctcagtcatttatactggtnatttcaactatactacgcaagctccgtagaagggccattcaccntctccagggacaagttcaggaactacggttatctacaaatgaacaacctgagaggacacgacacggcgtctattactgtcgcgagacaacgtcggacgtcgtcgggtagttgggttaatttagttcgtttcgtacgtttcgtacgggggtaccaaaccgggg

SEQ ID NO: 319233 - DNA, 744 bp, Homo sapiens
  misc_feature: GZ8MTXP02I7K6W.44.55.E11.1.454.CMB.2.raw
  modified_base (256)..(256): a, c, t, g, unknown or other
  misc_feature (256)..(256): n is a, c, g, or t
tcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccgcgtcgggtccgggcagacgtctcctcgtgtcngcgtctcggcggtctaccgtaccgtcgcgacgacgactaaacctactagtaggttaggggtttcccgggccccgaccggacggtcccgtaccggggaaaggggggacgggtcggtaggggtagggttcgggttcctacgttacgtactttaattaacgttacggtgggtattacttacaacttaacttaaccgtacgacgaacgtacccgttccgggtaaaggggacccgggtacttacctacccaaacctcttccccgaacggggaaacggtaaacttaccgttaccggaaaccggtaacgttttacgttactacctaaataaagtaacaaacccttacgaggacgggacgggaacccgaaccaacggcccgggttaccttaagttacctttaggcggtcgaacggacaaacgtccggggtcgcgtccggtacgtggtttattaagttcgtttcgtacgttcttcgggggcggtaacggtaacccgg

SEQ ID NO: 319234 - DNA, 620 bp, Homo sapiens
  misc_feature: GZ8MTXP02HDMI8.44.55.E11.1.454.CMB.2.raw
tcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctggggggtcccagagactctcctgtgcagcctcgtgggctcaccgtcagcagcaactacatgagttggtccgcaggctccgagggaaggggctggagtgggtctcgagtctatttatacgtggtgtatttcatatactacgcagactccgtagacgggccgattccacctatccctacgacgggactaattcccaagggaaacctacggttttactacttaacaaaatcgaaaccaacccgttaggaacggacgggaccgaaccggaaccgaccgggtacccgtacttacgttacgtggtacggacgacgaacgaaggtccgggccgacgttacgggagttgggtttaattacgtttcgtttcgtactttcggtcgggggacctaaccggggg

SEQ ID NO: 319235 - DNA, 639 bp, Homo sapiens
  misc_feature: GZ8MTXP02H6AQR.44.55.E11.1.454.CMB.2.raw
  modified_base (299)..(299): a, c, t, g, unknown or other
  misc_feature (299)..(299): n is a, c, g, or t
tcagacagtatatacacgaccggtgctcgatttagcactcgcacgttgggtttggggggagaggagcccagcactgggattccgaggtgtttccattcggtgatcagcactgaacacagaggactcaccatggagttttggctgagcgtggttctccttgttggacttttaaaaggtgtccagtgtgaggtgcggctgatggagtctggaggaggcttagtccagccgtgggggtccagagactctcctgtgcagcctcgtgggctcaccgtcagcagcaactacatgagtttgggccnccaggctccgaggggaaggggctgggagtggggtactcagtctatttatactggtgatttcactatactacgcagactccgtagaagggccattcaaccctatcctcccgaagggaaccaatttacccgaagggtaaacctacggtttactcttacaaaattcgaaaacaaccgtggaagacgggacctaacgacgaacgggccccttataacttacgtgtcgacgaaggacccaaaggtccgggccgtaccgtacgggggtaagtttggggtttaaatttaccggttacggtttttacggaaccgttttccgtacggggggttacccaaaaccgggggg

SEQ ID NO: 319236 - DNA, 532 bp, Homo sapiens
  misc_feature: GZ8MTXP02JBL9M.44.55.E11.1.454.CMB.2.raw
  modified_base (297)..(297): a, c, t, g, unknown or other
  misc_feature (297)..(297): n is a, c, g, or t
  modified_base (392)..(392): a, c, t, g, unknown or other
  misc_feature (392)..(392): n is a, c, g, or t
  modified_base (412)..(412): a, c, t, g, unknown or other
  misc_feature (412)..(412): n is a, c, g, or t
  modified_base (416)..(416): a, c, t, g, unknown or other
  misc_feature (416)..(416): n is a, c, g, or t
tcagacagtatatacacgaccggtgctcgatttagcactcgcacgttgggtttggggagaggagcccagcactgggattccgaggtgtttccattcggtgatcagcactgaacacagaggactcaccatggagttttggctgagctggggttctccttgttggacttttaaaaggtgtccagtgtgaggtgcggctgatggagtctggaggaggcttagtccagcctgggggtcccagagactctcctgtgcagcctctgggctcaccgtcagcagcaactacatgagttgggtccnccaggctccgagggaaggggctggagtggggtctcagtcatttatactggtgatttcactatactacgcagactccgtgaagggcgatcacatcncaggacatcagacacgttancttnaaatgaacactgagaggcgacgacacggccgtctattactgtcgcgagacaagtccggacgcgtcggagtggttaattagttcgtttacgactttcgtacgggggtcctaacgggg

SEQ ID NO: 319237 - DNA, 541 bp, Homo sapiens
  misc_feature: GZ8MTXP02I1H0G.44.55.E11.1.454.CMB.2.raw
  modified_base (306)..(306): a, c, t, g, unknown or other
  misc_feature (306)..(306): n is a, c, g, or t
  modified_base (356)..(356): a, c, t, g, unknown or other
  misc_feature (356)..(356): n is a, c, g, or t
  modified_base (456)..(456): a, c, t, g, unknown or other
  misc_feature (456)..(456): n is a, c, g, or t
tcagacagtatatacacgaccggtgctcgatttagcactcgcacgttgggtttggggagcttcagctgtgggtagagaagacaggactcaggacgatctccagcatggccagcttccctctcctcctcaccctcctcactcactgtgcagggtcctgggcccagtctgtgatgtctcagccaccctcagcgtctcgggacccccggcagggggtcaccatctcttgttctggaaggagtccaatatcggatcttatcctgtcaactggtatcgggactcccaggccaccggccccccgatccttanctatcgctactaatcagccgccctcgacggggtccctgcccgtattcccnctggctccaagtcctggcactacgaggcctaccgtggcctatcccttgactctccagtctgagatgagctgtattactactgtgcagcagtgggatgacnggaccggacggcgtggggtcgttcgggcgggaaggacgtagttcgaccgttcgaaggtcacggcccgaggcctcgcccccgtcgg

SEQ ID NO: 319238 - DNA, 513 bp, Homo sapiens
  misc_feature: GZ8MTXP02GIADD.44.55.E11.1.454.CMB.2.raw
  modified_base (403)..(403): a, c, t, g, unknown or other
  misc_feature (403)..(403): n is a, c, g, or t
  modified_base (424)..(424): a, c, t, g, unknown or other
  misc_feature (424)..(424): n is a, c, g, or t
tcagacagtatatacacgaccggtgctcgatttagcactcgcacgttgggtttggggagcttcagctgtgggtagagaagacaggactcaggacgatctccagcatggccagcttccctctcctcctcaccctcctcactcactgtgcagggtcctgggcccagtctgtgatgtctcagccaccctcagcgtctgggacccccgggcagggggtcaccatctcttgtctggaagagtccaatatcggatcttatcctgtcaactggtatcggggactcccaggccacggcccccgactcctatctatgctactaatcagcgccctcgacggggtccctgcccgtatcctctgctccaagtctggcactacaggctacctgccatcctgatctccagtctgagntgaggctgtattactactgtncgagcagtggatgacgagccggagcgtgggtcgtcgggcggtagggacacggttacgaccgtcgtaagtcacgccgagctcgccctcgg

SEQ ID NO: 319239 - DNA, 627 bp, Homo sapiens
  misc_feature: GZ8MTXP02G2H5V.44.55.E11.1.454.CMB.2.raw
tcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctgggggtcccagagactctcctgtgcagcctctggctcaccgtcagcagcaactacatgagttgggtccgccaggctccgaggggaaggggctgggagtgggtctcagtcatttatactggtgtatttcactatactacgcagactccgtagaacgggccgattcaccatcctccagggacaattccaggaactacggtttatcgtacaaaatgaaaccaccgttgaacgtacgggacgaaccggacgaccggggaccttcgtaacttaccgtgttacggacgaacggacaaacggttccgggaacgtccgttaccggggagtttaggggtttaactttaaggttttccggtttttacggaaccgttttccggttcggggggtaccctaaacccgggggg

SEQ ID NO: 319240 - DNA, 556 bp, Homo sapiens
  misc_feature: GZ8MTXP02I94X5.44.55.E11.1.454.CMB.2.raw
  modified_base (422)..(422): a, c, t, g, unknown or other
  misc_feature (422)..(422): n is a, c, g, or t
tcagacagtatatacacgaccggtgctcgatttagcactcgcacgttgggtttgggggagaggagcccagcactgggattccgaggtgtttccattcggtgatcagcactgaacacagaggactcaccatggagtttttggctgagcgtggttcgtcctaggtggactttaaaggtgtccagtgtgaggtgcggctgatggagtctggaggaggcttagtccagcctggggggtcccagagactctcctgtgcagcctctgggctcaccgtcagcagcactacatgagtggtccgcaggctccaggaaggggcgtggagtgggtcgtcagtcattatactgtgattcacatactacgcagactccgtgagggcgattcaccatctcaggacaattacacgaacacggttatctactaaatanaacaacctagagaggacgacgacgaacggccggtcctattaactgttgaccgagaccgaaagtacggcgtccggtacggtaggttaggttaagttacgtttacgtttacgttacgttcggtcggtacggtacgg

SEQ ID NO: 319241 - DNA, 570 bp, Homo sapiens
  misc_feature: GZ8MTXP02HRBA9.44.55.E11.1.454.CMB.2.raw
  modified_base (297)..(297): a, c, t, g, unknown or other
  misc_feature (297)..(297): n is a, c, g, or t
  modified_base (491)..(491): a, c, t, g, unknown or other
  misc_feature (491)..(491): n is a, c, g, or t
tcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtgggggtcccagagactctcctgtgcagcctcgtgggctcaccgtcagcagcaactacatgagttggtccncaggctccgaggggaggggctgggagtgggtctcgagtctatttatactggtgtatttcactatacctacgcagactccgtgaacgggccattccaccatctacacgggacaattaccaaggtaactacggtttatcttacaaaattacgaaacaaccttagagacgggacgaccgacacggcctcgtattacngtacgcgagacaaggtcgacgcgtacggagttaggtaatttagttcgtttagactttcggtcgggtaccgtaaccgggg

SEQ ID NO: 319242 - DNA, 542 bp, Homo sapiens
  misc_feature: GZ8MTXP02IUXA3.44.55.E11.1.454.CMB.2.raw
  modified_base (420)..(420): a, c, t, g, unknown or other
  misc_feature (420)..(420): n is a, c, g, or t
tcagacagtatatacacgaccggtgctcgatttagcactcgcacgttgggtttgggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctgggggtcccagagactctcctgtgcagcctctgggctcaccgtcagcagcaactacatgagttgggtccgccaggctccgaggggaaggggctggagtgggtctcagtcatttatactggtgatttcacatactacgcagactccgtagaaggggcattcacatctccagggacaattcaggaactacgttancttacaaatgaacaactgagaggacgacgacacggccgtactattactgtgacgagacaacggtcggcgcgtcggagtggtttaattagtttcgtttgactttcgtggggaccctaacgggg

SEQ ID NO: 319243 - DNA, 675 bp, Homo sapiens
  misc_feature: GZ8MTXP02JG5HM.44.55.E11.1.454.CMB.2.raw
tcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaggtgtccagtgtgaggtgcggctgatggagtctggaggaggcttagtccagccgtgggggtcccagagactctcctgtgcagcctcgtgggctcaccgtcagcagcaactacatgagttgggtccgccaggctccgagggaagggctggagtgggtctcagtctatttatacgtggtgtatttcaactatacgtacgcaagacctccgtagaacgggtccgtattccaaccaattccctacccgaaggggtacctaaacgtttacccgaacggggtaaacctaccgggtttttaactaccgtttaacaaaaacttacggaaaaccctaacccgttaggaacgggaacgggaccgaaacccgaaccgacccgggtacccgttacttaacgttacccgtgtacgaccggacgaaacgtaaacggtccggacgtacgtacgggtagttaggtttaacttaacgtttcgtttacgtacgtttcggtcgggggacccgtaaccgggg

SEQ ID NO: 319244 - DNA, 606 bp, Homo sapiens
  misc_feature: GZ8MTXP02H5LEA.44.55.E11.1.454.CMB.2.raw
  modified_base (299)..(299): a, c, t, g, unknown or other
  misc_feature (299)..(299): n is a, c, g, or t
  modified_base (453)..(453): a, c, t, g, unknown or other
  misc_feature (453)..(453): n is a, c, g, or t
tcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtgggggtccagagactctcctgtgcagcctcgtggctcaccgtcagcagcaaactacatgagttgggtccnccaggctccgaggggaaggggctgggagtgggtctcagtctattatactggtgtatttcactatactacgcaagactccgtagaacggcgaattccaacctatctaccgaagggacaagttaccaagggtaaactaccggtttaatccttaaanaaatacgaaactacgtagaaggacggacgaaccgaccgtacggtaccgtattaacttacgtgacgacgaagacgaaacggtccggacgtacgtacgggtagttaggttaatttacgttcgttacgtacgtttcggacggggtaaccgaacggg

SEQ ID NO: 319245 - DNA, 647 bp, Homo sapiens
  misc_feature: GZ8MTXP02GYXC7.44.55.E11.1.454.CMB.2.raw
  modified_base (541)..(541): a, c, t, g, unknown or other
  misc_feature (541)..(541): n is a, c, g, or t
tcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtgggggtcccagagactctcctgtgcagcctcgtgggctcaccgtcagcagcaactacatgagttgggtccgccaggcctccgaggggaaggggctgggagtgggtctcgagtcatttatacgtggtgtatttcactatactacgcagactccgtagaagggcagtacttccaaacctatcctaccgaagggaacctaaacgttcccgaaaggtaaaccgtacggtttaatctttaaacgaaaattacggaaaaccctaaacgtggaaacggaggacccgaacggaaccgaccggcccgttactaactttaccgngtacggacgtaagaacgaaacgggttccgggcgtcgtacgggtaaggttaacgggttttaattacgtttcggtttagtaaccgtttcggttacgggggaaccccgg

SEQ ID NO: 319246 - DNA, 530 bp, Homo sapiens
  misc_feature: GZ8MTXP02J1QRL.44.55.E11.1.454.CMB.2.raw
  modified_base (340)..(340): a, c, t, g, unknown or other
  misc_feature (340)..(340): n is a, c, g, or t
  modified_base (470)..(470): a, c, t, g, unknown or other
  misc_feature (470)..(470): n is a, c, g, or t
tcagacagtatatacacgaccggtgctcgatttagcactcgcacgttgggtttggggagaggagcccagcactgggattccgaggtgtttccattcggtgatcagcactgaacacagaggactcaccatggagttttggctgagctggggttctccttgttggacttttaaaaggtgtccagtgtgaggtgcggctgatggagtctggaggaggcttagtccagcctgggggtcccagagactctcctgtgcagcctctgggctcaccgtcagcagcaactacatgagttggtccgccaggctccgagggaaggggctggagtgggtctcagtcatttanactggtgatttcacatactacgcagactccgtagagggccgattcacctatctccgagggacaagttccaggaacacggtttatcttacaaatgaacactgagaggcgacgacgacggccgtctattacngtgcgagacacgtcgcgctcggagttggtaattagttcgttgacttcgcgggctaacggg

SEQ ID NO: 319247 - DNA, 732 bp, Homo sapiens
  misc_feature: GZ8MTXP02JTTXT.44.55.E11.1.454.CMB.2.raw
tcagacagtatatacacgaccggtgctcgatttagcactcgcacgttgggtttggggagcttcagctgtgggtagagaagacaggactcaggacgatctccagcatggccagcttccctctcctcctcaccctcctcactcactgtgcagggtcctgggcccagtctgtgatgtctcagccaccctcagcgtctcgggaccccccgggcagggggtcaccatctcttgttctggaaggagtccaatatcggatcttatcctgtcaactggtatcggggactcccaggccaccggccccccgactccttatctatgctactaatcagcgccctcgacggggtccctgccccgtattccctctggcctccaagtctgggcctacctacgacggtcctaccgtcggaccctacttcccgttagacttccctcccgtagttcccgttaggacggtagtcggaacgggtccttaggtaaacttttacgttaaccgttggttcgaccaggtaccgtaaggtgggggtaacttcggaaaccgtaacggggacccggggtaaacgggtcggttacgggggttacgggtttccgggggaccggggaaacgggggtaaacccggtaaacgggtttaccgggtaaccccgggtttacccgttaacgggggttacccgtaacccgggaccccggtaaaacgggggtcccgtttaccccggggtacccccccgtttacccggggg

SEQ ID NO: 319248 - DNA, 555 bp, Homo sapiens
  misc_feature: GZ8MTXP02H3MXO.44.55.E11.1.454.CMB.2.raw
  modified_base (382)..(382): a, c, t, g, unknown or other
  misc_feature (382)..(382): n is a, c, g, or t
tcagacagtatatacacgaccggtgctcgatttagcactcgcacgttgggtttggggagcttcagctgtgggtagagaagacaggactcaggacgatctccagcatggccagcttccctctcctcctcaccctcctcactcactgtgcagggtcctgggcccagtctgtgatgtctcagccaccctcagcgtctgggacccccgggcagggggtcaccatctcttgttctggaaggaagtccaatatcggatcttatcctgtcaactggtatcggggactcccaggccaccggcccccgactcctatctatgctacaatcacgcgccctcgacggggtccctgccccgtattccctctcggctaccaagtctcggcactacncggcctaccgtcggcctactcccttgacttcctccagtctagagatggagtctagactttactactgtgcagcagtgggatgacgacggcggaacggcgtgggtcgttcggcgaggacggacctaaggttcgacccggtcgtaggacacgacccgaggtcctaccggcccccg

SEQ ID NO: 319249 - DNA, 556 bp, Homo sapiens
  misc_feature: GZ8MTXP02GF0IM.44.55.E11.1.454.CMB.2.raw
tcagacagtatatacacgaccggtgctcgatttagcactcgcacgttgggtttggggagaggagcccagcactgggattccgaggtgtttccattcggtgatcagcactgaacacagaggactcaccatggagttttggctgagctggggttctccttgttggacttttaaaaggtgtccagtgtgaggtgcggctgatggagtctggaggaggcttagtccagcctggggggtcccagagactctcctgtgcagcctctgggctcaccgtcagcagcaactacatgagttggtccgcaggctccgaggggaaggggctgggagtggggtctcgagtcatttatactggtgatttcactatactacgcagactccgtgaagggcgattcacatctcgaggacaatccaggaactacggtttatactacaaactgaaacaaccgtgaagtacgggacgacgacgacggccgtacattacctgtacgcgagacaggtcggcgcgtacggagttcggttaattacgttcgtttgacgtttcgacggggtcctaacgggg

SEQ ID NO: 319250 - DNA, 663 bp, Homo sapiens
  misc_feature: GZ8MTXP02HOSUD.44.55.E11.1.454.CMB.2.raw
  modified_base (296)..(296): a, c, t, g, unknown or other
  misc_feature (296)..(296): n is a, c, g, or t
  modified_base (353)..(353): a, c, t, g, unknown or other
  misc_feature (353)..(353): n is a, c, g, or t
tcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctggggggtcccagagactctcctgtgcagcctctgggctcaccgtcagcagcaactacatgagttggtccncaggctccgaggggaaggggcgtgggagtgggtctcgagtctatttatacgtgggtntatttcactatacctacgctagactccggtgaaacgggccgtaattccacctatcctaccgaagggactaacgttacccgaaggtaaacctacggtttaactacctttaacaaaattcgaaaacctaaaccgttaggaacggacgggaccgaacggaccgacggcccgttactaattaccgtgtacgaccgaagaacccgtaaagggttccgggccgtccggtacggggttaacggttagggttttaacgtttaagtttaccgggtttttgaaccggttttccggtcgggggtaccccgtaaaccggggg

SEQ ID NO: 319251 - DNA, 528 bp, Homo sapiens
  misc_feature: GZ8MTXP02JZ7MG.44.55.E11.1.454.CMB.2.raw
  modified_base (414)..(414): a, c, t, g, unknown or other
  misc_feature (414)..(414): n is a, c, g, or t
  modified_base (461)..(461): a, c, t, g, unknown or other
  misc_feature (461)..(461): n is a, c, g, or t
  modified_base (464)..(464): a, c, t, g, unknown or other
  misc_feature (464)..(464): n is a, c, g, or t
tcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctggggggtcccagagactctcctgtgcagcctctgggctcaccgtcagcagcaactacatgagttgggtccgccaggctccgagggaaggggctggagtgggtctcagtcatttatactggtgatttcacatactacgcagactccgtgaagggccatcacatctcaggacaatcagaacacgttanctcaaatgaaacaacctgagaggacgacgacacggccgtctattacngtncgagacaacgtcggcgctcggagtggtaattattcgtttcgactttcgtcgggggccaacgggg

SEQ ID NO: 319252 - DNA, 547 bp, Homo sapiens
  misc_feature: GZ8MTXP02JARK9.44.55.E11.1.454.CMB.2.raw
  modified_base (424)..(424): a, c, t, g, unknown or other
  misc_feature (424)..(424): n is a, c, g, or t
  modified_base (475)..(475): a, c, t, g, unknown or other
  misc_feature (475)..(475): n is a, c, g, or t
tcagacagtatatacacgaccggtgctcgatttagcactcgcacgttgggtttgggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctgggggtcccagagactctcctgtgcagcctctgggctcaccgtcagcagcaactacatgagttggtccgcaggctccgagggaagggctggagtgggtctcgagtctatttatactggtgtatttcacatactacgcagactccgtagaaggccgattcaccatcctacgaggactaattcaggaactacggtttancttacaaatgaaacaactgagaggacgaacgacacggccgtactattacgngtcgacgagacgaacgtcggcacgtcggatggttaattacgttcgttcgactttcgcggggtcctaacgggg

SEQ ID NO: 319253 - DNA, 569 bp, Homo sapiens
  misc_feature: GZ8MTXP02I9F7N.44.55.E11.1.454.CMB.2.raw
  modified_base (330)..(330): a, c, t, g, unknown or other
  misc_feature (330)..(330): n is a, c, g, or t
tcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtgggggtcccagagactctcctgtgcagcctctgggctcaccgtcagcagcaactacatgagttggccgccaggctccgagggaagggctggagtgggtctnagtctatttatactggtgtatttcacatactacgcagactccgtagaacgggccgattccaaccatcctacccgagggacaattaccaggaaacctacggtttatcttaacaaattcgaaactaacctgaagacggacgaacgacacgggcctatacgtactgtacgcgagacaaacggtcgcgccgtacggtgtaggttaattagttcgtttgacgtttcgtcggggacctaacgggg

SEQ ID NO: 319254 - DNA, 571 bp, Homo sapiens
  misc_feature: GZ8MTXP02IUQSK.44.55.E11.1.454.CMB.2.raw
  modified_base (299)..(299): a, c, t, g, unknown or other
  misc_feature (299)..(299): n is a, c, g, or t
tcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtgggggtcccagagactctcctgtgcagcctctgggctcaccgtcagcagcaactacatgagttgggtccncaggctccgaggggaagggctggagtgggtctcagtctatttatactggtgatttcactatacctacgcagactccggtagaacgggccgtattccaccatcctccgagggactaagttccgaaggtaactacggtttatcttacaaatcgaaacaacctgacgaggacgacgacacggcgtactatacgtgtcgacgagactaacggtcggacgcgtcggaagttggttaattacgttcgtttacgactttcgtcggggacctaaccgggg

SEQ ID NO: 319255 - DNA, 621 bp, Homo sapiens
  misc_feature: GZ8MTXP02HUSKQ.44.55.E11.1.454.CMB.2.raw
  modified_base (519)..(519): a, c, t, g, unknown or other
  misc_feature (519)..(519): n is a, c, g, or t
tcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctgggggtcccagagactctcctgtgcagcctcgtgggctcaccgtcagcagcaactacatgagttgggtccgccgaggctccgaggggaagggcgtgggaggtggggtctcgagtctatttatacgtggtagtatttcaactatacgtacgcaagactcccgtagaaacgggccgattcaacctatcctcccaaggggacaaacgttcccgaaagggaacctaacgggttttaactctttaacaaaaagttcgaaaacaaccgttagaaggacggacgaacgtacacgggcctntaacttactggcgcgaagaccaaagtccgggcgtcctcggggtaattggtttaaattagtttccggtttagaccgtttcggcgggggtacccaaaccggggg

SEQ ID NO: 319256 - DNA, 572 bp, Homo sapiens
  misc_feature: GZ8MTXP02H4X5Z.44.55.E11.1.454.CMB.2.raw
  modified_base (441)..(441): a, c, t, g, unknown or other
  misc_feature (441)..(441): n is a, c, g, or t
  modified_base (488)..(488): a, c, t, g, unknown or other
  misc_feature (488)..(488): n is a, c, g, or t
tcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctgggggtcccagagactctcctgtgcagcctctgggctcaccgtcagcagcaactacatgagttgggtccgccaggctccgaggggaggggctggagtgggtctcagtcatttatactggtagtatttcactatactacgcagactccgtagaacgggtccgattccaccatcctccgaagggacaattcccaagggaactacggttatcttanaaatgaaaccactgacgaggccaacgacacggccgtactaattacgngtcgacgagacaaaggtccgggcgcgtacgggtagttggtttaattacgtttgtttcgacgttcgttgggggaccctaacgggg

SEQ ID NO: 319257 - DNA, 544 bp, Homo sapiens
  misc_feature: GZ8MTXP02GAQ7K.44.55.E11.1.454.CMB.2.raw
  modified_base (416)..(416): a, c, t, g, unknown or other
  misc_feature (416)..(416): n is a, c, g, or t
  modified_base (420)..(420): a, c, t, g, unknown or other
  misc_feature (420)..(420): n is a, c, g, or t
tcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtgggggtcccagagactctcctgtgcagcctctgggctcaccgtcagcagcaactacatgagttgggtccgccaggctccgaggggaaggggctggagtgggtctcgagtcatttatactggtgatttcacatactagcagactccgtgaacggccgattcacatctcaggacaatcaggactacgttanctanaaatgaacactgagaggcgacgacgacggccgtactatacgtgtgaccggagacgaacgtcggcgcgtcggagtggtttaattagtttcggtttgacgtttcggtacggggtaccgtaacgggg

SEQ ID NO: 319258 - DNA, 534 bp, Homo sapiens
  misc_feature: GZ8MTXP02F4F0T.44.55.E11.1.454.CMB.2.raw
  modified_base (418)..(418): a, c, t, g, unknown or other
  misc_feature (418)..(418): n is a, c, g, or t
  modified_base (421)..(421): a, c, t, g, unknown or other
  misc_feature (421)..(421): n is a, c, g, or t
  modified_base (464)..(464): a, c, t, g, unknown or other
  misc_feature (464)..(464): n is a, c, g, or t
tcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggaattttaaaaggtgtccagtgtgaggtgcggctgatggagtctggaggaggcttagtccagcctgggggtcccagagactctcctgtgcagcctctgggctcaccgtcagcagcaactacatgagttggtccgccaggctccgaggggaaggggctggagtggggtctcgagtcatttatactggtgatttcacatactacgcagactccgtgaacgggcattcacatctccaggacaattccagaacacggttanctnaaatgaaacacctgagaggcgacgacacggccgtactattacngtgacgagacaagtcggcgcgtcggagtggttaattagttcgttgacgtttcgtacgggggctaacgggg

SEQ ID NO: 319259 - DNA, 545 bp, Homo sapiens
  misc_feature: GZ8MTXP02F7W7V.44.55.E11.1.454.CMB.2.raw
  modified_base (297)..(297): a, c, t, g, unknown or other
  misc_feature (297)..(297): n is a, c, g, or t
  modified_base (416)..(416): a, c, t, g, unknown or other
  misc_feature (416)..(416): n is a, c, g, or t
tcagacagtatatacacgaccggtgctcgatttagcactcgcacgttgggtttgggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctgggggtcccagagactctcctgtgcagcctctgggctcaccgtcagcagcaactacatgagttgggtccnccaggctccgaggggaaggggctgggagtggggtctcagtcatttatactggtgatttcacatactacgcagactcgtgaaggcgatcacatctcaggacaatccagaacacggtttancttacaaatgaaacaactgagaggcgaaccgacgacggccgtctattacgtgtcgacgagacaacggtcggcgcgtcggagttggttaagttacttacggtttgtactttcggcggggtacctaacggg

SEQ ID NO: 319260 - DNA, 551 bp, Homo sapiens
  misc_feature: GZ8MTXP02HCMBT.44.55.E11.1.454.CMB.2.raw
  modified_base (298)..(298): a, c, t, g, unknown or other
  misc_feature (298)..(298): n is a, c, g, or t
  modified_base (392)..(392): a, c, t, g, unknown or other
  misc_feature (392)..(392): n is a, c, g, or t
  modified_base (418)..(418): a, c, t, g, unknown or other
  misc_feature (418)..(418): n is a, c, g, or t
tcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtgggggtcccagagactctcctgtgcagcctctgggctcaccgtcagcagcaactacatgagttgggccnccaggctccgagggaagggctggagtgggtctcagtcatttatactggtgatttcactatactacgcagactccgtagaagggcattcacatcncaggacaattccagaacacggtttancttacaaaatgaaacaacctgagaggacgacgacacggccgtactattacgtgtgccgagtacgaaacgtcggacgcgtcggagtggtttaatacgtttcgtttagaccttttcgacgggggcctaacggggg

SEQ ID NO: 319261 - DNA, 587 bp, Homo sapiens
  misc_feature: GZ8MTXP02HPHLN.44.55.E11.1.454.CMB.2.raw
tcagacagtatatacacgaccggtgctcgatttagcactcgcacgttgggtttggggagcttcagctgtgggtagagaagacaggactcaggacgatctccagcatggccagcttccctctcctcctcaccctcctcactcactgtgcagggtcctgggcccagtctgtgatgtctcagccaccctcagcgtctcgggacccccggcagggggtcaccatctcttgttctggaagagtccaatatcggatcttatctgtcaactggtatcggggactcccgaggccaccggcccccgactccttatctatgctactaatcagccggccctcgacggggtcccctgccccgtattccctctggcctccaagtcctggccactacgacgtcctacctcggcctatccttgactctccagttctgagactgaggctagattactactgtgcagcagtgggatgacgaggaccgggaacggtcggtggggttcggttcggggacgggtaacggggaccgtaacgggttcgtaacccggttcgtaacgggtccaacggtaccccgaacggtccgtccgtcccccgttaccgg

SEQ ID NO: 319262 - DNA, 532 bp, Homo sapiens
  misc_feature: GZ8MTXP02HVN74.44.55.E11.1.454.CMB.2.raw
  modified_base (333)..(333): a, c, t, g, unknown or other
  misc_feature (333)..(333): n is a, c, g, or t
  modified_base (435)..(435): a, c, t, g, unknown or other
  misc_feature (435)..(435): n is a, c, g, or t
  modified_base (476)..(476): a, c, t, g, unknown or other
  misc_feature (476)..(476): n is a, c, g, or t
tcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggagaggcttagtccagcctgggggtccagagactctctgtgcagcctctggctcaccgtcagcagcaactacatgagttggtccgccaggctccagggaagggctggagtgggtctcagtcatttanactggtgatttcactatactacgcagactccgtgaaggccgatcaccatctcagggacaagttccaaggaacacggttatcttacaaatgaaacaactgagngacgacgaacacgcgtcattactgtgcgagacaaagcggcncgtcggagtgggttaattagttacgtttgacgtttctacgggggtccaaaccgggg

SEQ ID NO: 319263 - DNA, 577 bp, Homo sapiens
  misc_feature: GZ8MTXP02H394X.44.55.E11.1.454.CMB.2.raw
  modified_base (485)..(485): a, c, t, g, unknown or other
  misc_feature (485)..(485): n is a, c, g, or t
tcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccaggccgtggggggtcccagagactctcctgtgcagcctcgtgggctccaccgtcagcagcaactacatgagttcgggtccgccaggctccgaggggaaggggctgggagtgggtctcagtctatttatactggtgtatttcactatactacgcagactccgtagaacgggccgattccaccctatcctaccgagggacaattccgaaggaactacggttatcttacaaatgaaacaacgtagagaggacacgacacggcctntactactgtcgcgagacaacggtcggacgcgtacggtagttgtttaagttacgtttcgtttacgaccgtttcggacggggtacccaacgggg

SEQ ID NO: 319264 - DNA, 587 bp, Homo sapiens
  misc_feature: GZ8MTXP02GL7OM.44.55.E11.1.454.CMB.2.raw
  modified_base (326)..(326): a, c, t, g, unknown or other
  misc_feature (326)..(326): n is a, c, g, or t
  modified_base (406)..(406): a, c, t, g, unknown or other
  misc_feature (406)..(406): n is a, c, g, or t
tcagacagtatatacacgaccggtgctcgatttagcactcgcacgttgggtttggggagcttcagctgtgggtagagaagacaggactcaggacgatctccagcatggccagcttccctctcctcctcaccctcctcactcactgtgcagggtcctgggcccagtctgtgatgtctcagcccaccctcagcgtcgtcgggaccccccgggcgagggggtcaccatctcttgttctggaagtaggtccaacatcggaaagttaattacgtatactggtatcggcaattcacaggacgccggtccccagacccctcatctagtagganaatcagcggccctcgacggggtccctgaccgtattccctctcgccctaccaacgtctcggccacctcacgtccctcccgnggccatcgagtcgggcctccgggtcccgaggtactggaggtctaggtatttacgtttcgtggtcggcggtcgttgggatgacagtctgagtgactgctagttcgggacggacgggaccaaggcgtacggacccgtcgtaacgtccgaacgtcccgaacggtcctacccggtcccccgtcgg

SEQ ID NO: 319265 - DNA, 413 bp, Homo sapiens
  misc_feature: GZ8MTXP02JLVJZ.44.55.E11.1.454.CMB.2.raw
  modified_base (311)..(311): a, c, t, g, unknown or other
  misc_feature (311)..(311): n is a, c, g, or t
  modified_base (406)..(413): a, c, t, g, unknown or other
  misc_feature (406)..(413): n is a, c, g, or t
tcagacagtatatacacgaccggtgctcgatttagcactcgcacgctggagtgggtctcagtcatttatactggtgatttcacatactacacagactccgtgaagggccgattcaccatctccagggacaattccaggaacacggtttatcttcaaatgaacaacctgagaggcgacgacacggccgtctattactgtgcgagacaagtcggcgctcggagtggttattattcgtttgacttctggggccagggaaccctggtcacgtcgcctcgctccaccaggccatcgctcccctgcacctcctcagngcactctggggcacagcggccctgggctgcctggtcaagggactacgttcctatactactgtctgagcggggtactgggccaaaggcgcataggnnnnnnnn

SEQ ID NO: 319266 - DNA, 538 bp, Homo sapiens
  misc_feature: GZ8MTXP02GOMMC.44.55.E11.1.454.CMB.2.raw
  modified_base (345)..(345): a, c, t, g, unknown or other
  misc_feature (345)..(345): n is a, c, g, or t
  modified_base (385)..(385): a, c, t, g, unknown or other
  misc_feature (385)..(385): n is a, c, g, or t
  modified_base (388)..(388): a, c, t, g, unknown or other
  misc_feature (388)..(388): n is a, c, g, or t
  modified_base (410)..(410): a, c, t, g, unknown or other
  misc_feature (410)..(410): n is a, c, g, or t
  modified_base (421)..(421): a, c, t, g, unknown or other
  misc_feature (421)..(421): n is a, c, g, or t
tcagacagtatatacacgaccggtgctcgatttagcactcgcacgttgggtttggggggagaggagcccagcactgggattccgaggtgtttccattcggtgatcagcactgaacacagaggactcaccatggagttttggctgagcgtggttcgtcctagtggactttaaaaggtgtccagtgtgaggtgcggctgatggagtctggaggaggcttagtccagcctgggggtcccagagactctcctgtgcagcctctggctcaccgtcagcagcaactacatgagttggtccgccagggctccgagggagggctggagtgggtctcagtcatttatactggtntattcactatactacgctacgctcgagacggtctatcacntcncgagacatcgagactacgttanactacaaatanacacagagacggacgacgacgacgacgtactactacgtgtgacgacgacgacgtacggacgcgtacggtaggtagttaagttacgttacgttacgtacgttcgtcggtacggtacgg

SEQ ID NO: 319267 - DNA, 634 bp, Homo sapiens
  misc_feature: GZ8MTXP02ILA4S.44.55.E11.1.454.CMB.2.raw
  modified_base (298)..(298): a, c, t, g, unknown or other
  misc_feature (298)..(298): n is a, c, g, or t
  modified_base (326)..(326): a, c, t, g, unknown or other
  misc_feature (326)..(326): n is a, c, g, or t
  modified_base (336)..(336): a, c, t, g, unknown or other
  misc_feature (336)..(336): n is a, c, g, or t
  modified_base (343)..(343): a, c, t, g, unknown or other
  misc_feature (343)..(343): n is a, c, g, or t
  modified_base (350)..(350): a, c, t, g, unknown or other
  misc_feature (350)..(350): n is a, c, g, or t
tcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtgggggtcccagagactctcctgtgcagcctcgtgggctcaccgtcagcagcaactacatgagttggccncaggctcgagggaggctggagtgggtcnagtcatttanactggtntattcanatactagcagctccgagaacggcattcaccatccgtacgagggaactaacgttacccgaaggtaaaccgttaacggtttaacttaccttaaacaaaacgttacggaaaaccctaacccgttaggaaacggtacgggaccgaaaccggacccgaaccgggtacccgttacttaacgtttaccgtggacgaccgagtaaccgaaacgtcgggacgtccgtacgggtagttggtttaatttacgttcgtttacggtactttccggttacggggacccgtaaccgggg

SEQ ID NO: 319268 - DNA, 576 bp, Homo sapiens
  misc_feature: GZ8MTXP02HKM16.44.55.E11.1.454.CMB.2.raw
  modified_base (397)..(397): a, c, t, g, unknown or other
  misc_feature (397)..(397): n is a, c, g, or t
  modified_base (425)..(425): a, c, t, g, unknown or other
  misc_feature (425)..(425): n is a, c, g, or t
  modified_base (473)..(473): a, c, t, g, unknown or other
  misc_feature (473)..(473): n is a, c, g, or t
tcagacagtatatacacgaccggtgctcgatttagcactcgcacgttgggtttgggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtgggggtcccagagactctcctgtgcagcctcgtggctcaccgtcatcagcaactacatgagttcgggtccgccaggctccgaggggaagggctgggagtgggtctcgagtctatttactactggtgtatttcactatacctacgcagactccgtgaacgggcattcacntcacaggacattcaggaactaggtttanctacaaatgtaaacacctgagaggcgacgacacggcctatacttacgngtcgacgaagaccgaaggtccggacgtcctacggggaagttgggtttaaactttagtttccggtttagaaccgttttcggacgggggttaccctaaacggggg

SEQ ID NO: 319269 - DNA, 700 bp, Homo sapiens
  misc_feature: GZ8MTXP02IMP8A.44.55.E11.1.454.CMB.2.raw
tcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtcgtggaggaggcttagtccagccgtgggggtcccagagactctcctgtgcagcctcgtgggctcaccgtcagcagcaactacatgagtcggtccgccaggctccgaggggaagggcgtgggagtgggtctcagtctatttatacgtggtgtatttcactataactacgcagtactccggtaggaacggggccgtattcccacctactcctaccgaaggggaacctaaacgttcccgaaagggtaaaccgttaacgggttttaaactccttaacaaaacgtacgaaaaccctaaaccgttaggaaggaacgggaccgaaccggaaccgaaccggggacccgttactaacggtttaaccgtgtacggacggtaaacggaacggtaaacggttccggggacggtaccgtacggggttaacgggtttacggttttaaagtttacggttttccggtttacggtaacctttccggggtaccgggggtaccgtaaacccggggg

SEQ ID NO: 319270 - DNA, 570 bp, Homo sapiens
  misc_feature: GZ8MTXP02I0ELN.44.55.E11.1.454.CMB.2.raw
tcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtggggggtccagagactctcctgtgcagcctcgtgggctcaccgtcagcagcaactacatgagttggtccgcaggctccgagggagggctggagtgggtctcgagtctattagtactggtgatttcaacatactacgcaagctccgtagaacggccgattcacctatctacccgagggactaaagttccgaaggtaacctacggtttactactactaaaatgaaacaaccgtgaagaggacgaacgacgacggcgtactattactcgtgacgagacaacgttcggcgtcgtacggagttggttaattgttacggtttcgacttcggtcggggacctaaccgggg

SEQ ID NO: 319271 - DNA, 544 bp, Homo sapiens
  misc_feature: GZ8MTXP02GSKY7.44.55.E11.1.454.CMB.2.raw
  modified_base (421)..(421): a, c, t, g, unknown or other
  misc_feature (421)..(421): n is a, c, g, or t
  modified_base (468)..(468): a, c, t, g, unknown or other
  misc_feature (468)..(468): n is a, c, g, or t
tcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctggggggtcccagagactctcctgtgcagcctctgggctcaccgtcagcagcaactacatgagttggtccgcaggctccgaggggaaggggctggagtgggtctcagtctatttatactggtgatttcactatactacgcagactccgtagaagggccattcacatctcgaggacaattccagaactacgttancttacaaatgaaacactgagaggcgacgacgacggcgtactattacngtcgcgagacaaggtcggcgcgtcggagttgggttaattatttcggttagtacgttcggtcggggacctaacgggg

SEQ ID NO: 319272 - DNA, 408 bp, Homo sapiens
  misc_feature: GZ8MTXP02H0LR1.44.55.E11.1.454.CMB.2.raw
  modified_base (404)..(408): a, c, t, g, unknown or other
  misc_feature (404)..(408): n is a, c, g, or t
tcagacagtatatacacgaccggtgctcgatttagcactcgcacgctggagtgggtctcagtcatttatactggttatttcacatactacgcagactccgtgaagggccgattcaccatctccagggacaattccaggaacacggtttatcttcaaatgaacaacctgagaggcgacgacacggccgtctattactgtgcgagacaagtcggcgctcggagtggttattattcgttgacttctggggccagggaccctggtcaccgtcgcctccgcctccaccaaggcccatcggctcccctggcaccctcctccaagcgcacctctggggcacagcggcctgggctgcctggtccaaggactactcctatatactgtctgagcgggctggcaaggcgcatagnnnnn

SEQ ID NO: 319273 - DNA, 657 bp, Homo sapiens
  misc_feature: GZ8MTXP02H06BW.44.55.E11.1.454.CMB.2.raw
  modified_base (532)..(532): a, c, t, g, unknown or other
  misc_feature (532)..(532): n is a, c, g, or t
tcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccaggccgtgggggtcccagagactctcctgtgcagcctctgggcctcaccgtcagcagcaactacatgagttggtccgccgaggctccgaggggaaggggctgggagtgggtctcgagtctatttatacgtggtgtatttcactatactacgcagactccgtagaaggccgattccacctatccaccgaagggactaaatttcccgaaggtaacctacggtttatacctttaacaaaagttacgaaaacctaacccgttaggaagacgggaccgaacgaccgtaccgggtacccgttacttaacgttaccgnggttacgaccggaagtaaaccgaaacggttccggaccgtccgtacggggtaacgttggggttttaaatttacgtttcgggttttacggtaaccgttttcgggtcgggggtaccctaaaccggggg

SEQ ID NO: 319274 - DNA, 685 bp, Homo sapiens
  misc_feature: GZ8MTXP02HZZGG.44.55.E11.1.454.CMB.2.raw
tcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaggtgtccagtgtgaggtgcggctgatggagtctggaggagcttagtccagccgtgggggtccagagactctcctgtgcacgcctcgtggcctcaccgtcagcagacaaactacagtggtagttcgggccgccgaggccgtaccggaaggggaaggggcgtagggaggtcgggtctcgagtactatttactacgtggtagtactttacaactacttaaccgtacgccaacgtaccgttccggtaggaaacgggcccgtaattacccaaccctatcccgtacccgaagggaactaacgtttaccgaaaggttaacgttaacgtttactcgttaaacaaagttacggaaacctacgtagaacgacgggaccgaagacccggacgtcccgtagttaacgttaccgtggtacgacgaacggaccgtaaacggtccggacgtaccgtacggggtattacgggtttaattacgttttcggttacgtacctttcggggtacgggggaccctaaccggggg

SEQ ID NO: 319275 - DNA, 517 bp, Homo sapiens
  misc_feature: GZ8MTXP02JFEDO.44.55.E11.1.454.CMB.2.raw
  modified_base (299)..(299): a, c, t, g, unknown or other
  misc_feature (299)..(299): n is a, c, g, or t
  modified_base (342)..(342): a, c, t, g, unknown or other
  misc_feature (342)..(342): n is a, c, g, or t
  modified_base (412)..(412): a, c, t, g, unknown or other
  misc_feature (412)..(412): n is a, c, g, or t
  modified_base (448)..(448): a, c, t, g, unknown or other
  misc_feature (448)..(448): n is a, c, g, or t
  modified_base (454)..(454): a, c, t, g, unknown or other
  misc_feature (454)..(454): n is a, c, g, or t
  modified_base (507)..(507): a, c, t, g, unknown or other
  misc_feature (507)..(507): n is a, c, g, or t
tcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggatgaggcttagtccagcctggggggtcccagagactctcctgtgcagcctctgggctcaccgtcagcagcaactacatgagttgggtccncaggctccgaggggaagggctggagtgggtctcagtcatttanacctggtgatttcacatactcgcagactccgtgaagggcattcacatctcaggacatccaggacagttancttacaatgaacactgagagcgacgacacggccgtntatacngtcgcgagaccaagtcggcgctcggagtggttattagttcgttagactttcgnggggtacccg

SEQ ID NO: 319276 - DNA, 567 bp, Homo sapiens
  misc_feature: GZ8MTXP02J1W0Z.44.55.E11.1.454.CMB.2.raw
  modified_base (328)..(328): a, c, t, g, unknown or other
  misc_feature (328)..(328): n is a, c, g, or t
  modified_base (339)..(339): a, c, t, g, unknown or other
  misc_feature (339)..(339): n is a, c, g, or t
tcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtgggggtcccagagactctcctgtgcagcctctgggctcaccgtcagcagcaactacatgagttggtccgcaggctccgagggagggctggagtgggtcncagtcatttanacgtggtgtatttcactatactacgcagacctccggtagaacgggccgtattccaccatcctacccgagggacaacttcccgaaggtaacctacggttttaatcttacaaattgaaaccaacctgaagacggacgacgacgacggccgtctattctgtacgcgacgacaacggtccgcgcgtcggagttggttaattagttcgttgtacttcgtcggggtacaacggg

SEQ ID NO: 319277 - DNA, 586 bp, Homo sapiens
  misc_feature: GZ8MTXP02HJKLY.44.55.E11.1.454.CMB.2.raw
  modified_base (300)..(300): a, c, t, g, unknown or other
  misc_feature (300)..(300): n is a, c, g, or t
  modified_base (404)..(404): a, c, t, g, unknown or other
  misc_feature (404)..(404): n is a, c, g, or t
  modified_base (431)..(431): a, c, t, g, unknown or other
  misc_feature (431)..(431): n is a, c, g, or t
  modified_base (480)..(480): a, c, t, g, unknown or other
  misc_feature (480)..(480): n is a, c, g, or t
tcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtgggggtcccagagactctcctgtgcagcctcgtgggctcaccgtcagcagcaactacatgagttgggtccnccaggctccgaggggaagggctgggagtgggtctcagtctatttatacgtggtgtatttcactatactacgcagtacctccgtagaaggggccattccacatcnccgaggacaattcgagaactagtttancttacaaatgaaacacgtgagaggacacgacacggtcctatacgttacngtacgacgaacgtacgaaacggtccggacgtcgttacggggattagggtttaatttacgtttcggtttacgactttcgggtaccgggggtacccgtaaaccggggg

SEQ ID NO: 319278 - DNA, 652 bp, Homo sapiens
  misc_feature: GZ8MTXP02GSJG3.44.55.E11.1.454.CMB.2.raw
  modified_base (298)..(298): a, c, t, g, unknown or other
  misc_feature (298)..(298): n is a, c, g, or t
  modified_base (343)..(343): a, c, t, g, unknown or other
  misc_feature (343)..(343): n is a, c, g, or t
tcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtgggggtcccagagactctcctgtgcagcctctggctcaccgtcagcagcaactacatgagttgggtccnccaggctccgaggggaagggctggagtgggtctcgagtcatttanacgtggtgtatttcactatactacgcagtactccgtagacgggccgtattccaccatcctaccgaagggacaacgttccgaacgggtaaactacggtttaactcttaaccaaaagttacgaaacaacccgttggaacgagggacccgaacgaccgaccgggtacccgtcttaacgtttacgtacggttcgacggacgaaacgtaaacgggttccggaccgtcccggttacgggtaaggtttagggtttaattttaacgtttcggttttacggaccgttttcggtaccgggggtacccgtaaaccggggg

SEQ ID NO: 319279 - DNA, 544 bp, Homo sapiens
  misc_feature: GZ8MTXP02FGX4F.44.55.E11.1.454.CMB.2.raw
  modified_base (335)..(335): a, c, t, g, unknown or other
  misc_feature (335)..(335): n is a, c, g, or t
  modified_base (420)..(420): a, c, t, g, unknown or other
  misc_feature (420)..(420): n is a, c, g, or t
tcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtgggggtcccagagactctcctgtgcagcctctgggctcaccgtcagcagcaactacatgagttgggtccgccaggctccgaggggaaggggctgggagtggggtcncgagtcatttatactggtgtatttcactatactacgcagactcgtgaagggcatcacatctcaggacaatccagaacacggttancttacaaatgaaacacctgagacggagacgacacggcgtctatactgcgcgagacaagtccggctcgtacggagttggttaattagtttcgtttggactttcggtcgggggcctaaaccggggg

SEQ ID NO: 319280 - DNA, 418 bp, Homo sapiens
  misc_feature: GZ8MTXP02JYL8L.44.55.E11.1.454.CMB.2.raw
  modified_base (412)..(418): a, c, t, g, unknown or other
  misc_feature (412)..(418): n is a, c, g, or t
tcagacagtatatacacgaccggtgctcgatttagcactcgcacgctggagtgggtctcagtcatttatactggttatttcacatactacgcagactccgtgaagggccgattcaccatctccagggacaattccaggaacacggtttatcttcaaatgaacaacctgagaggcgacgacacggccgtctattactgtgcgagacaagtcggcgctcggagtggttattattcgtttgacttctggggccagggaaccctggtcaccgtcgcctccgcctccaccaaggcccatcggtcttccccctggcacccctcctccaagacgcacctctgggggcacagcggcctgggctgcctggtccaaggactactcctatatactgtctgagcggctggcaagggcgcatagnnnnnnn

SEQ ID NO: 319281 - DNA, 590 bp, Homo sapiens
  misc_feature: GZ8MTXP02JY983.44.55.E11.1.454.CMB.2.raw
tcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctgggggtcccagagactctcctgtgcagcctctgggctcaccgtcagcagcaactacatgagttgggtccgccaggctccgagggaaggggctgggagtgggtctcgagtcatttagtactggtgatttcacatactacgcagactccgtagaagggccgattccaccatctccgagggacaattccaaggaactacggtttatcttacaaaattgaaacaacctgaagagggacgacgacgaacggccctactagttacctgtcgacggaacgacgaaacggtccgggacgccgtacgggagttagggtttaattacgtttcggtttacgaccgtttcggtacgggggacccgtaaccgggg

SEQ ID NO: 319282 - DNA, 553 bp, Homo sapiens
  misc_feature: GZ8MTXP02HFFF3.44.55.E11.1.454.CMB.2.raw
  modified_base (294)..(294): a, c, t, g, unknown or other
  misc_feature (294)..(294): n is a, c, g, or t
  modified_base (439)..(439): a, c, t, g, unknown or other
  misc_feature (439)..(439): n is a, c, g, or t
tcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtgggggtccagagactctcctgtgcagcctcgtggctcaccgtcagcagcaactacatgagttggccnccaggctaccgagggaagggcgtggagtgggtcgtcagtctattatatgtgtattcacatactacgcagactacgtcgaaggacgacttacaccactctcacggacaacttacacgaactaacggttacttactactaaataaanaacaacgtagagacgacgacgacgacgacgtactactactgtgacgacgacgacgacggacgcgtacgtagtagttaagttacgttacgttcgtacgtcgtacggtacggacgg

SEQ ID NO: 319283 - DNA, 709 bp, Homo sapiens
  misc_feature: GZ8MTXP02IBNFY.44.55.E11.1.454.CMB.2.raw
  modified_base (357)..(357): a, c, t, g, unknown or other
  misc_feature (357)..(357): n is a, c, g, or t
  modified_base (365)..(365): a, c, t, g, unknown or other
  misc_feature (365)..(365): n is a, c, g, or t
tcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtgggggtcccagagactctcctgtgcagcctctggacctccacccgtcagcagaccaaactacatgtagttcgggtccgccgaggctaccggaggggaaggggcgtgggagtgggtctcgagtctatttanacgtggtntatttcactatactacgcaagactccggtaggaacgggtccgattccgaaccctatccgtacccgaaggggtaacctaaacgtttccccgaaagggtaaacccttacggttttaactacgttaaacaaaacgttcgaaaaccctaaacgtggaaacggacggggaccgaaacgaacccgtaccgggtacccgttacttaaagttaccgtaggtaccggacggtaaacggtaacgtaaacgggtccgggcgtaccggtaacgggttaggtttagggtttaacttttaacggtttccggtttacggaaccgtttcgggtaccgggggttaacccctaaaccggggg

SEQ ID NO: 319284 - DNA, 683 bp, Homo sapiens
  misc_feature: GZ8MTXP02G8WBB.44.55.E11.1.454.CMB.2.raw
  modified_base (273)..(273): a, c, t, g, unknown or other
  misc_feature (273)..(273): n is a, c, g, or t
tcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtgggggtcccagagactctcctgtgcagcctcgtggctcaccgtnagcagcaactacatgagttcggtccgccgaggcctccgaggggaagggcgtgggagtgggtctcgagtctatttacgtacgtggtagtatttcgaactagttacctacgcgaacgaccgttcccggtagaacggggtccgtatttaccaaccctatcccgtaccgaaggggaacctaaacgttacccgaaggtaaccttaaccgggttttaactaccgtttaacaaaagttacgaaaacctaacccgttagacgggaacgggaccgaaccggaaccgaccgggtacccgttaccgttaatttaaccgtggtcgaacgacgtaacgaacggtccggacgtcgtacgggtagtttaggtttaactttagtttcggtttacgtacgtttcggtacggggtaccgtaaccgggg

SEQ ID NO: 319285 - DNA, 578 bp, Homo sapiens
  misc_feature: GZ8MTXP02GGO4O.44.55.E11.1.454.CMB.2.raw
tcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtgggggtcccagagactctcctgtgcagcctctgggctcaccgtcagcagcaactacatgagttggtccgccaggctccgaggggaagggctgggagtggggtggcagtcatcgtggtcctgatggaaagtaaagaatactagtaggaaactccggtagaacgggccgtattcctccgtctcccgagacgacaattaccaaagaaccaccggtatactactaaacaaatagaaactaagtttgaagagaccgaggactcggctctactattatcgtacgagccctagttccgtacgtacgcggggtaccgaaggggacgtcccgtacggtcctaccggtctcccgtaccg

SEQ ID NO: 319286 - DNA, 656 bp, Homo sapiens
  misc_feature: GZ8MTXP02H25AL.44.55.E11.1.454.CMB.2.raw
  modified_base (273)..(273): a, c, t, g, unknown or other
  misc_feature (273)..(273): n is a, c, g, or t
  modified_base (352)..(352): a, c, t, g, unknown or other
  misc_feature (352)..(352): n is a, c, g, or t
  modified_base (410)..(410): a, c, t, g, unknown or other
  misc_feature (410)..(410): n is a, c, g, or t
tcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccaggccgtggggggtcccagagactctcctgtgcagcctcgtggctcaccgtnagcagcaactacatgagttcgggtccgccgaggcctaccgaggggaaggggcgtgggagtgggtctcgagtctatttanactggtgtatttcactatactacgcaagactccggtagaacggccgtattccaacctntcctaccgaagggaaccaactttccgaaagggtaaccttacggtttactcttaaacaaattacgaaaactaccgtagaaggacggacgacgaccgacgggtccctatacttacgtggtacgaccgtaaaggacccgtaaaggttcccggggacgtacccgtacggggttaagtttggggtttaacttttaacggtttcgggtttacgtaccgtttccgggtaccgggggttacccaaacccggggg

SEQ ID NO: 319287 - DNA, 590 bp, Homo sapiens
  misc_feature: GZ8MTXP02HMEEX.44.55.E11.1.454.CMB.2.raw
  modified_base (303)..(303): a, c, t, g, unknown or other
  misc_feature (303)..(303): n is a, c, g, or t
  modified_base (408)..(408): a, c, t, g, unknown or other
  misc_feature (408)..(408): n is a, c, g, or t
  modified_base (446)..(446): a, c, t, g, unknown or other
  misc_feature (446)..(446): n is a, c, g, or t
  modified_base (501)..(501): a, c, t, g, unknown or other
  misc_feature (501)..(501): n is a, c, g, or t
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtggggggtcccagagactctcctgtgcagcctcgtgggctcaccgtcagcagccaactacatgagttgggtccnccgaggctccgaggggaaggggctgggaggtgggtctcgagtctatttagtacgtggtgtatttcactatacctacgcagactcggtagacggggccattcaccntcctcgaagggactaacgttcgaggaactacggtttancttacaaatacgaaactacctgagacggcgaacgacgacggtccgtctaattcgngtacgcgaagacgaacggtcggacgtcgtcgggtagttggttaattcgtttcggtttacgactttccggacgggggtacctaacggggg

SEQ ID NO: 319288 - DNA, 594 bp, Homo sapiens
  misc_feature: GZ8MTXP02FFZEU.44.55.E11.1.454.CMB.2.raw
  modified_base (349)..(349): a, c, t, g, unknown or other
  misc_feature (349)..(349): n is a, c, g, or t
tcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcggctgatgggagtctggaggaggcttagtccagccgtgggggtcccagagactctcctgtgcagcctctgggctcaccgtcagcagcaactacatgagttggccgcaggctccgaggggaggggctgggagtgggtctcgagtcatttatacgtggtntattcactatactacgcagactccgtagaacggccgtattcaccatcctaccgagggtacaaagttcccgaaggtaaacctacggtttatacttacgaaaatcgaaaacaccgtgacggaggcgacgacgacggccgtactatacgtgtcgacgaagacgaacggtccggcgccgttacgggagtttagggttaatttacgtttcggtttacgtacgtttcggacgggggtacctaaaccggggg

SEQ ID NO: 319289 - DNA, 642 bp, Homo sapiens
  misc_feature: GZ8MTXP02HC2X6.44.55.E11.1.454.CMB.2.raw
  modified_base (517)..(517): a, c, t, g, unknown or other
  misc_feature (517)..(517): n is a, c, g, or t
tcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtgggggtcccagagactctcctgtgcagcctctgggctcaccgtcagcagcaactacatgagttggccgcaggctccgaggggaaggggctggaggtgggtctcgaggtctatttatacgtggtgtatttcactatactacgcagactcgtagaacgggccgattcaccatccgtcccgagggaccaagtttcccaaggaacctaacggtttatacgttacaaaagttcgaaaccaaccttggaacgacgggaccgaaccgaaccaccgggtccgtactagttaaccgngtacgacggacgaaccgtaaacggttccgggacgtcccggtacggggtaagtttcggggtttaaatttacggttttacggtttacggttaccgtttcggtaccgggggtaccttaaacccggggg

SEQ ID NO: 319290 - DNA, 596 bp, Homo sapiens
  misc_feature: GZ8MTXP02H23G1.44.55.E11.1.454.CMB.2.raw
  modified_base (299)..(299): a, c, t, g, unknown or other
  misc_feature (299)..(299): n is a, c, g, or t
tcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtgggggtcccagagactctcctgtgcagcctctgggctcaccgtcagcagcaaactacatgagttgggccnccaggcctccgaaggggaaggggctgggagtgggtctcgagtctattatacgtggtgtatttcactatactacgcagactccgtagaacgggccattccaccctatcctaccgagggaccaacgttaccgaacggaactacggttatacttacaaatacgaaacaacctgaagaggacacgacacgtcgtactatacgtgtgacgtaagacgtaaaggtccggacgtcgtcggtaagttggtttaagtttacgtttcggtttacgtacgtttaccggtcggggtaccgtaaccgggg

SEQ ID NO: 319291 - DNA, 777 bp, Homo sapiens
  misc_feature: GZ8MTXP02GH385.44.55.E11.1.454.CMB.2.raw
tcagacagtatatacacgaccggtgctcgatttagcactcgcacgttgggtttggggagcttcagctgtgggtagagaagacaggactcaggacgatctccagcatggccagcttccctctcctcctcaccctcctcactcactgtgcagggtcctgggcccagtctgtgatgtctcagcccaccctcagcgtcgtcggggacccccgggcgacgggggtcaccatctcttgttctggaaggagtccaatatcggatcttatcctgtcaactggtagtccggggacctcccgaggccacccggcccccccgtacttcccttatccttatcgaccttaactaatccacgcccggcccctcgacggggtcccctcgccccgtattccccgtcgtcggtcctaccgaagtccgtcgggcctaaccgtacgacggtccttaacccgtcggaccctacgttcccttgaccttcccgtaccgtacggttctacggaggtagttacgggacgggtcttaggtaactttaccgttacgttgggttacgaccgaaggtccgtaaagggttcggggaattacgggaaacccggtaaccggggaccccgggggtaaacgggttccgggttacgggggtttccggggtttaccgggggaccgggggtaaaccgggggtaaacccgttaacggggtttaccgggtaacccccggtttacggtaaacggggttcccgaaccgggtacccccggtaacgggtcccgttcccccggaccccccggttttccgg

SEQ ID NO: 319292 - DNA, 541 bp, Homo sapiens
  misc_feature: GZ8MTXP02FJ87R.44.55.E11.1.454.CMB.2.raw
  modified_base (427)..(427): a, c, t, g, unknown or other
  misc_feature (427)..(427): n is a, c, g, or t
  modified_base (475)..(475): a, c, t, g, unknown or other
  misc_feature (475)..(475): n is a, c, g, or t
tcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcgctgatggagtctggaggaggcttagtccagcctggggggtcccagagactctcctgtgcagcctctgggctcaccgtcagcagcaactacatgagttgggtccgccaggcctccgaggggaaggggctggagtgggtctcagtcatttatactggtgatttcacatactacgcagactccgtgaagggccaattcaccatcctccagggacaattccaaggaacacggtttanacttcaaatgaaacacctgagaggcgacgacgacggccgtctattacngtgacgagacaagtcggcgcgtcggagttgtttaatattcgttgacttcgtacgggcctaacgggg

SEQ ID NO: 319293 - DNA, 646 bp, Homo sapiens
  misc_feature: GZ8MTXP02II7FE.44.55.E11.1.454.CMB.2.raw
  modified_base (376)..(376): a, c, t, g, unknown or other
  misc_feature (376)..(376): n is a, c, g, or t
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtgggggtcccagagactctcctgtgcagcctcgtgggctcaccgtcagcagcaaactacatgagttcgggtccgccagggcctaccggaaggggaaggggcgtaggggaggttggggtctacgaggtctaattttagtactggggtntatttcactataccgtagcagactcgtagaacgggcaattccaacatcctaccgaggactaaacttccgaaggtaacctacggtttaactacttacaaaattcgaaaacctaaaccgtgaaagacggacgaaccgacacgggtcctactaattacctgagacgaaagtaccgaaaagtccgggacgtacgttacgggaaggtttacggtttaatttagtttcggtttacggtaacgtttccgggtacgggggtaccctaaaacccggggg

SEQ ID NO: 319294 - DNA, 558 bp, Homo sapiens
  misc_feature: GZ8MTXP02J24NO.44.55.E11.1.454.CMB.2.raw
  modified_base (486)..(486): a, c, t, g, unknown or other
  misc_feature (486)..(486): n is a, c, g, or t
  modified_base (507)..(507): a, c, t, g, unknown or other
  misc_feature (507)..(507): n is a, c, g, or t
tcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctggggggtcccagagactctcctgtgcagcctctgggctcaccgtcagcagcaactacatgagttggggtccgcccagggctccaggggaagggctggagtggggtctcgagtctatttatactggtgatttcacatactacgcagactccggtgaagggccgattccaccatcctccaggggacaaattcccgaggaacacgggttttatcttacaaatgaaacacctgagaggcgacgacacggccgtctatttacngtcgcgagacaaggtcggacncgtacggagtggtttaattatttcgttgtacttcgtggggccctaacgggg

SEQ ID NO: 319295 - DNA, 658 bp, Homo sapiens
  misc_feature: GZ8MTXP02I6OVG.44.55.E11.1.454.CMB.2.raw
  modified_base (384)..(384): a, c, t, g, unknown or other
  misc_feature (384)..(384): n is a, c, g, or t
tcagacagtatatacacgaccggtgctcgatttagcactcgcacgttgggtttggggagcttcagctgtgggtagagaagacaggactcaggacgatctccagcatggccagcttccctctcctcctcaccctcctcactcactgtgcagggtcctgggcccagtctgtgatgtctcagccaccctcagcgtctcgggacccccgggcaggggtcaccatctcttgttctggaagaagtccaatatcgatcttatcctgtcactgtagtcgggactccgaggccaccggcccccgatccttatctatcgactactatcgagccgcctcgacgggtccctcgcccgtatccctcgtcggcctcctaagtccgtgcctactaccgnggtcctaccgtcggcctaacttcccgtgtacctctaccgtagttcgtagaggtattggaacggtcttaggtaactttaccgtaaccgttgttcgacgacggtacaggttaggacgtacggaaacggcgggacccggggtaaacgggtcggttaacgggggtcgggttacggggaccggggtaaacgggtaccgttaacgggttccgaacccggtttcgaacgggttccgaaccggtaccccggaaggtcccgtcccggtaacccccgtttccgg

SEQ ID NO: 319296 - DNA, 536 bp, Homo sapiens
  misc_feature: GZ8MTXP02FR2O6.44.55.E11.1.454.CMB.2.raw
  modified_base (351)..(351): a, c, t, g, unknown or other
  misc_feature (351)..(351): n is a, c, g, or t
tcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctgggggtcccagagactctcctgtgcagcctctgggctcaccgtcagcagcaactacatgagttgggtccgccagggctccgaggggaaggggctggagtgggtctcagtcatttatactggtnatttcacatactacgcagactccgtgaagggccgattcaccatctccagggacaattccaggaacacggtttatcttcaaatgaaacacctgagaggcgacgacacggccgtctatactgtgcgagacaacgtcggcgctcggagttggttaattattcgtttgacttcgtcggggccaacgggg

SEQ ID NO: 319297 - DNA, 545 bp, Homo sapiens
  misc_feature: GZ8MTXP02I9WLF.44.55.E11.1.454.CMB.2.raw
  modified_base (418)..(418): a, c, t, g, unknown or other
  misc_feature (418)..(418): n is a, c, g, or t
  modified_base (468)..(468): a, c, t, g, unknown or other
  misc_feature (468)..(468): n is a, c, g, or t
tcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctggggggtcccagagactctcctgtgcagcctctggctcaccgtcagcagcaactacatgagttggtccgcaggctccgagggaaggggctggagtgggtctcagtcatttatactggtgatttcacataactacgcaagactccgtgaacggggcattcacatctccaggacaatcaggaacacgtttanctacaaatgaaacaactgagaggacgacgacacggccgtctacttatgtncgagaacaacggtcggcgcgtcgggaagttcggttaatttagttcgtttgtacgttcgtcgggggacctaaccgggg

SEQ ID NO: 319298 - DNA, 686 bp, Homo sapiens
  misc_feature: GZ8MTXP02GC8N1.44.55.E11.1.454.CMB.2.raw
tcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtcgtggaggaggcttagtccaggccgtgggggtcccagagactctcctgtgcacgcctcgcgggctcaccgtcagcagcaactacatggtacgttcgggtcccgccgaggccgtaccggaaggggaaggggcgtgggaggtcgggtctcgagtctaatttatacgtggtactatttcaactaacttaaccaacgcgaacgtaccgttaccggtaggaaccggggaccgtaactttcccaaacctacgttcccgtaccgaaacgggaactaaaccgttacccgaaacggtaaccgttaacggtttactacttaacaaaacgttacgaaaacctaaccgtagaacggacgggaccgaaccgacgaaccggtccgttaactacgttaccgtggtacacggaacgaaacgtacggtccggacgtcgtacgggagttacgttaagtttacgttcgtttacgtcgttcggtcgggaccgtaaccgggg

SEQ ID NO: 319299 - DNA, 801 bp, Homo sapiens
  misc_feature: GZ8MTXP02HIRIZ.44.55.E11.1.454.CMB.2.raw
  modified_base (195)..(195): a, c, t, g, unknown or other
  misc_feature (195)..(195): n is a, c, g, or t
tcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggtacttttaaaaggtgtccagtgtgaggtgcggntgatggagtctggaggaggcttagtccagccgtgggggtcccagagactctcctgtgcagcctcgtggctccaccgtcagcagcaactacatgagttcgggccgccgaggctccgaaggggaacggggctgggaggtgggtctcagtctatttatacgtgggtatactttacaacgtataacctacgccgaagtaccgtccgggttagaaacggggtccctaaattacccaaaccctagtacccgtacccgaaagggggtaaaccctaaacgtttacccgaaaacgggtaaaccttaaccgggttttaaactacccgtttaaaccgaaaaaatttccggaaaaacctaaaaccccgttagggaaaacgggacggggaacccgtaaaccggtaaaccccggaaccccggggtacccggttaactttaaaccgttaccggttaaggacggtaccccggtaaaaggaaacccttaaaacgggggtccccgggtaaaccgggcccgtttaacggggtaaacggtttacgggtttaaaagttttacgttttacccgggtttaggtaaccggtttccggttaccggggggtaaacccgtaaacccccggggg

SEQ ID NO: 319300 - DNA, 741 bp, Homo sapiens
  misc_feature: GZ8MTXP02JSCV3.44.55.E11.1.454.CMB.2.raw
tcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtgggggtcccagagactctcctgtgcagcctcgtgggctcaccgtcagcagacaactacatgagttcggtccgccgaggcctccggaggggaaggggcgtgggagtggggtctgagtctatttatactggtgtatttcactatacacgcagactccggtaggaacgggccgtaacttccaaaccgtactccgtacccgaaaggggtaccctaaagttacccgaaagggtaaccttacgggtttaactacttaacctaaaagtcgaaaaccgaaccgtggaacggaacgggaccgaaaccgggaaccgtaacccggggtaccccgtttaacgtttaacgtttaaccgtggggttaaccggtaccgggaaacggtaaccgtaaaacggggttccgggaacccggtccggttaccgggggtaaccggttttaggggtttaaacttttacggttttacccgggtttttaggaacccggttttcggggtacccggggggtaccgttaaaccccggggg

SEQ ID NO: 319301 - DNA, 558 bp, Homo sapiens
  misc_feature: GZ8MTXP02I1POX.44.55.E11.1.454.CMB.2.raw
  modified_base (423)..(423): a, c, t, g, unknown or other
  misc_feature (423)..(423): n is a, c, g, or t
  modified_base (428)..(428): a, c, t, g, unknown or other
  misc_feature (428)..(428): n is a, c, g, or t
  modified_base (432)..(432): a, c, t, g, unknown or other
  misc_feature (432)..(432): n is a, c, g, or t
  modified_base (474)..(474): a, c, t, g, unknown or other
  misc_feature (474)..(474): n is a, c, g, or t
tcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtgggggtcccagagactctcctgtgcagcctctgggctcaccgtcagcagcaactacatggagttcgggccgccaggctccgaggggaagggctgggagtgggtctcgagtctatttatacgtggtgatttcactatactacgcagctcgtgaacggccatcaccatccaccgaggactaatcaggaactacgttanactanaaancgaaacaccgtgagaggacgacgacgaccggctactattacngtcgacgagacacggtcgcgtcgtacgggtagttggttaatttacgtttcggttgtaccgttcggtcggggaccgtaaccgggg

SEQ ID NO: 319302 - DNA, 564 bp, Homo sapiens
  misc_feature: GZ8MTXP02F3F99.44.55.E11.1.454.CMB.2.raw
  modified_base (340)..(340): a, c, t, g, unknown or other
  misc_feature (340)..(340): n is a, c, g, or t
  modified_base (408)..(408): a, c, t, g, unknown or other
  misc_feature (408)..(408): n is a, c, g, or t
  modified_base (434)..(434): a, c, t, g, unknown or other
  misc_feature (434)..(434): n is a, c, g, or t
  modified_base (485)..(485): a, c, t, g, unknown or other
  misc_feature (485)..(485): n is a, c, g, or t
  modified_base (514)..(514): a, c, t, g, unknown or other
  misc_feature (514)..(514): n is a, c, g, or t
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccaggccgtggggggtcccagagactctcctgtgcagcctctgggctcaccgtcagcagcaactacatgagttgggtccgccagggcctccgaggggaaggggctgggaggtgggtcncgagtcatttatacgtggtgtatttacactatactacgcagactccggagaacgggcgacttcacctntctcaggacatcacggaactagttanactacgaaatgaaactacctggagacggacacgacgacggtctctattacngtgacgagtacaggtccggagccgtaggngttaggttaattacgttcgttacgacgtttcgtacgggggcctaacgggg

SEQ ID NO: 319303 - DNA, 585 bp, Homo sapiens
  misc_feature: GZ8MTXP02I8ASJ.44.55.E11.1.454.CMB.2.raw
  modified_base (402)..(402): a, c, t, g, unknown or other
  misc_feature (402)..(402): n is a, c, g, or t
tcagacagtatatacacgaccggtgctcgatttagcactcgcacgttgggtttgggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtgggggtcccagagactctcctgtgcagcctctgggctcaccgtcagcagcaactcatgagttgggccgccaggctccgaggggaaggggctgggagtgggtctcgagtcatttatactggtgatttcacatactacgcagactccgtgaacggggccaattccaccatctaccncggggaacacgttacgcaaacgtacgttagtacttacgtaaatcgtaacaacctagagacggacgaccgacgaccggaccggtcctacgttacctgtacgtacgagaacgacgacgggcgacgtcggacgtaggttaacgttatttcggttacttacgtttccgtacgggaccgtaaccgggg

SEQ ID NO: 319304 - DNA, 660 bp, Homo sapiens
  misc_feature: GZ8MTXP02HQK1F.44.55.E11.1.454.CMB.2.raw
  modified_base (301)..(301): a, c, t, g, unknown or other
  misc_feature (301)..(301): n is a, c, g, or t
tcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaggtgtccagtgtgaggtgcggctgatggagtcgtggaggaggcttagtccaggccgtgggggtcccagagactctcctgtgcagcctcgtggctcaccgtcagcagcaactacatgagttcgggtccnccgaggctccgaggggaaggggctgggagtgggtctcgagtctatttatacgtggtagtatttcgatagttactacgcagactccgtagaacggccgtattcaccctatccctacgagggacaagttaccgaagaactacggtttatcgttaacaaaattcgaaaactaccgtgaacgacgggaccgaacgaaccgtaccgggtacccttactacgtttaaccgtggttacggaccgtaaacggaaaccgaaacggttccgggaccgtacggttaccgggtaaggtttcgggtttaaaatttcggtttccggttttaccgaacgttttccgggtacgggggtacccctaaacccggggg

SEQ ID NO: 319305 - DNA, 750 bp, Homo sapiens
  misc_feature: GZ8MTXP02IBNKW.44.55.E11.1.454.CMB.2.raw
  modified_base (310)..(310): a, c, t, g, unknown or other
  misc_feature (310)..(310): n is a, c, g, or t
tcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggtacttttaaaggtgtccagtgtgaggtgcggctgatggagtcgtggaggaggtcttagtccaggccgtgggggtcccagacgactctcctgtgcacgcctcgtgggctccaccgtcagcagacaactacatggtagttcgggtccnccgacgggcctaccggaaggggaacgggtcgtagggagtcgggtctgagtctaatttacgacgttggtagttacttcaactataccgtacgcaaacgtacctaccggtagggaaaccggtccgtaactttaccgaacccttagtcccgtaaccgaacgggtaacctaaacgtttacccgaaagggtaaaccttaacgggtttaactaccttaaacgaaaacgttaacgaaacctaaccgttaggaaacgggacgggacccgaacggaacccgtacggggtaccctttagtaactttaccgtggtaacggcccgaaaaggtaccgtaaacggttcccggggacgtaccggttacgggttaaggtttacgggtttaattttaccgtttcgggttttacggaacccgttttcgggaccgggggtttaacccgtaacccggggg

SEQ ID NO: 319306 - DNA, 707 bp, Homo sapiens
  misc_feature: GZ8MTXP02FYTFA.44.55.E11.1.454.CMB.2.raw
  modified_base (240)..(240): a, c, t, g, unknown or other
  misc_feature (240)..(240): n is a, c, g, or t
  modified_base (355)..(355): a, c, t, g, unknown or other
  misc_feature (355)..(355): n is a, c, g, or t
  modified_base (369)..(369): a, c, t, g, unknown or other
  misc_feature (369)..(369): n is a, c, g, or t
tcagacagtatatacacgaccggtgctcgatttagcactcgcacgttgggtttggggagaggagcccagcactgggattccgaggtgtttccattcggtgatcatcactgaacacagaggactcaccatggactttgggctgagattgggttttcctcgttgcttcttttaagaggtggccagtgtcaggtgcagctagtggagtcgtgggggagagcggcccagccgtgggaacctccngagactctctgtgcagcctctggattcattcttacaggacctatcgccatcgcacgttcgggcccgaccaggcctccgaggccgaagggggctgggaggtgggagactaaattanagtacaggaaagtnttaggaaaacttggaaacgaacaaacggtacggaagaaccgtacggaaagggaaacgggtccgtaacttcccgaacgttccaccgaaaggaacgaacctaaacttaccgaaggaaaacccacgaacgtacgacctacgtaccgtagaaccgtaaaacttacgtaaacctaacccaacgtaaaccgaaaggtaccggaaaggttacccgaaaccggggttacttaacgtttaactttaaagtttcggttaacggtacgtaccggtaaaccgtaaccccggtaacccccggtacggtaacccggtacccccggttaccccgtacgttaccggtaacccgg

SEQ ID NO: 319307 - DNA, 650 bp, Homo sapiens
  misc_feature: GZ8MTXP02HT884.44.55.E11.1.454.CMB.2.raw
  modified_base (419)..(419): a, c, t, g, unknown or other
  misc_feature (419)..(419): n is a, c, g, or t
  modified_base (424)..(424): a, c, t, g, unknown or other
  misc_feature (424)..(424): n is a, c, g, or t
tcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagccagccgtgggggtcccagagactctcctgtgcagcctctgggctcaccgtcagcagcaactacatgaggttcgggtccgaccgagggcctccggaaggggaaggggtcgtgggtaggtgggtctcgagtctaagtttatacgtggtgtactttcactatacctacgcacgtactccgtaggaacggcgtattcccaactntaccnccgaagggacctaacgttccgaagggtaacctaacggtttatcgttaacaaattacgaaacaccgtaggaacgtagggacgaaccgaccgaccgggtaccgtacttaacgtaccgttgggacgacggaagaaccggtaacgtccggggcaccggttcgggaaggtttgtttaacttacggtttcggtttacgtccgtttccggtacgggggtcccgaaaccggggg

SEQ ID NO: 319308 - DNA, 690 bp, Homo sapiens
  misc_feature: GZ8MTXP02JME9Y.44.55.E11.1.454.CMB.2.raw
  modified_base (274)..(274): a, c, t, g, unknown or other
  misc_feature (274)..(274): n is a, c, g, or t
  modified_base (358)..(358): a, c, t, g, unknown or other
  misc_feature (358)..(358): n is a, c, g, or t
tcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtggggggtcccagagactctcctgtgcagcctctgggctcaccgtnagcagccaactacatgagttcggccgccaggcctccgaggggaagggctgggagtggggtcacgagtctatttatactgggttntacttcactatacacgcacgtacgtccggtaggaacgggtccgtaattcccaacctactacccgtaccgaacgggtaaccttaacgttaccgtaacgggtaaaccgttaaccggttttaacttaccgttaactaaaacgtacgtaaaacctaaccgtaggaacggtacgggaccgaacgaaccgaccgggtcccgttacttaacgttacgtcggtacgaccggaacgtaacggtaacgggtccgggtaccgtccggtacggtaaggttacggtttaagtttacggtttcggtttacggtaccgtttcgggtccgggggtaaccgtaacgggg

SEQ ID NO: 319309 - DNA, 545 bp, Homo sapiens
  misc_feature: GZ8MTXP02F48RU.44.55.E11.1.454.CMB.2.raw
  modified_base (334)..(334): a, c, t, g, unknown or other
  misc_feature (334)..(334): n is a, c, g, or t
  modified_base (425)..(425): a, c, t, g, unknown or other
  misc_feature (425)..(425): n is a, c, g, or t
  modified_base (472)..(472): a, c, t, g, unknown or other
  misc_feature (472)..(472): n is a, c, g, or t
  modified_base (483)..(483): a, c, t, g, unknown or other
  misc_feature (483)..(483): n is a, c, g, or t
tcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggcgcggctgatggagtctggaggaggcttagtccagcctggggggtcccagagactctcctgtgcagcctctgggctcaccgtcagcagcaactacatgagttgggtccgccaggctcccgaggggaaggggctggagtgggtcncagtcatttatactggtgatttcactatactacgcagactccgtgaaggccgattcaccatctcagggacaatccagtaaacacggtttancttacaaatgaaacactgagaggacacgacacggccgtactattacngtgacgacganaagtcggcgctcggagtttggttaattacttcggtttgactttcgacggggcctaaacgggg

SEQ ID NO: 319310 - DNA, 714 bp, Homo sapiens
  misc_feature: GZ8MTXP02FFXVA.44.55.E11.1.454.CMB.2.raw
  modified_base (249)..(249): a, c, t, g, unknown or other
  misc_feature (249)..(249): n is a, c, g, or t
  modified_base (260)..(260): a, c, t, g, unknown or other
  misc_feature (260)..(260): n is a, c, g, or t
tcagacagtatatacacgaccggtgctcgatttagcactcgcacgttgggtttggggagaggagcccagcactggggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtgggggtcccagagactctccngtgcagcctgnggctcaccgtcagcagcaactacatgagttggccgcaggctaccggaggggaggggctgggtaggtcgggtctcgtagttctatttacgtacgtggtactacttcaactactacctacggccaacgtacccgtcggtaggaacgggtccactttacccaaccctactcccgtaacggaacgggtaaacctaaacgtttcccgaaaggggtaaaccttaaccgggttttacaccgtttaacaaaacgttccgaaaaccttacccgaggaacgggaaccgggacggaacccgtaacggacccgggtccgtttaacctaagtaccgttggacggaacgaacgaccggtaaacggtccgggaccgtacggttacgggtggtttaaacgggttaatttacggtttccggtttaacgtcccggtttccgggaccgggggttacccgtaaaaccccggggg

SEQ ID NO: 319311 - DNA, 597 bp, Homo sapiens
  misc_feature: GZ8MTXP02JY2MV.44.55.E11.1.454.CMB.2.raw
  modified_base (366)..(366): a, c, t, g, unknown or other
  misc_feature (366)..(366): n is a, c, g, or t
  modified_base (382)..(382): a, c, t, g, unknown or other
  misc_feature (382)..(382): n is a, c, g, or t
tcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtggggggtcccagagactctcctgtgcagcctctgggctcaccgtcagcagcaactacatgagttgggtccgccaggctccgagggaaggggctgggagtgggtctcgagtctatttatacgtggtgtatttcactanctacgcagactccggngaacgggcctattccacctatctaccgagggacaacgttccgaagtaactacggtttactcgttacaaattcgaaactaccgagagacgggtacgacgaccgacggcccgtatacttacgtgtcgacgacgacaacggtccggacgcgtaccgggtagttaggtttaattacgtttcggtttcgtaccgtttcggtacggggacccgtaccgggg

SEQ ID NO: 319312 - DNA, 661 bp, Homo sapiens
  misc_feature: GZ8MTXP02GION4.44.55.E11.1.454.CMB.2.raw
  modified_base (194)..(194): a, c, t, g, unknown or other
  misc_feature (194)..(194): n is a, c, g, or t
  modified_base (473)..(473): a, c, t, g, unknown or other
  misc_feature (473)..(473): n is a, c, g, or t
tcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggtacttttaaaaggtgtcagtgtgaggtgcggntgatgggagtcgtggaggaggcttagtccaggccgtgggggtcccagagactctcctgtgcagcctcgtgggctcaccgtcagcagcaactacatgagttggccgcaggctccggaaggggaagggcgtgggaggtgggtctcgtatctatttacgtacgttggtagtatttacaactatacctacgctaagaccgtcggtaggaacggggtcctattccaacctagtcctacgaaggactaaacgttaccaaggtaaactacggtttataccttaaanaaagtacgaaactaacgtaggaacggacgggaccgaaaccgaccgtaaccggtaccttaatacgttacgtggtacggaacggaacgaaccgtacgggtccggacggtcgttaacgggtagtttaacggtttaacgtttacggtttcggtttacgtaccggtttacgggtaccggggtaccgtaacggg

SEQ ID NO: 319313 - DNA, 654 bp, Homo sapiens
  misc_feature: GZ8MTXP02H0JST.44.55.E11.1.454.CMB.2.raw
tcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccaggccgtgggggtcccagagactctcctgtgcagcctctggctcaccgtcagcagcaactacatgagttcggccgccaggcctcggaggggaagggcgtggaggtgggtctcgagtctattatacgtggtgtactttcacatacgtacgcgtacgactccggtagaacggggcccgtaatttcccaactacttacccgtaccgaaagggtaaccctaaacgtttacccgaaacggggtaaactttaacggtttactacgtttaacaaaaacgttcgaaaactaacccgtaggaacgacgggacccgacgaccgaccggtcgtactagttacgtgtcgacgacgtacgaacggtcggaccgtcctagggtacgttagtttaagtttacgtttacgttacgtaccgtttcggtacggggtaccgtaaccgggg

SEQ ID NO: 319314 - DNA, 639 bp, Homo sapiens
  misc_feature: GZ8MTXP02HVQQ8.44.55.E11.1.454.CMB.2.raw
tcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtgggggtcccagagactctcctgtgcagcctctgggcctcaccgtcagcagcaactacatggagttgggtccgccgaggcctccgaggggaaggggctgggagtgggtctcgagtactatttatacgtggtagtatttcactattactacgcagtactccgaggaacggccgtattcccaccgtatccctaccgaagggaccaaagtttcccgaaggaaccttacggtttattcttaacaaaattcgaaacctaacgtgaacgacggacgaacgacgacggtaccgtctacgttacgtgtcgacgacgtaacgaaacggtccggacgtccggtacggtaggttagggtttaactttacgttttaccgggtttagtacccgttttcgggtaccgggggttacccgaaccggggg

SEQ ID NO: 319315 - DNA, 560 bp, Homo sapiens
  misc_feature: GZ8MTXP02FL89K.44.55.E11.1.454.CMB.2.raw
tcagacagtatatacacgaccggtgctcgatttagcactcgcacgttgggtttggggagcttcagctgtgggtagagaagacaggactcaggacgatctccagcatggccagcttccctctcctcctcaccctcctcactcactgtgcagggtcctgggcccagtctgtgatgtctcagcccaccctcagcgtctcgggacccccgggcagggggtcaccatctcttgttctggaaggaagtccaatatcggatcttatcctgtcaactggtatcgggactcccgaggccaccggccccccgatccttatctatcgctactaatcagccggccctcgacggggtccctgcccgtattcctctgctaccagtctggcactacaggcctacgtggcctatcctgactctcagtctggagatgagtcgtagtatttacacgtgtgcagtcagtgggatgacaggaccggaacggcgttgggtcggttacgggcgggtacgggaccgtaaaggttcggaccgttcgtaaggtccacggaccgaacggccttcgcccccgtttcg

SEQ ID NO: 319316 - DNA, 631 bp, Homo sapiens
  misc_feature: GZ8MTXP02HQDWH.44.55.E11.1.454.CMB.2.raw
  modified_base (450)..(450): a, c, t, g, unknown or other
  misc_feature (450)..(450): n is a, c, g, or t
  modified_base (522)..(522): a, c, t, g, unknown or other
  misc_feature (522)..(522): n is a, c, g, or t
tcagacagtatatacacgaccggtgctcgatttagcactcgcacgttgggtttggggagcttcagctgtgggtagagaagacaggactcaggacgatctccagcatggccagcttccctctcctcctcaccctcctcactcactgtgcagggtcctgggcccagtctgtgatgtctcagccaccctcagccgtctcggggacccccgggcgacgggggtcaccatctcttgttctggaaggaagtccaatatcggatcttatcctgtcaactggtatcggggactccgaggccaccggccccccgtactccttatctatcgactactaatcacgccggtccctcgacggggtccctcgcccgtacttccctcgtcggcctccgaagtccgtggcctacgtacgagtcctaccgtcggcctactcccttgacttctccgagtcgtagagtntaggagtctagtacgtttacctagtgtcgcgaggctaagtgggactaggacgacggaccgggtaaaccgggnggtttacggggtggttcgggggacggtaacggggtaccgaacggtttcggaacccgttcggtaacggtccgacggacccggtaacggcccgtacccggccccgttccgg

SEQ ID NO: 319317 - DNA, 740 bp, Homo sapiens
  misc_feature: GZ8MTXP02IRQJW.44.55.E11.1.454.CMB.2.raw
  modified_base (302)..(302): a, c, t, g, unknown or other
  misc_feature (302)..(302): n is a, c, g, or t
  modified_base (358)..(358): a, c, t, g, unknown or other
  misc_feature (358)..(358): n is a, c, g, or t
tcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccaggccgtgggggtcccaggagactctcctgtgcagcctctgggctcgaccgtcagcagcaactacatgagttcggtccnccgaggctaccgaggggaagggctggagtgggtctgagtctatttagtacgtggtntatttcagtacttaactacgctaagtaccgtacccggtgaaacggggtccgaatttccaaaccctatcccgtaccgaaggggtactaaacgttacccgaaacgggtaaaccttacgggttttaactccgttaacgaaaacttacgggtaaaaccaacccggttagggaaacggacggggaacccgaaaccggaacccgtaaccgggtacccgtacgttaaacgtttaccgtaggttacggaaccggaacggtaaccgtaaacgggttcccggggacgtaccggttaccggggtaaggtttacgggttttaaaacgtttaggttttccggtttacgggtaacccgttttccggttaccgggggtaaccccgttaaaccggggg

SEQ ID NO: 319318 - DNA, 693 bp, Homo sapiens
  misc_feature: GZ8MTXP02IR6M3.44.55.E11.1.454.CMB.2.raw
tcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatagagtcgtggaggaggcttagtccagccgtgggggtcccagagactctcctgtgcagcctcgtgggctcaccgtcagacagacaactacagtgtaggttcgggtcccgccgacggtcctaccggaggggaacggggcgtaggggaggttcgggttcgtcgtacggtacctttaagtttaacgttaccgttggttagttacttttaccaaactacttaaccgttaccgcgtaagtacccgttccggtacgggaacggggcctactttacccaaccttatcccgtaccgaagggtacctaaacgtccgaaagtaaccgttaacggtttactacgttacaaaattaccgaaacaacgtgaagacggacgacgacgaccggtctacttattacgtgtacgcggaagaacgacggtacggcgtcggtacggtaggtttagtttaacgtttcgttcggtttacggtactttacgggtccggggtacggtaaacccgggg

SEQ ID NO: 319319 - DNA, 570 bp, Homo sapiens
  misc_feature: GZ8MTXP02JCOET.44.55.E11.1.454.CMB.2.raw
  modified_base (297)..(297): a, c, t, g, unknown or other
  misc_feature (297)..(297): n is a, c, g, or t
  modified_base (427)..(427): a, c, t, g, unknown or other
  misc_feature (427)..(427): n is a, c, g, or t
tcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtgggggtcccagagactctcctgtgcagcctctgggctcaccgtcagcagcaactacatgagtggtccncaggctccgagggaaggggctggagtgggtctcagtcatttatactggtgatttcaactatactacgcagactccggtagaagggccgattccgacatcctcgagggacaactcaaggaactacgtttancttagaaattgaaactaccgtgagaggccgaacgacgacggtcctctagttacgtggtcgacgagacgtaaacggcggacgtcgtcggtagttggttaattacgtttcgttacggacgtttccggtaggggcctaaaccgggg

SEQ ID NO: 319320 - DNA, 556 bp, Homo sapiens
  misc_feature: GZ8MTXP02FMT5G.44.55.E11.1.454.CMB.2.raw
  modified_base (306)..(306): a, c, t, g, unknown or other
  misc_feature (306)..(306): n is a, c, g, or t
  modified_base (418)..(418): a, c, t, g, unknown or other
  misc_feature (418)..(418): n is a, c, g, or t
tcagacagtatatacacgaccggtgctcgatttagcactcgcacgttgggtttggggagcttcagctgtgggtagagaagacaggactcaggacgatctccagcatggccagcttccctctcctcctcaccctcctcactcactgtgcagggtcctgggcccagtctgtgatgtctcagccaccctcagcgtctcggggacccccggcagggggtcaccatctcttgttctggaaggaagtccaatatcggattctatcctgtcaactggtatcgggactcccgaggccaccggcccccatcctanctatcgactactaatcacgccggccctcgacggggtccctgcccgtattccctctcgctccagtctcggcactacaggcctaccgtgcctatcctgactctccagtctgagntgagtctgtattactatgtgcagcagtgggatgacgaggaccggacggtcgtggggtcgttacggggcggtaagggaccgtacggttcgaccggttaccgaaggtcgacgacccgaaggtccgtccggccccgtccgg

SEQ ID NO: 319321 - DNA, 534 bp, Homo sapiens
  misc_feature: GZ8MTXP02FF3CM.44.55.E11.1.454.CMB.2.raw
  modified_base (416)..(416): a, c, t, g, unknown or other
  misc_feature (416)..(416): n is a, c, g, or t
  modified_base (486)..(486): a, c, t, g, unknown or other
  misc_feature (486)..(486): n is a, c, g, or t
  modified_base (519)..(519): a, c, t, g, unknown or other
  misc_feature (519)..(519): n is a, c, g, or t
tcagacagtatatacacgaccggtgctcgatttagcactcgcacgttgggtttgggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctggggggtcccagagactctcctgtgcagcctctgggctcaccgtcagcagcaactacatgagttggtccgccaggctccgaggggaaggggctgggagtgggtctcagtcatttatactggtgattcacatactacgcagactcgtgaaggcgatcaccatctcaggacaatccaggaacacggtttancttacaaaatgaaacaacctgagaggcgaccgacacggccgtctaattactgagcgagacaacgtcggcncgtcggagtggttaatagttcgttgactttcgnggggacctaacgggg

SEQ ID NO: 319322 - DNA, 621 bp, Homo sapiens
  misc_feature: GZ8MTXP02GN84J.44.55.E11.1.454.CMB.2.raw
  modified_base (354)..(354): a, c, t, g, unknown or other
  misc_feature (354)..(354): n is a, c, g, or t
tcagacagtatatacacgaccggtgctcgatttagcactcgcacgttgggtttgggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtgggggtcccagagactctcctgtgcagcctcgtggctcaccgtcagcagcaactacatgagtggtccgcaggctccgaggggaagggctggagtgggtctcagtcattatactggtgatttcactntactacgcacgactccgtagaaggggtcccagttccacctatcctacgagggacaacgttaccaggaacctacggtttataccttacaaagtacgaaacaaccgttagacggaggaccgaaccgaaccgaccggtcccggttacttaacgtttacgtacggtcgacggacgacggtaacgtaccgggcgtaccgtacgggtagttacgggtttaatttacgtttacgtttcggaaccgtttcggtacggggtacccgtaacccgggg

SEQ ID NO: 319323 - DNA, 565 bp, Homo sapiens
  misc_feature: GZ8MTXP02FKUTE.44.55.E11.1.454.CMB.2.raw
  modified_base (298)..(298): a, c, t, g, unknown or other
  misc_feature (298)..(298): n is a, c, g, or t
  modified_base (435)..(435): a, c, t, g, unknown or other
  misc_feature (435)..(435): n is a, c, g, or t
tcagacagtatatacacgaccggtgctcgatttagcactcgcacgttgggtttgggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtgggggtcccagagactctcctgtgcagcctctgggctcaccgtcagcagcaactacatgagttgggtccnccaggctccgaggggaggggctggagtgggtctcgagtcatttatacgtggtgtatttcactatacctacgcagacctccgtagaacgggccgaattccaccatcctcgagggacaattccaggaactacggtttanacttacaaatgaaacactgagaggcgacgacgacggccgtactattactgtcgacgacgacaacggtccggcgtccgtcggagttggttaattagttcgtttcgacgtttcgcggggtacctaaccgggg

SEQ ID NO: 319324 - DNA, 703 bp, Homo sapiens
  misc_feature: GZ8MTXP02ITEQ9.44.55.E11.1.454.CMB.2.raw
  modified_base (276)..(276): a, c, t, g, unknown or other
  misc_feature (276)..(276): n is a, c, g, or t
  modified_base (307)..(307): a, c, t, g, unknown or other
  misc_feature (307)..(307): n is a, c, g, or t
tcagacagtatatacacgaccggtgctcgatttagcactcgcacgttgggtttggggagaggagcccagcactgggattccgaggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccaggccgtgggacgtccctgacgctctcctgtgcagcgtctggattccaccttnagtacctagtcgcagtcgacacgtgggcccncaggcctccgaggcgaaggggctgggacggtgggtcgacttacgttaatagtacgggtatggaagttaagggtaaaagtttaaaacttaaaaattcgttaaatcggaactaacgtaccgttaccgggaaaggtaaccgggggtaacccgtaacgtttacccgaaaccctacgttacccgttaaccgaaacggtaacgtaaaacctaaaacgttaaaccgaaaacgtaaaacccacgtaaccgttacgttaacttacgtacgtaaacctaaaagtacaaacgaacgaccgtagaacgacgaccggaaggaaccgtaacggtcgttagttacggttactttaacgcggttagaggaacgtaataactttagttacggtaacgtaccttaaccgtaccg

SEQ ID NO: 319325 - DNA, 533 bp, Homo sapiens
  misc_feature: GZ8MTXP02J1RR5.44.55.E11.1.454.CMB.2.raw
  modified_base (271)..(271): a, c, t, g, unknown or other
  misc_feature (271)..(271): n is a, c, g, or t
  modified_base (296)..(296): a, c, t, g, unknown or other
  misc_feature (296)..(296): n is a, c, g, or t
  modified_base (323)..(323): a, c, t, g, unknown or other
  misc_feature (323)..(323): n is a, c, g, or t
  modified_base (333)..(333): a, c, t, g, unknown or other
  misc_feature (333)..(333): n is a, c, g, or t
  modified_base (341)..(341): a, c, t, g, unknown or other
  misc_feature (341)..(341): n is a, c, g, or t
  modified_base (481)..(481): a, c, t, g, unknown or other
  misc_feature (481)..(481): n is a, c, g, or t
tcagacagtatatacacgaccggtgctcgatttagcactcgcacgttgggtttggggagaggagcccagcactgggattccgaggtgtttccattcggtgatcagcactgaacacagaggactcaccatggagttttggctgagcgtgggttctccttgttggacttttaaaaggtgtccagtgtgaggtgcggctgatggagtctggatgaggcttagccagccgtgggggtcccagagactctcctgtgcagcctcgtggctcaccgtnagcagcaactacatgagtttggccncaggctcgaggagggctggagtggctnagtcatttanacgtggtntattcatattacaccgcacgcgtcgagacggtctactaccactatccgacgagactacgtacgaagtactacgttatactacaaatacaacgtacgtgacggacgacgacgtacgacgtctactagtacgtgtcgacganacgtagcgcgcgtaggtagttgttattacgttcgttacgcgttcggacggcg

SEQ ID NO: 319326 - DNA, 564 bp, Homo sapiens
  misc_feature: GZ8MTXP02IRZ6L.44.55.E11.1.454.CMB.2.raw
  modified_base (345)..(345): a, c, t, g, unknown or other
  misc_feature (345)..(345): n is a, c, g, or t
  modified_base (435)..(435): a, c, t, g, unknown or other
  misc_feature (435)..(435): n is a, c, g, or t
  modified_base (440)..(440): a, c, t, g, unknown or other
  misc_feature (440)..(440): n is a, c, g, or t
tcagacagtatatacacgaccggtgctcgatttagcactcgcacgttgggtttggggagcttcagctgtgggtagagaagacaggactcaggacgatctccagcatggccagcttccctctcctcctcaccctcctcactcactgtgcagggtcctggcccagtctgtgatgtctcagccaccctcagcgtcgtcgggacccccggcagggggtcaccatctctgtctggagagtccatatcgatctatcctgtcaactggtatcgggactccaggccaccggcccccgactcctatctatcgctactatcaggccgccctcgacgggtccctgcccgtattccncgtgcctcagtctgcactacgagcctaccgtcggcctactcttgactctccagtctgagatgaggctagtattactagtgtagcagcagnggtangacgacggaccgggacgtcggtggggtggttccggggacggtacggggtaccgtacggtttaccgaacccggttcgtaaacggtcgaaccgtaccgaacggccgtacccggtccccgttcccgg

SEQ ID NO: 319327 - DNA, 576 bp, Homo sapiens
  misc_feature: GZ8MTXP02JSXD3.44.55.E11.1.454.CMB.2.raw
  modified_base (304)..(304): a, c, t, g, unknown or other
  misc_feature (304)..(304): n is a, c, g, or t
  modified_base (339)..(339): a, c, t, g, unknown or other
  misc_feature (339)..(339): n is a, c, g, or t
  modified_base (399)..(399): a, c, t, g, unknown or other
  misc_feature (399)..(399): n is a, c, g, or t
  modified_base (432)..(432): a, c, t, g, unknown or other
  misc_feature (432)..(432): n is a, c, g, or t
tcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtcgtggaggaggcttagtccaggccgtgggggtcccagagactctcctgtgcagcctcgtggctcaccgtcagcagcaactacattggattcggggtccnccagggctccgaggggaagggctggagtgggtctnaggtcagtttatactggtgatttcgacataccagcagactccgtgaaggccgattcaccntctccgagggacaattccgagaacacggtttancttacgaattgaaccacgtgagagggacgaccgacgaaccggtccgtactagtaacttgtacgcgacgacgaacgtccggacgcgtacggtgttacggttaattaacgttcgttagtaactttcgtacggggacctaaccgggg

SEQ ID NO: 319328 - DNA, 532 bp, Homo sapiens
  misc_feature: GZ8MTXP02FHG8Y.44.55.E11.1.454.CMB.2.raw
  modified_base (391)..(391): a, c, t, g, unknown or other
  misc_feature (391)..(391): n is a, c, g, or t
  modified_base (416)..(416): a, c, t, g, unknown or other
  misc_feature (416)..(416): n is a, c, g, or t
  modified_base (420)..(420): a, c, t, g, unknown or other
  misc_feature (420)..(420): n is a, c, g, or t
tcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtgggggtcccagagactctcctgtgcagcctcgtgggctcaccgtcagcagcaactacatgagttggtccgccaggctccgaggggaagggctggagtgggctcagtcatttatacgtggtgatttcacatactacgcagactcgtagaagggcattcaccanctcaggacaatcaggacacgtttancttnaaatgaaacactgagaggcgacgacacggcgtcatactgtagcgagacaagtcgggcgacgtcggagtggttaattagtttcgttgtacctttcggtggggacctaacgggg

SEQ ID NO: 319329 - DNA, 716 bp, Homo sapiens
  misc_feature: GZ8MTXP02H9H83.44.55.E11.1.454.CMB.2.raw
  modified_base (256)..(256): a, c, t, g, unknown or other
  misc_feature (256)..(256): n is a, c, g, or t
tcagacagtatatacacgaccggtgctcgatttagcactcgcacgttgggtttggggggaggaggagcccagcactgggattccgaggtgtttccattcggtgatcagcactgaacacagaggactcaccatggagttttggctgagctgggttctccttgttggtacttttaaaaggtgtccagtgtgaggtgcggctgatggagtctggaggaggcttagtccagccgtgggggtccagagactctcctgtgcngcctcgtggctcaccgtcagcagacaactacatgtaggtttcgggtcccgccgacgggcctccggaacggggaaggggcgtgggagtggggtctgagtctagtttatacgtggtagtatttcactactaaccgttacgcacgtactcccggtagggaacgggtacccgtacttacccaccctacgtccttacccgaacgggaacctaaaacgtttacccgaaacgggtaaaccgttaacccgggtttaacttacttaaaccaaaagtttacgaaaaccgtaacccgttaaggaacggacggggaccgaacccgaaccgacccggtaccgttacttaacttacgtcggtacgaccggtaagaaaccgtaggtccgggcgtacgttaccgggtaggttaggttttaacgttacgtttcggttttacgaccgtttacggtcgggggtaccgtaaacccggggg

SEQ ID NO: 319330 - DNA, 553 bp, Homo sapiens
  misc_feature: GZ8MTXP02H5BAS.44.55.E11.1.454.CMB.2.raw
  modified_base (298)..(298): a, c, t, g, unknown or other
  misc_feature (298)..(298): n is a, c, g, or t
  modified_base (349)..(349): a, c, t, g, unknown or other
  misc_feature (349)..(349): n is a, c, g, or t
  modified_base (364)..(364): a, c, t, g, unknown or other
  misc_feature (364)..(364): n is a, c, g, or t
  modified_base (474)..(474): a, c, t, g, unknown or other
  misc_feature (474)..(474): n is a, c, g, or t
tcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtgggggtcccagagactctcctgtgcagcctctgggctcaccgtcagcagcaactacatgagttgggccnccgaggctccgaggggagggctggagtgggtctcagtcatttatactggtnatttcacatacacgnagctcgtgaagggccattcaccatctccgagggacaaagttccgaaggtaactacggtttatcttacaaagtgaaacaactgaagaggcgaacgacacgcgtctattacngtacgagacgaacgacgtcgggcacgttcggaagttggttaattagttcgtttagaccgtttccggcggggaccgacgg

SEQ ID NO: 319331 - DNA, 695 bp, Homo sapiens
  misc_feature: GZ8MTXP02IWSCA.44.55.E11.1.454.CMB.2.raw
tcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcggctgatgggagtctggaggaggcttagtccagccgtgggggtcccagagactctcctgtgcagcctctgggctcaccgtcagcagcaactacaatgaggttcgggtcccgccagggcctcggaggggaaggggctgggaggtcgggtctacagtctatttactacgtggttgtatttcgactattaccacgcagtacccgtccggtagaacggggccgtaatttcccgaaacctattccctaccgaacgggggaacctaaagttaccccgaaagggtaaacccgtacgggtttttaactacgtttaactaaaacgttaacggaaacctaaacccgtgaacgggagggacccgaaccggaaccgaccgggtcccgtacttaacgtttaccgtgttacgaccggtaagaaccgtaaacggtcgggaccgtcggtacggtacggtttagtttaagtttacgtttcggtttcgtaacgtttccggtacgggggaccgttaaccgggg

SEQ ID NO: 319332 - DNA, 666 bp, Homo sapiens
  misc_feature: GZ8MTXP02HTTDD.44.55.E11.1.454.CMB.2.raw
tcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctgggagaggcttagtcagccgtgggggtcccagagactctcctgtgcagcctcgtgggctcaccgtcagcagcaactacatgagttcgggtccgccgaggcctaccgaaggggaaggggcgtggaggtgggtctcgagtctaatttatacgtggtgtatttcgaactatacctagcacgtacgtccgtagaacggccgtattccgaaccatcccgtaccgaagggtactaacgttacccaggtaacgtaacggtttactcctttaacaaaattacgaaactacccgtaggaaggaacgggaccaacgaccgaaccggtcctacgttaaagttacgtggtaccgaggtaaacgaacgttaaacggccggacgtcggttacggggtagttaggggtttttaaactttacgtttaccggtttacgtaccgtttaccggtcgggggaacccgtttaaacccggggg

SEQ ID NO: 319333 - DNA, 603 bp, Homo sapiens
  misc_feature: GZ8MTXP02HB5MR.44.55.E11.1.454.CMB.2.raw
tcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtggggggtcccagagactctcctgtgcagcctctgggctcaccgtcagcagcaactacatgagttggtccgcaggctccgagggaagggctggagtgggtctcgagtcatttagtactggtgtatttcactatactacgcagtactccgtagaacgggtccgattccgaccatccctaccgagggacaattccaaggaacctacgggtttactacgttacaaaattcgaaaacctaccgtagtaaggacgggacaacggaccacgggtcccgtactattacgtgtcgaccgaagccaaaggtccggcgccgttacggagtttggttaattacgtttcggttcgtaccgtttcggtcggggtaccctaaccggggg

SEQ ID NO: 319334 - DNA, 605 bp, Homo sapiens
  misc_feature: GZ8MTXP02IV9UW.44.55.E11.1.454.CMB.2.raw
  modified_base (367)..(367): a, c, t, g, unknown or other
  misc_feature (367)..(367): n is a, c, g, or t
tcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggagaggcttagtccagccgtgggggtcccagagactctcctgtgcagcctctggctcaccgtcagcagcaaactacatgagttcgggtccgccaggcctaccggaaggggaggggctggggagtcggggtctacgcgtactaacttttagtactggggttntattttcaccgattacgtacgcacgactaccggtgaaacgggtccgtaatttccaccgtatcgtaccgagggactaaattccgaggaacctacggtttatacttacaaaatcgtaaacaccgtagacgacgggcgaacgacgacggtacgtctacgttcgtgtcgacgagacgtaaggcggcgacgtcggagttggttaattagttcgttcgtacgttccggtcggacctaaccgggg

SEQ ID NO: 319335 - DNA, 631 bp, Homo sapiens
  misc_feature: GZ8MTXP02FJJUD.44.55.E11.1.454.CMB.2.raw
  modified_base (261)..(261): a, c, t, g, unknown or other
  misc_feature (261)..(261): n is a, c, g, or t
  modified_base (274)..(274): a, c, t, g, unknown or other
  misc_feature (274)..(274): n is a, c, g, or t
tcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctggggggtcccagagactctcctgtgcagccctntgggctcaccgtnagcagcaaactacatggagttgggccgcaggctccgaggggaagggctgggagtgggtctcgagtcatttagtactggtgtatttcaactactaccagcacgacttccgtgaacgggtccattcccactatccctaccgaggggaccaaagttcccgaaagggaaacctaccgggttttaataccgtttaccaaaattccggaaaccaacccgtggaacgagggccgaaccgaccgacgggccctactaagttaaccgtggtacggacgacgaacaaggttccggccgacgttcgggaagttggttaacttagtttccggttacgaccgtttcgggcggggtaccctaaaccggggg

SEQ ID NO: 319336 - DNA, 663 bp, Homo sapiens
  misc_feature: GZ8MTXP02JESFF.44.55.E11.1.454.CMB.2.raw
  modified_base (275)..(275): a, c, t, g, unknown or other
  misc_feature (275)..(275): n is a, c, g, or t
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggtacttttaaaggtgtccagtgtgaggtgcggctgatggagtcgtggaggagcttagtccaggccgtgggggtccagagactctcctgtgcagtcctcgtggctcaccgtnagcagcaactacatgaggttcggtcccgcaggcctaccggaggggaagggcgtgggaggtcggggtctgtacgttcttaactttagtaccgtgggttagtaacttttcaacctaacttaacctacgtcaaaccggtaccgttaccgggtaggtaaaccggggtcccgttaattacccgaacccattaccccgtacccgaagggtaaccctaaagttaccgaacgggtaacttaacggttatacttaacgaaattacgaaactaaccgtgaagacggaccgacgacgaccgggtctacttatacgtgtcgacgacgtacgacggtcgcgtcgtacgtggttagttaacgtcgtttacgttcgtacgttccggtacggtacgtaaccggg

SEQ ID NO: 319337 - DNA, 725 bp, Homo sapiens
  misc_feature: GZ8MTXP02GZTC4.44.55.E11.1.454.CMB.2.raw
  modified_base (366)..(366): a, c, t, g, unknown or other
  misc_feature (366)..(366): n is a, c, g, or t
tcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtcgtggaggaggcttagtccaggccgtggggggtcccagagactctcctgtgcagcctcgtgggctcaccgtcagcagcaactacatgagtcgggtccgccgaggctaccggaaggggaagggcgtgggaggtgggtctacgtagtctattatacgtgggtntatttcactatactacgccgagtacgtccggtaggaacggggcctattaccacctacttacccgtacccgaaaggggaccctaaacgtttacccggaaacggtaaaccgttaacgggtttaacttacccgtttaaataaaaacggttacaaaaccgtaaacccgttagggaaacggtaacgggggaacccgaaacccgggttaaccgaaccggggtacccttaaccgttaacgtttacgtacggtacggaaccgtaacgaaacggtaaaccggtaccgggcgtacggtaccggtaggtttagtttaacgttaacgtttcggtttacgaccgtttcggtacgggggtaccctaaccgggg

SEQ ID NO: 319338 - DNA, 596 bp, Homo sapiens
  misc_feature: GZ8MTXP02FE6ZK.44.55.E11.1.454.CMB.2.raw
  modified_base (253)..(253): a, c, t, g, unknown or other
  misc_feature (253)..(253): n is a, c, g, or t
tcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtgggggtcccagagactctcctgtncagcctcgtgggctcaccgtcagcagcaaactacatgagttggtccgcaggctccgaggggaaggggctgggagtgggctgtagtcatttatacgtggtgtattcactatactacgcacgacctcggtagaagggccgattccacctatccgtacccgaagggaccaacttcccgaaaggaacctaacggtttatacgttaacaaaatgaaacctaacgtgaacggaggacgaccgaaccgacggtacctctaagtctagtgcgaagacgtaacggccggacgtcgtacggagttacgttaattacgttccgtttagacctttcggacggggcctaaacgggg

SEQ ID NO: 319339 - DNA, 443 bp, Homo sapiens
  misc_feature: GZ8MTXP02JMRBL.44.55.E11.1.454.CMB.2.raw
  modified_base (224)..(224): a, c, t, g, unknown or other
  misc_feature (224)..(224): n is a, c, g, or t
  modified_base (346)..(346): a, c, t, g, unknown or other
  misc_feature (346)..(346): n is a, c, g, or t
  modified_base (431)..(431): a, c, t, g, unknown or other
  misc_feature (431)..(431): n is a, c, g, or t
  modified_base (434)..(443): a, c, t, g, unknown or other
  misc_feature (434)..(443): n is a, c, g, or t
tcagacagtatatacacgaccggtgctcgatttagcactcgcacgttgggtccgccaggctccagggaaggggctggagtgggtctcagtcatttatactggtgatttcacatactacgcagactccgtgaagggccgattcaccatctccagggacaattccaggaacacggtttatcttcaaatgaacaacctgagaggcgacgacacggccgtctattacngtgcgagacaagtcggcgctcggagtggttattattcgtttgacttctggggccagggaaccctggtcaccgtcgcctccgcctccaccaggcccatcgtctcccctgccacctcctccagncacctctggggcaccagcggcctgggctgcctggtcaaggacctacgttcctatactactgtctgagcgggctggacaggcgcanagnnnnnnnnnn

SEQ ID NO: 319340 - DNA, 613 bp, Homo sapiens
  misc_feature: GZ8MTXP02IW06X.44.55.E11.1.454.CMB.2.raw
  modified_base (524)..(524): a, c, t, g, unknown or other
  misc_feature (524)..(524): n is a, c, g, or t
tcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtcgtggaggagcttagtccagccgtgggggtccagagactctcctgtgcagcctcgtggctcaccgtcagcagcaactacatggagttcgggccgccaggctccgaggggaggggctgggagtcgggtctcgagtctatttatacgttggtgtatttcactataccgtacgcagactccggtagaacggggtaccattccaccgtatctaccgaagggaactaacgttaccaacgggtaacgtaacggttttactacttacaaacgttacgaaactaaccgtgaaggacggacgtaccgacgacgtaccgtatagttacngtacgacgagacgacggtcggacgtacgtaccggtagtacgtttaagtagtttcggtttacgactttcggtcggggaccgttaaccggg

SEQ ID NO: 319341 - DNA, 726 bp, Homo sapiens
  misc_feature: GZ8MTXP02H3ZNQ.44.55.E11.1.454.CMB.2.raw
  modified_base (299)..(299): a, c, t, g, unknown or other
  misc_feature (299)..(299): n is a, c, g, or t
tcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtcagcctggggggtcccagagactctcctgtgcagcctcgtgggctcaccgtcagcagcaactacatgagttcgggccnccgaggctccgaggggagggctggagtgggtctcagtctattatacgtggtgtatttcactatactacgcagtactccgtagaacgggtccgaagttcccaaccctatcccgtaccgaaacggggtaaccaaacgtttacccgaaaggtaaacctaacgggttttaaacttcgtttaacaaaaagttcgaaaaaccctaaccgttaggaaaggaacgggggaccaaaccggaacccggtaaccggtacccgttaacttaacgtttaaccgtaagggttcggtaaacggaaacggtaaaccgtaaacgggtcccggggtccggtacggttaccggggtaacggtttaggggtttaaactttcggtttttaccggtttacggtaacccggtttacgggttccggggggttaaccccgtaaacccggggg

SEQ ID NO: 319342 - DNA, 631 bp, Homo sapiens
  misc_feature: GZ8MTXP02F64B0.44.55.E11.1.454.CMB.2.raw
  modified_base (537)..(537): a, c, t, g, unknown or other
  misc_feature (537)..(537): n is a, c, g, or t
  modified_base (541)..(541): a, c, t, g, unknown or other
  misc_feature (541)..(541): n is a, c, g, or t
tcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtcgtggaggagcttagtccagccgtgggggtcccagagactctcctgtgcacgcctcgtgggcctcaccgtcagcagcaactacatgtaggttcgggtccgcgaggcctaccggaggggaacgggtcgtgggagttcgggtctcgtagtctatttagtactggtagtactttacactactacacgtcagtaccgtccggtagaacggggtcctaagttcccaacctgtccctcgaaagggtactaacttaccgaggtaacttacggtttatacctaacaaaagtcgaaacaacgtgaacggagggaccaaccgtacgaccgggtctaacgttntacngtagaccgagtaccgacgtccggccgtacgtacggagttagttaagtttcgttacgtttagaccgtttcgtaaccggggccgtaaacggg

SEQ ID NO: 319343 - DNA, 693 bp, Homo sapiens
  misc_feature: GZ8MTXP02F4KHT.44.55.E11.1.454.CMB.2.raw
  modified_base (415)..(415): a, c, t, g, unknown or other
  misc_feature (415)..(415): n is a, c, g, or t
  modified_base (575)..(575): a, c, t, g, unknown or other
  misc_feature (575)..(575): n is a, c, g, or t
tcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtgggggtcccagagactctcctgtgcagcctcgtgggctcaccgtcagcagcaactacatgagtcgggtccgcaggctccgaggggaagggctgggagtgggtctgagtctatttatactgtagtatttacacgtatacctacgccgagaccgtaccgtgaaacgggggcctaactttccaaccctntaccctacccgaaggggtaaccaagtttacccgaacgggtaaaaccttaacgggttttaactaccgttaacctaaaagttaccggaaaaccttaacccgtaggaacgaaacgggggaccgaaaccggaacgtaccgggaccgttactaattttacccggnggtacgacggaacgaaacggtacggtaccggacgtcggtacgggtacggtttacggtttaacgtttacggtttcggttacggtaccggtttacggtacgggggtaccgtaaaccgggg

SEQ ID NO: 319344 - DNA, 676 bp, Homo sapiens
  misc_feature: GZ8MTXP02FLFNR.44.55.E11.1.454.CMB.2.raw
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggactttaaaggtgtccagtgtgaggtgcggctgatggagtctggaggaggcttagtccagccgtgggggtcccagagactctcctgtgcagcctcgtgggctcaccgtcagcagcaactacatgaggttcggtccgccgaggcctccgaggggaaggggcgtgggaggtggggtcctcgagttctatttatacgtggtgtatttcactatacctacgcaacgacctccggtagaacggggtccagttacccaaccctatccctacccgaagggtaactaaacgtttacccgaaacggtaaaccttaaccggtttaatacctttaacgaaaattcgaaaacctaaccgtagaacggacgggaccgaaaccggaaccgaccgggtacccgttacttaacgttaacgtggtacgacggtaaagaccgtaaaggtccggaccggtacgtacgggtaggtttagtttaacgtttatttcggttacgtacgttacggtacggggaccgtaaaccgggg

SEQ ID NO: 319345 - DNA, 681 bp, Homo sapiens
  misc_feature: GZ8MTXP02IYZE8.44.55.E11.1.454.CMB.2.raw
  modified_base (322)..(322): a, c, t, g, unknown or other
  misc_feature (322)..(322): n is a, c, g, or t
  modified_base (361)..(361): a, c, t, g, unknown or other
  misc_feature (361)..(361): n is a, c, g, or t
tcagacagtatatacacgaccggtgctcgatttagcactcgcacgttgggtttggggagcttcagctgtgggtagagaagacaggactcaggacgatctccagcatggccagcttccctctcctcctcaccctcctcactcactgtgcagggtcctgggcccagtctgtgatgtctcagcccaccctcagcgtcgtcgggaccccggcgagggggtccaccatctcgttgttctaggaagaagtaccaatagtcggtatcttatcctgtacaactggtagtcgggacctcccgacggccaccggccccccgactcctttacnctatcgactaactatcacggcccgcctcgaccggtcccncgcctattccctcgtcgcctaccgtacgtcgtcggcactaacgcggtacctaccgcgtcctactcctagtctacccgtcgacgttgtaagcggaagttcgggtaacggctaagtttactttaaacccgtgttcgggtacaccgtacggaggtaacggtaggggtaccttacgggaaacgaccggggaaccggggtacggtccgggtttaaggggtcggttaccgggacgggggaaacggtaaccgtacggtttaaccggcccgttacggttaacggtccgaacggtaccccgaggacccgttcccggcccccgtttacgg

SEQ ID NO: 319346 - DNA, 595 bp, Homo sapiens
  misc_feature: GZ8MTXP02IY5CL.44.55.E11.1.454.CMB.2.raw
  modified_base (510)..(510): a, c, t, g, unknown or other
  misc_feature (510)..(510): n is a, c, g, or t
tcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccaggccgtgggggtcccagagactctcctgtgcagcctcgtgggctcaccgtcagcagcaactacatgagttcgggtccgccgaggctccgaggggaacgggctgggagtgggtctcagtctatttatacgtggtgatttcaactattacctacgcagactccggtagaacggggccattccacctatctaccgaagggactaattccgaaggtaactacggttttacacttacaaaagttcgaaaaccaaaccgtgaacgagggccaacgacacggctcgtattacngtgacgtagacaacggtcggacgtcgtacggtagttggtttaacttagtttcgtttacgactttcggacggggtcctaaccgggg

SEQ ID NO: 319347 - DNA, 639 bp, Homo sapiens
  misc_feature: GZ8MTXP02HN8LU.44.55.E11.1.454.CMB.2.raw
  modified_base (541)..(541): a, c, t, g, unknown or other
  misc_feature (541)..(541): n is a, c, g, or t
tcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtgggggtcccagagactctcctgtgcagcctctggctcaccgtcagcagcaactacatgagttcgggtccgccacgggctaccggaggggaagggcgtggaggtgggtcctgagtctatttagtacgtggtgtactttcaactagtacctacgcgtacgtacctccggtaggaacgggccgtattcccaacctatcccgtaccgaagggacctaacgtttaccgaacggtaactacggtttatccgtaacaaaagttcaaaacctacgtaggaacgacgggacaaccgaccgtaccggccgttactagttaccgngtcgtacggaagtacgaaacggttcggacgtcccggtagggtagttggtttaactttgttcggttttacgacgtttcggcgggggtacctaaccgggg

SEQ ID NO: 319348 - DNA, 752 bp, Homo sapiens
  misc_feature: GZ8MTXP02F8OVY.44.55.E11.1.454.CMB.2.raw
  modified_base (176)..(176): a, c, t, g, unknown or other
  misc_feature (176)..(176): n is a, c, g, or t
  modified_base (194)..(194): a, c, t, g, unknown or other
  misc_feature (194)..(194): n is a, c, g, or t
  modified_base (265)..(265): a, c, t, g, unknown or other
  misc_feature (265)..(265): n is a, c, g, or t
  modified_base (282)..(282): a, c, t, g, unknown or other
  misc_feature (282)..(282): n is a, c, g, or t
  modified_base (355)..(355): a, c, t, g, unknown or other
  misc_feature (355)..(355): n is a, c, g, or t
tcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctcttgttggtacttttaaaaggtntccagtgtgaggtgcggntgatggagtcgtgggaggtaggtcttagtccaggtccggtcgggggtcccaggacgactcctcctgtcgcncgtccgtcgcgggtccnctaccgcagcagaccaactactagttggacggttcggtcccgacgacggcgtaccgggaaggggtaacggggnggttcgggagggttcgggtcctacgtagttacttatttaaagtcggttaggttacgtactttaccaactaacgtacctaacgtcacgtaaccggttccggtaaggggtaaccggtcgtacttacccacctacgtacccgtaacggaacggaaacttaaaccgttaccggaaaacgggtaaactttaccggtttaaacttacttaaacaaattaaccgaaaactaaccggtagaaggaacggggtacaaaccggtaaccgcggtaaccgttacttacgtacgtagacggaaccaggtaacccgaggttccggacgtcggtaacgggttacgtttaggtttaaccttttggttacgtttacggtaaccggtttcgggaacgggtacccgtaacccgggg

SEQ ID NO: 319349 - DNA, 694 bp, Homo sapiens
  misc_feature: GZ8MTXP02IW32D.44.55.E11.1.454.CMB.2.raw
  modified_base (188)..(188): a, c, t, g, unknown or other
  misc_feature (188)..(188): n is a, c, g, or t
  modified_base (259)..(259): a, c, t, g, unknown or other
  misc_feature (259)..(259): n is a, c, g, or t
  modified_base (283)..(283): a, c, t, g, unknown or other
  misc_feature (283)..(283): n is a, c, g, or t
  modified_base (350)..(350): a, c, t, g, unknown or other
  misc_feature (350)..(350): n is a, c, g, or t
  modified_base (452)..(452): a, c, t, g, unknown or other
  misc_feature (452)..(452): n is a, c, g, or t
tcagacagtatatacacgaccggtgctcgatttagcactcgcacgttgggtttggggagcttcagctgtgggtagagaagacaggactcaggacgatctccagcatggccagcttccctctcctcctcaccctcctcactcactgtgcagggtcctgggcccagtctgtgatgtctcagcccaccctnagcgtcgtcgggaccccggcgagggggtcacctatctcttgttctaggaagagtccaatatcggatcttanctgtacatggtagtcgggctccgnggccaccggcccccactctatctatgactactatcgacgccgccctcgacgggtccctcgacccgtntttccccgcgtcggtcctaccgtaagtccgttacggctacgtacgacggtccttaccgtcggaacctcgttcctagtactcctaccgtagtctaggaacgtnttacggacgtactagttaaacgttacgttacgtacggttgaccgtaggtacccgtagggttaggaacgttcgggaaaacccgttacgggggaaccgggtaaacggggtcccgggtttagggggtccggttaaccgggggaccggggaaccggtaaaccggttacggggttacccgtacccgttacggtaaacggtcccgaacggaccccggtacggtccccgtcccggtccccggtttacgg

SEQ ID NO: 319350 - DNA, 626 bp, Homo sapiens
  misc_feature: GZ8MTXP02IT66D.44.55.E11.1.454.CMB.2.raw
  modified_base (301)..(301): a, c, t, g, unknown or other
  misc_feature (301)..(301): n is a, c, g, or t
  modified_base (518)..(518): a, c, t, g, unknown or other
  misc_feature (518)..(518): n is a, c, g, or t
  modified_base (528)..(528): a, c, t, g, unknown or other
  misc_feature (528)..(528): n is a, c, g, or t
  modified_base (548)..(548): a, c, t, g, unknown or other
  misc_feature (548)..(548): n is a, c, g, or t
tcagacagtatatacacgaccggtgctcgatttagcactcgcacgttgggtttggggggagaggagcccagcactgggattccgaggtgtttccattcggtgatcagcactgaacacagaggactcaccatggagttttggctgagccgggttctccttgttggtacttttaaaaggtgtccagtgtgaggtgcggctgatggagtctggaggaggcttagtccagccgtgggggtcccagagactctcctgtgcagcctcgtggctcaccgtcagcagcaactacatgagttcgggcccncgacggccgtaccggaggggaaggggtcgaggtaggtcggtctgtagttcgtaattttatacgtgggttacttactttccaactacttaccgtacgacacgtaccttaccggtaggaaccgggtacctaacgtaccaaccctagtacccgacgtacgggaactaaacgtcccgaaagtaacgtacggtttaactctacgaaaatcgaaacctaccgngagagccganacgaccggctatactaccgngtagacgtaagacgagtcgcgtcgcggtaaattcggttaattgttcgttagtctacgggtcggcgtaaaccggtcccg

SEQ ID NO: 319351 - DNA, 685 bp, Homo sapiens
  misc_feature: GZ8MTXP02G1W5H.44.55.E11.1.454.CMB.2.raw
  modified_base (585)..(585): a, c, t, g, unknown or other
  misc_feature (585)..(585): n is a, c, g, or t
tcagacagtatatacacgaccggtgctcgatttagcactcgcacgttgggtttggggggagaggagcccagcactgggattccgaggtgtttccattcggtgatcagcactgaacacagaggactcaccatggagtttggctgagctgggttctccttgttggtacttttaaaggtgtcagtgtgaggtgcggctgagtggagtcgtggaggaggtcttagtccgaggtccggtgggggtcccagagactctcctgtgcacgcctcgtcggctcgaccgtcagcaagcaactacagtgaggttcgggccgaccgacggtcctaccggaggggaacggggcgtaggggtaggttcgggtctacgtagtacttagtttagacgtggtagtattacacgataacgacgctaacgacgtccggtaggaccggggtacctagttacccactacgtaccgtaccgaagggtaactaaccgttaccgaaaggaaccgtttacggtttaactacgttaaacaaacgttaaccgaaactaacccgtgggaagacgggtaccaaccgacgtaaccggtcgttactacgttaccgnggtaccaggacgaacgtaacggtcgacgtcgtaacggtgttaaggttaacgtttacgttacggtttacgaacggtttcggtacggggacccgtaaccggg

SEQ ID NO: 319352 - DNA, 627 bp, Homo sapiens
  misc_feature: GZ8MTXP02HRYKA.44.55.E11.1.454.CMB.2.raw
  modified_base (282)..(282): a, c, t, g, unknown or other
  misc_feature (282)..(282): n is a, c, g, or t
  modified_base (373)..(373): a, c, t, g, unknown or other
  misc_feature (373)..(373): n is a, c, g, or t
  modified_base (399)..(399): a, c, t, g, unknown or other
  misc_feature (399)..(399): n is a, c, g, or t
  modified_base (488)..(488): a, c, t, g, unknown or other
  misc_feature (488)..(488): n is a, c, g, or t
  modified_base (542)..(542): a, c, t, g, unknown or other
  misc_feature (542)..(542): n is a, c, g, or t
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagttgtggaggaggacttagtccaggccgtggggggtcccaggagactctcctgtgcagccctgtcgggctcgaccgtnagcagcaaacacatgagtggtcccgcacgggctaccggaggggaaggggctagggacgtgggtcctgtacgtataatttagaacttgggtnttacttttcaactaattaccgaaccngtaacgtacctcggtacggaagggtccattaccacctattccacccgaagggactaactaccgaaagtaactacgttataccttaaaanaatacgaaacctaagagacggacgacgacgaccgtacggtactacttaatacgngtacgacgtaagacgacgggcgtcgtacgtacggttagttagtttaagttacgttgttacgtacgtcggtacgggaccgtaacgg

SEQ ID NO: 319353 - DNA, 633 bp, Homo sapiens
  misc_feature: GZ8MTXP02IO4PG.44.55.E11.1.454.CMB.2.raw
  modified_base (299)..(299): a, c, t, g, unknown or other
  misc_feature (299)..(299): n is a, c, g, or t
  modified_base (305)..(305): a, c, t, g, unknown or other
  misc_feature (305)..(305): n is a, c, g, or t
  modified_base (463)..(463): a, c, t, g, unknown or other
  misc_feature (463)..(463): n is a, c, g, or t
tcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtgggggtcccagagactctctgtgcagcctcgtgggctcgaccgtcagccagcaactacatgagttggccncaggcncgaagggaggctggagtcgggtctacacgtcagtttaatacgtggtagtactttacgactagtacctacgcagtactccggtagaaccggggctagttaccaaccatcctaccgaagggaactaaacgtttccgaacgggtaaactaacgggtttaanaccttacgtaaaatcgaaaccaaccttaggacgaggaccgaaccgtaacgaacggccttacgtaattacgtgtacgacgaaggtaacacgggtaggccgtacgtacggtaggttaagtttaatttacgttaacggtttcaacgtttccgttcgggggaccaaaccggggg

SEQ ID NO: 319354 - DNA, 693 bp, Homo sapiens
  misc_feature: GZ8MTXP02IN4OK.44.55.E11.1.454.CMB.2.raw
  modified_base (256)..(256): a, c, t, g, unknown or other
  misc_feature (256)..(256): n is a, c, g, or t
  modified_base (292)..(292): a, c, t, g, unknown or other
  misc_feature (292)..(292): n is a, c, g, or t
tcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggtacttttaaaggtgtccagtgtgaggtgcggctgatggagtcgtggaggaggcttagtccaggccgtggggggtcccaggagactctcctgngcacgcctcgtggctcgaccgtcagcagcaactacntgacggttcggcccgccgaggccgtaccggaggggaacggggctagggaggttcgggtctacgagtctatttaagtcgttaggtgtatttacactaactaccgttacgcgtaacgtaacctccggtaaggaacggggtccctaattaccacctacgtacccgtaccgcgggtaaacaacgtttacccaacgggtaaaccttaacgggtttactacttaaacgtaaaacgtacgtaaaccgaaccgttagaacggaacgggacggtaacccggaaccgtaccgggtcgttactaaacttcgtacgtcgacggtaacgaaacgaaacggtcgggcgaccgttacggaggtttagttaagtttagttcgtttcggtactttccggacggggtacgaaaccgggg

SEQ ID NO: 319355 - DNA, 656 bp, Homo sapiens
  misc_feature: GZ8MTXP01EEY3O.4.71.G05.1.454.CMB.2.raw
  modified_base (242)..(242): a, c, t, g, unknown or other
  misc_feature (242)..(242): n is a, c, g, or t
  modified_base (255)..(255): a, c, t, g, unknown or other
  misc_feature (255)..(255): n is a, c, g, or t
tcagagcactgtagcacgaccggtgctcgatttagtgtcgtcgcaagagagagggggtgggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctggagatgcattgaccaaaaaaatntgattatgacagnagagcagccacgacccaaagtgacatctatagaagacgaacaaaccgacccgtaccgggactccgtagagagtacttctccgtcggtctccgagtcctaacgaagggtaacttagtccggaccctaccgttagaactagtcgagggtcggggacccgaagggtgggaaggtagtaggaacgtcgtacgaacttacgtacttacgttaactacgtaaagttaacgaaacgtaaacgtaaggtagtaagtttaaacgtttcggttaggggttcggttaccggggacgggtaacgggtaaaccgtaaacggttcggtaacccggttacgtaacgggtaccgaccggcccgaacgggtccctccggtccccgttcggtacccttaccgttccgttcccgttcccc

SEQ ID NO: 319356 - DNA, 567 bp, Homo sapiens
  misc_feature: GZ8MTXP01DB8UE.4.71.G05.1.454.CMB.2.raw
  modified_base (241)..(241): a, c, t, g, unknown or other
  misc_feature (241)..(241): n is a, c, g, or t
tcagagcactgtagcacgaccggtgctcgatttagtgtcgtcgcaagagagagggggtgggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctggagatgcattgaccaaaaaatntgcttattggtaccagcagaagtcaggccaggaccccaaaattggtcatctatgaagacgaacaaacgccctccgggatccctgagagattctcctggctccagctacgagggctatggaccaccttgactatcagtgggccaagtggagatagaagctgactactactagttactacgaaatagaagaacagtagattaaagtttcgtggggtgttcgggcgggtaaggggaacctaaacgttcggtacccgttccgttagggtccacggccccaaagggccctcggtcccccgtcgggtccaccgttccgttcgtttccccccg

SEQ ID NO: 319357 - DNA, 560 bp, Homo sapiens
  misc_feature: GZ8MTXP01DBRR4.4.71.G05.1.454.CMB.2.raw
  modified_base (241)..(241): a, c, t, g, unknown or other
  misc_feature (241)..(241): n is a, c, g, or t
tcagagcactgtagcacgaccggtgctcgatttagtgtcgtcgcaagagagagggggtgggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctggagatgcattgaccaaaaaatntgcttatggtaccagcagaagtcaggccaggccccaaaattggacatctatgaagacgaacaaacgaccctcgggatccctgagagattctcctggctccagctacgagggctatgggccctaaccttgactatccaggtggggacccaaggtggaggatagaagctagactactactgttactacaataagagaacagtagtataatttcgtagggtgttcgggacgggagggaaccaaacgttggacccgttcgtaacggtcacgcccgaaggtcctacgtcccccgttcggtccaccgttccgttccgttcccccg

SEQ ID NO: 319358 - DNA, 539 bp, Homo sapiens
  misc_feature: GZ8MTXP01BONLB.4.71.G05.1.454.CMB.2.raw
  modified_base (240)..(240): a, c, t, g, unknown or other
  misc_feature (240)..(240): n is a, c, g, or t
tcagagcactgtagcacgaccggtgctcgatttagtgtcgtcgcaagagagagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaatntgcttattggtaccagcagaagtcaggccaggccccaaaattggcatctatgaagacgaacaaacgaccctccgggatccctagacgagattctcctggctccagctacagggctatggccaccttgactatcagtcgggccaagtggaggatagaagctgactactactagttactcaaatagaagaaacagtgattaagtttcgtgggttgttcgggcggtaaggggaaccaaagttcgaaccgttcgtaaggtcacggcccaaggctcgcccctcgggtcactccttcgtcccccg

SEQ ID NO: 319359 - DNA, 670 bp, Homo sapiens
  misc_feature: GZ8MTXP01EU1NW.4.71.G05.1.454.CMB.2.raw
  modified_base (246)..(246): a, c, t, g, unknown or other
  misc_feature (246)..(246): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagcccaccctcggtgtcagtgtccccaggacaaacggccaggatcacctgctctggagatgctattgaaccaaaaaaatntgacttatggtaccagcagaagtcaggccaggaccccaaaattggtacatctatagaacgacgaacaaaccgccctaccgggatccctgagagacttctccgtcggctacccgagtccgtacgaacgggtaactagtccgggaccctaccgtttgaactagtacgagggtcggggacccaagggtgggaaggagttaggaagtcgtacggaacttactaacttagtttaacctacgtaaagttaaggaaagtaaacctaggttaggtaaatttaaagttttaccggtggggttacggttcgggacgggaacgggaacctaaaacgttcggtaccccgttacgtacgggtaccgacggcccgaaacgggtccctcccggtccccccgttgggtcccttaccgttcccgtttcgggtttccccccc

SEQ ID NO: 319360 - DNA, 538 bp, Homo sapiens
  misc_feature: GZ8MTXP01C53G8.4.71.G05.1.454.CMB.2.raw
  modified_base (240)..(240): a, c, t, g, unknown or other
  misc_feature (240)..(240): n is a, c, g, or t
  modified_base (368)..(368): a, c, t, g, unknown or other
  misc_feature (368)..(368): n is a, c, g, or t
tcagagcactgtagcacgaccggtgctcgatttagtgtcgtcgcaagagagagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaatntgcttattggtaccagcagaagtcaggccaggccccaaaattggtcatctatgaagacgacaaacgaccctccgggatccctgagagattctctggctccagctcagggctatggccaccttgactancagtgggccaagtgaggatgaagctgactactactagttactcaatagaagaacagtgtaattaatttcgtggggtgtttcgggcggtaaggggaaccaaacgttggacccgttccgtaggtcagccccaaggctcggccccctcgggtccacctccgttcgttcccccg

SEQ ID NO: 319361 - DNA, 692 bp, Homo sapiens
  misc_feature: GZ8MTXP01A5UPV.4.71.G05.1.454.CMB.2.raw
  modified_base (265)..(265): a, c, t, g, unknown or other
  misc_feature (265)..(265): n is a, c, g, or t
tcagagcactgtagcacgaccggtgctcgatttagtgtcgtcgcaagagagagggggtgggctcaggaggcagagctctgggaatctcaccatggcctggacccctctcctgcctccccctcctcactttctgcacagtctctgaggcctcctatgagctgacacacgcccacccgtcggtgtcagtccgtaccccgaaggaaccgaaacggccaggactccaccgtgctcgtggagatgctaattacgaaaacctaaaaaaatntagtactttaagttacggtaaccagacaagaacgtacgacggacccgaacggaaacccctaaaagttcggtacatactaagtagaaacgaaccgaaaccgaaacccgtaccccgtaccgggactcccgtagagagtacttctcgtcggctaccgacgtccgtaacgacgggtctagtccggaccctacgttcgaactacgtcgacgggtccgggaccgaagggtaggaggtagtaggaagtctacgtactacgttactacgttaactaagtaaagtaaggaacgtaagtagtagtaagtttaagtttcggtgggttcggttaccgggacgggtaacggaaacctaacgttcggacccgttacgtacggcgaccgccgaacggccgtcccgccccgttcggaccttccgttccttcccgttaaccccc

SEQ ID NO: 319362 - DNA, 569 bp, Homo sapiens
  misc_feature: GZ8MTXP01CLRVD.4.71.G05.1.454.CMB.2.raw
  modified_base (241)..(241): a, c, t, g, unknown or other
  misc_feature (241)..(241): n is a, c, g, or t
  modified_base (363)..(363): a, c, t, g, unknown or other
  misc_feature (363)..(363): n is a, c, g, or t
tcagagcactgtagcacgaccggtgctcgatttagtgtcgtcgcaagagagagggggtgggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctggagatgcattgaccaaaaaatntgcttattggtaccagcagaagtcaggccaggccccaaattggtcatctatgaagacgacaaacgccctcgggatccctgagagattctctggctcagctcagggctatggccactgactancagtgggccaagtggaggatgaagctgactactactgttactcaatagagaacagtgataatttcgtaggggttgttcgggcgggtaggggaaccctaaaacgttcggtacccgttccgtaaacgggtcacggccccgaaacggggtccctccggtcccccccgttcggggtacccttacccgttccgttccggttttcccccccg

SEQ ID NO: 319363 - DNA, 632 bp, Homo sapiens
  misc_feature: GZ8MTXP01CU4IF.4.71.G05.1.454.CMB.2.raw
  modified_base (240)..(240): a, c, t, g, unknown or other
  misc_feature (240)..(240): n is a, c, g, or t
  modified_base (452)..(452): a, c, t, g, unknown or other
  misc_feature (452)..(452): n is a, c, g, or t
tcagagcactgtagcacgaccggtgctcgatttagtgtcgtcgcaagagagagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaatntgcttatggtaccagcagaagtcaggaccaggacccccaaaattggtacaacctctaatgaaagacgaacaaaccgacccctaccgggatcccctagagagacttctcctggctccagctacagggctagtcggcccaccttgactatcaggtcgggacccaaggtggaggagtagaagctgaactactactagttacactaaataggtaanaaacgagtgtaattaagtttcgtggggttgtttcgggacgggaaggggaaccctaaaacgttcgggtaacccgttccggtaaacgggttccgaacggcccccgaaaggggtccccgtcccggtccccccccgttacgggggtacccttacccgttcccgttccggttttaaccccccccg

SEQ ID NO: 319364 - DNA, 533 bp, Homo sapiens
  misc_feature: GZ8MTXP01BZP4M.4.71.G05.1.454.CMB.2.raw
  modified_base (240)..(240): a, c, t, g, unknown or other
  misc_feature (240)..(240): n is a, c, g, or t
tcagagcactgtagcacgaccggtgctcgatttagtgtcgtcgcaagagagaggggtgggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctggagatgcattgaccaaaaaatntgcttattggtaccagcagaagtcaggccaggccccaaaattggtcatctatgaagacgacaaacgccctccgggatccctgagagattctcctggctccagctacagggctatcgggccaccgttgactatcagtcgggacccagtggagatagaagctgactactacttagttactacaatagagaacagtgattaagtttcgtagggtgttcggcgggtagggaaccaaacgttgaccgttcgtacggtcacgccgaaggctcgcccctcggtcacctcgttcgttcccc

SEQ ID NO: 319365 - DNA, 543 bp, Homo sapiens
  misc_feature: GZ8MTXP01EQKZO.4.71.G05.1.454.CMB.2.raw
  modified_base (241)..(241): a, c, t, g, unknown or other
  misc_feature (241)..(241): n is a, c, g, or t
  modified_base (374)..(374): a, c, t, g, unknown or other
  misc_feature (374)..(374): n is a, c, g, or t
  modified_base (430)..(430): a, c, t, g, unknown or other
  misc_feature (430)..(430): n is a, c, g, or t
tcagagcactgtagcacgaccggtgctcgatttagtgtcgtcgcaagagagagggggtgggctcaggaggcagagctctgggaatctcaccatggcctggacccctctcctgctcccctcctcactttctgcacagtctctgaggcctcctatgagctgacacagcccaccctcggtgtcagtgtccccaggacaaacggccaggatcacctgctctggagatgcattgaccaaaaaaatntgcttatggtaccagcagaagtcaggaccaggaccccaaaattggtcatctatgaagacgacaaacgaccctccgggatccctgacgagattctcctggctcagctacgagggctatggccctacttgactancgagtgggcccaagtggaggagtagaagctgactactactagtactcgaataaganaacagtgtataatttacgtgggtgttcggagggaggaactaaacgttggaccgttcgtagggtcacggcccaagggcctcgcccccgtggtccaccgttcttcgttaaccccc

SEQ ID NO: 319366 - DNA, 607 bp, Homo sapiens
  misc_feature: GZ8MTXP01AO9WC.4.71.G05.1.454.CMB.2.raw
  modified_base (241)..(241): a, c, t, g, unknown or other
  misc_feature (241)..(241): n is a, c, g, or t
tcagagcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaatntgcttattggtaccagcagaagtcaggccaggccccaaattggacatctatagaagacgaacaaaccgaccccgtccgggatcccgtagagagtattctcctggctcagctacgacgggtctagtcgggacctaccttgactatcgaggtgggcccaaaggtggaggatagaagctagacttactactagttactacaatacgagaacagtagattaagtttcgtagggtgttcgggacggtagggaaccgtaaacgttcggacccggttaccgtacggttcgaccggttccccggaaacgggtccccttccggggcccccccttacggggtcccgaaccctttcccgttcccggttttccccccc

SEQ ID NO: 319367 - DNA, 737 bp, Homo sapiens
  misc_feature: GZ8MTXP01A29GD.4.71.G05.1.454.CMB.2.raw
  modified_base (224)..(224): a, c, t, g, unknown or other
  misc_feature (224)..(224): n is a, c, g, or t
  modified_base (244)..(244): a, c, t, g, unknown or other
  misc_feature (244)..(244): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggatcacctgctctgganatgcattagaacaaaaaatntgtacttattggtaccagtcaagaagtcacggaccacggaccccaaaagttggtacatctaagtagaaagaacgaacaaaccgaccccgtaccgggaactccccgtaggaacgtaagtacttaccgtccgtcgggccttaccgacggtccttaacggaaacgggtaacttacgtaccgggtacccctacccgtttagaaccttacgtaccgtaacggggttaccgggggaacccctaaaggggttggggaaagggtagttaacgggaaacgtcgttaacggtaaccttaacccgttaacgtttacgttaaactacggtaaaagttaacggtaaagtaaaccgtagttagtaaagtttacgtttacggtggggttacggttaccggggacgggtaacgggaaccgtaaaacgttcggtaaccggttacgtacggacgaccgttcccgaaggtcctacccgccccgtacggtccaccttcgttccgttccccccg

SEQ ID NO: 319368 - DNA, 592 bp, Homo sapiens
  misc_feature: GZ8MTXP01AVKU5.4.71.G05.1.454.CMB.2.raw
  modified_base (295)..(295): a, c, t, g, unknown or other
  misc_feature (295)..(295): n is a, c, g, or t
tcagagcactgtagcacgaccggtgctcgatttagtgtcgtcgcaagagagagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaattgcttatgtaccagcagaagtcaggccaggaccccaaaattggtacatctatgaanacgaacaaacgaccctcgggatccctgagagattctctggctccagctacagggctagtcggaccaccttgactatcgaggtcgggacccaaggtgggaaggataggaagtctagactactacgtgttactacaaatagaagaacagtagaattaagtttcggtagggttcggttacggggcgggtaaggggtaacccaaaacgttcggaaccccggttccgttaacgggtccgacgccccggaaaggtcccgtccgccccccgttcgggtccttaccttccgttccggttcccccc

SEQ ID NO: 319369 - DNA, 665 bp, Homo sapiens
  misc_feature: GZ8MTXP01DB3MM.4.71.G05.1.454.CMB.2.raw
  modified_base (181)..(181): a, c, t, g, unknown or other
  misc_feature (181)..(181): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagcccaccctcggtntcagtgtccccaggacaaacggccaggatcacctgctctggagatgcattgaaccaaaaaaattgcttatggtaccagcagaagtcaggccaggaccccaaattggacatctatgaagacgaacaaaccgcccgtaccgggatccctgagagattctcgtggctcagctacgagggctagtcggccctacgttgacttagtcgaggtcggggacccaagggtgggaaggagtaggaaacgtctaggtaaccttaactacgttacgtttaacctacgtaaagtaaggaaacgtaaacgtaggttagtaagtttaaagttttaccggtgggggtttacggttaccggggacggggtaaacgggtaaaccctaaacggttcggtaaccccggttaccgtaacgggtccgaaccggccccgaaacgggtccccgtcccgtccccccggttccggtaccttacccgttccgttcccggtttcccccccg

SEQ ID NO: 319370 - DNA, 543 bp, Homo sapiens
  misc_feature: GZ8MTXP01E2FEH.4.71.G05.1.454.CMB.2.raw
  modified_base (242)..(242): a, c, t, g, unknown or other
  misc_feature (242)..(242): n is a, c, g, or t
  modified_base (451)..(451): a, c, t, g, unknown or other
  misc_feature (451)..(451): n is a, c, g, or t
  modified_base (513)..(513): a, c, t, g, unknown or other
  misc_feature (513)..(513): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagcccaccctcgtgtcagtgtccccaggacaaacggccaggatcacctgctctggagatgcattgaccaaaaaatntgcttatggtaccagcagaagtcaggccaggcccccaaaattggtcatctatgaagacgaacaaaccgacccctccgggatccccgtgagagattctcctggctccagctcgagggctagtcggccaccttgactatcagtcggggcccaaggtggaggatgaagctgactactactgtactcaatagagaacagtgattaaatttcgnggggttgttcgggcgggaagggaaccaaacgttgaccgttccgtaggtcacgcccaaggccncgccccctggtccactccgttcgtcccccg

SEQ ID NO: 319371 - DNA, 769 bp, Homo sapiens
  misc_feature: GZ8MTXP01EY596.4.71.G05.1.454.CMB.2.raw
  modified_base (246)..(246): a, c, t, g, unknown or other
  misc_feature (246)..(246): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagcccaccctcggtgtcagtgtccccaggacaaacggccaggatcacctgctctggagatgcattgaaccaaaaaaattntagtacttagttacggtaccagacaagaacgtcgacggaccgaacggacccctaaagttcggtacattactaagtagaaacgaaccgaaaccaaaccgtaccccgtaccgggactcccgagagacgtacttcgtccgtcggctaccgacgtcctaacgacgggtaacttacgtccggaccctaccgttacgaacttacgtacgtacggggtaccggggaacccgtaaagggtagggaaggtaagtaacgggaacgtcgtacgtaaccttacgttaacgtttacgttaaccttaacgtaaagttaaacggaacgtaaacgtaggttaagtaagtttaacgtttacgggttaggggtttcgggttaccggggtacggggtaaaccgggtaaacccgtaaacggttaccgggtaacccgttacccggtaacgggtacccaaccgggttaccccgttaacgggtccccgtaccccggtccccccggttacggtacccttacccgtttcccgttccccgttaaccccc

SEQ ID NO: 319372 - DNA, 741 bp, Homo sapiens
  misc_feature: GZ8MTXP01EESDS.4.71.G05.1.454.CMB.2.raw
  modified_base (247)..(247): a, c, t, g, unknown or other
  misc_feature (247)..(247): n is a, c, g, or t
  modified_base (317)..(317): a, c, t, g, unknown or other
  misc_feature (317)..(317): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctggagatgcattgaaccaaaaaaattntagtacttagttaggtacagacaagaagtacgacggaccaacggaaccctaaagttcgtactatactaanagaacgaaccgaaaccgaaaccgtaccccgtacccgggactacccgtagaacgtacgtacttccgtccgtcggcctaccgacgtccgtaacgaacgggtaactacgtaccggtaccctaccgttagactagtacggtacgggtacggggaccgtaagggtagggaaggtaagtaaggacgtacgtacgtaaccttaacgttaacgttacgttaactaacgtaaagtaaaggaaacgtaaacgtaaggttaagttaagtttaagtttacgggttggggttacgggttaccggggtaacggggaaacgggtaaacctaaacggttaccggtaacccggttacggtaacggtaccgaaccggacccgacgggtccctcccggtaacccccgtcggtaccttacccgttcccgttaacccgttccccc

SEQ ID NO: 319373 - DNA, 596 bp, Homo sapiens
  misc_feature: GZ8MTXP01BHDPZ.4.71.G05.1.454.CMB.2.raw
  modified_base (367)..(367): a, c, t, g, unknown or other
  misc_feature (367)..(367): n is a, c, g, or t
  modified_base (377)..(377): a, c, t, g, unknown or other
  misc_feature (377)..(377): n is a, c, g, or t
  modified_base (518)..(518): a, c, t, g, unknown or other
  misc_feature (518)..(518): n is a, c, g, or t
tcagagcactgtagcacgaccggtgctcgatttagtgtcgtcgcaagagagagggggaagaccgatgggcccttggtggaggcttggtgaagccggggggtcccttagactctcctgtgcagtctctggactcaacctcaaaatgcctggatgacctgggtccgccagactccagggaagggctgcagtgggttgccgtattataaccaaacctgatggtgagacaacagactacgctgcacccgtgaaaggcagattcaccatctcaagagatgattacaacgaacacgcttagttttggaaatgaacagcctagaaaaccgaggacacagtcccgtttattctgttccactactccctgcctacngtatattcgngaactataatcgctatatggacgtcgtggggccaagggcccacgacgtcacccgtctcctacaaccctcccaaccaacgggccccaacgttccgggtccttcccccgtggcccgccccttggaccctccgacggacgcccncccgtccgacgagccacgacgccggccccgttggggcctcggccctggtccgaacggttacctaaccttcccgtaacg

SEQ ID NO: 319374 - DNA, 539 bp, Homo sapiens
  misc_feature: GZ8MTXP01B4ILY.4.71.G05.1.454.CMB.2.raw
  modified_base (241)..(241): a, c, t, g, unknown or other
  misc_feature (241)..(241): n is a, c, g, or t
tcagagcactgtagcacgaccggtgctcgatttagtgtcgtcgcaagagagagggggtgggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctggagatgcattgaccaaaaaatntgcttatggtaccagcagaagtcaggccaggccccaaaattggcatctatgaagacgaacaaacgccctcgggatccctgagagattctctggctcagctacgagggctagtcggcctaccttgactatcagtcgggcccaaggtggaggatagaagctgacttacgtactgttactacaaatagaagaacagtgtaattaatttcgtgggtgttcgggcggaggaaccaaagttcggaccgttcgtaggtcacgcccgaaggctcgcccctcggtcttactccgttcgttaaccccc

SEQ ID NO: 319375 - DNA, 644 bp, Homo sapiens
  misc_feature: GZ8MTXP01DJLEX.4.71.G05.1.454.CMB.2.raw
  modified_base (241)..(241): a, c, t, g, unknown or other
  misc_feature (241)..(241): n is a, c, g, or t
tcagagcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaatntgcttatggtaccagcagaagtcaggccaggaccccaaaattggcatctatgaagacgacaaacgaccctcgggatccctgagagattctctggctcagctacgagggctatcgggccctaccgttgactatacgaggtcgggacccgtaaggtgggaaggtagtaggaacgtcgtagaaccttactaacttaggtttaacctacgtaaattaaggaagaaacgtaaggttagaagtttaaagttttcgttagggggttggtttccggggacgggtacgggggtaaaccctaaacggttacggtaaccccgttacgttaacgggtccacggttccccgaaacgggtccgtacccggcccccccgttgggtcccttaccgttcccgttccggtttccccccccg

SEQ ID NO: 319376 - DNA, 669 bp, Homo sapiens
  misc_feature: GZ8MTXP01CBSPA.4.71.G05.1.454.CMB.2.raw
  modified_base (225)..(225): a, c, t, g, unknown or other
  misc_feature (225)..(225): n is a, c, g, or t
  modified_base (244)..(244): a, c, t, g, unknown or other
  misc_feature (244)..(244): n is a, c, g, or t
  modified_base (337)..(337): a, c, t, g, unknown or other
  misc_feature (337)..(337): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctgganatgcattgaccaaaaaatntgcttatggtacagcagagtcaggccaggaccccaaattggcatctatagaagacgaacaaacgcccctcgggactccctgagagattctccnggctcagctacgagggctagtcgggaccctacttgacttagtcaggtcggggacccaaagggtggaaggataggaagtctagaactactactagtttaacctacgtaaagttaaggaagtaaacgtaagttaggtaatttaaagtttccggttgggggttacggttacggggtaccggggtaacggggtaaacccgtaaacggttccgggtaaacccggttaccgtaaacgggttccgaaacccgggttcccgaaaccgggtcccgttacccggcccccccgttcggggtaccccttacccgtttcccgtttcccggtttaacccccccccg

SEQ ID NO: 319377 - DNA, 576 bp, Homo sapiens
  misc_feature: GZ8MTXP01ADJGM.4.71.G05.1.454.CMB.2.raw
  modified_base (225)..(225): a, c, t, g, unknown or other
  misc_feature (225)..(225): n is a, c, g, or t
  modified_base (449)..(449): a, c, t, g, unknown or other
  misc_feature (449)..(449): n is a, c, g, or t
  modified_base (523)..(523): a, c, t, g, unknown or other
  misc_feature (523)..(523): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctgganatgcattgaacaaaaaattgcttatggtacagcagaagtcaggccacggaccccaaattgtacatctatgaaagacgaacaaaccgacccctcgggactcccgtagagagtattctccgtcggctccgagctaacgagggtctagtcggccctaccttgactatcgaggtcgggacccaaggtggaggatagaagctagactactactgttacacgaatagaanaacagtgtaattagtttcggtgggttgttacgggcgggacggaacctaaacgttcgaccgttaccgtacggtcncggcccaacggcctccgccccgtcggtccttaccttccgttccgttaaccccc

SEQ ID NO: 319378 - DNA, 621 bp, Homo sapiens
  misc_feature: GZ8MTXP01BL33D.4.71.G05.1.454.CMB.2.raw
  modified_base (240)..(240): a, c, t, g, unknown or other
  misc_feature (240)..(240): n is a, c, g, or t
tcagagcactgtagcacgaccggtgctcgatttagtgtcgtcgcaagagagagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaatntgcttattggtaccagcagaagtcaggccaggaccccaaaattggtcatctatgaagacgaacaaacgaccctcgggaatcccgtgagagacttctccgtggctccgagcctacgaacggggtaactacgtcgggacccacccgtttgaactatccgaaggttcggggaccccaagggtgggaggattaggaaagctaggaacttactacttacgtttaactactaaattagaacgtaaacgagttagaattaaagtttcgtggggttaggtttcgggacgggaagggtaacccgaaacgttcggtacccggttacgtacgggtcaccggcccgaaagggcctacggtcccccgtggtaccaccgttccttcgttcccccc

SEQ ID NO: 319379 - DNA, 652 bp, Homo sapiens
  misc_feature: GZ8MTXP01BDOHZ.4.71.G05.1.454.CMB.2.raw
  modified_base (245)..(245): a, c, t, g, unknown or other
  misc_feature (245)..(245): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctggagatgcattagaaccaaaaaaatntgacttattgtaccagcagaagtcaggaccacggaccccaaaagttggtacatctaatagaagacgaacaaaccgaccccgtccgggaactcccctaggagagtacttctcctcggctccagcctacgagggctagtcgggacccaccgttgactatcgaggtcggggacccaagggtgggaagagtaggaagtctagaacttactacttagtactaacaataagacgtaagtagtagtaattagtttcgttggggtcggtttacggggaccggggtaacgggaaacctaaacgttcgggtaaaccccgttccggtaaacgggtccaaccgggccccgttaaacggggtccctacccggtccccccgttacggtcccttaccgtttcccgttcccgtttcccccccg

SEQ ID NO: 319380 - DNA, 585 bp, Homo sapiens
  misc_feature: GZ8MTXP01DVP67.4.71.G05.1.454.CMB.2.raw
  modified_base (369)..(369): a, c, t, g, unknown or other
  misc_feature (369)..(369): n is a, c, g, or t
  modified_base (382)..(382): a, c, t, g, unknown or other
  misc_feature (382)..(382): n is a, c, g, or t
  modified_base (487)..(487): a, c, t, g, unknown or other
  misc_feature (487)..(487): n is a, c, g, or t
tcagagcactgtagcacgaccggtgctcgatttagtgtcgtcgcaagagagagggggaagaccgatgggcccttggtggaggcttggtgaagccgggggggtcccttagactctcctgtgcagtctctggactcaacctcaaaaatgcctggatgacctgggtccgccagactccagggaagggctgcagtgggttggccgtattataaccaaacctgatggtgagacaacagactacgctgcaccgtgaaaggcagattcaccatctcaagagatgattcaacgaacacgtctagtttttaggaaatgaaacagcctagaaaaccgagacacagtccgtttatttctgttccactactcctcgcctanagagtatttacgngtaactataaactcgaccatagtgggacgtcgtggggaccaagggccaacagtccaccgtctcctcaacctccacgaacggccatccggtcctccccgtggcccncctgcctccgacggacgccacccgtcgagcgccacgcgccggccccgttggggcctcggcccgtggtaccgaacggttacctaaccgttcccgtaacg

SEQ ID NO: 319381 - DNA, 668 bp, Homo sapiens
  misc_feature: GZ8MTXP01AFOU9.4.71.G05.1.454.CMB.2.raw
  modified_base (247)..(247): a, c, t, g, unknown or other
  misc_feature (247)..(247): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggatcacctgctctggagatgctattagaaccaaaaaaatntgtacttagtcggtaccagtcaagaagtcgaacggccaacggaccccctaaaagttcggtacaattacctaagtagaaacgaccgaaccaaaccggtaccccgtaccgggactccccgtagacgagtattcgtctcggctcgacgctacgagggtaactagtcggaccctacgttgactagtacgagggtcgggaccaagggtcggaggtataggaatcgtacgacttactacgtacgtttaacaacgtaaagttaaggaagtaaaccgtagtagtaattaaacgtttcggtaggggttcggtaccgggtaacgggtaacggggtaaaccaaacggttcgtaacccgttcgtaacggtcaccggacccgaacggtcccgtccgtaacccccgtggtccttaccgtccttccgttaaccccc

SEQ ID NO: 319382 - DNA, 608 bp, Homo sapiens
  misc_feature: GZ8MTXP01DO80X.4.71.G05.1.454.CMB.2.raw
  modified_base (376)..(376): a, c, t, g, unknown or other
  misc_feature (376)..(376): n is a, c, g, or t
  modified_base (508)..(508): a, c, t, g, unknown or other
  misc_feature (508)..(508): n is a, c, g, or t
  modified_base (536)..(536): a, c, t, g, unknown or other
  misc_feature (536)..(536): n is a, c, g, or t
tcagagcactgtagcacgaccggtgctcgatttagtgtcgtcgcaagagagagggggaagaccgatgggcccttggtggaggcttggtgaaggccgggggggtcccttagactctcctgtgcagtctctggactcaacctcaaaaatgcctggatgacctgggtccgccagactccagggaagggctgcagtgggttggccgtattataaccaaacctgatggtgagacaaacagactacgctgcaccgtgaaaggcagattcaccatctcaaagagatgattacaaacgaacaacgtcttagtttttaggaaatgaaacagcctagaaaaccgagacacagtccgttttatctgttccacactccctgccctaanagagtactttcgagtaactataaactcgacctatagtcgggactcgtgggaccaagggaccacgtagtcaaccgtcctaccaccaaaccctccaaccaaacgggccctaacgtcccggttcccttcccccgnggccccgtcctcgaccctccgagggacnccaccgcgagcgacacgacgccggcccgttgggcctgcccgtggtacaacgggttcctaaccgttccctaag

SEQ ID NO: 319383 - DNA, 597 bp, Homo sapiens
  misc_feature: GZ8MTXP01AL3PQ.4.71.G05.1.454.CMB.2.raw
  modified_base (225)..(225): a, c, t, g, unknown or other
  misc_feature (225)..(225): n is a, c, g, or t
  modified_base (246)..(246): a, c, t, g, unknown or other
  misc_feature (246)..(246): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctgganatgcattgaaccaaaaaaatntgcttattggtaccagcagaagtcaggccacggaccccaaaattggtacatctatgaagacgaacaaaccgccctccgggactccctgagagtacttctcctggctccgagctacgagggaactagtcggccctacttgactatcgaggtcgggacccaaggtggaggatagaagctagacttactactagttactacgaatagaagaacagtgtaattaagtttcgtggggttgttacgggacgggtaacgggaacctaaacgttcggacccgttaccgtaacgggtccacgcccgaacgggtcctccggtcccccgtacggtcccttaccgtccgttcccgttcccccg

SEQ ID NO: 319384 - DNA, 575 bp, Homo sapiens
  misc_feature: GZ8MTXP01AFC8Z.4.71.G05.1.454.CMB.2.raw
  modified_base (245)..(245): a, c, t, g, unknown or other
  misc_feature (245)..(245): n is a, c, g, or t
  modified_base (333)..(333): a, c, t, g, unknown or other
  misc_feature (333)..(333): n is a, c, g, or t
  modified_base (448)..(448): a, c, t, g, unknown or other
  misc_feature (448)..(448): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctggagatgcattgaaccaaaaaatntgacttattggtaccagcagaagtcaggccaggaccccaaattggacatctatgaagacaacaaaccgcccgtacgggactccctganagattctcctggctccagctacgagggctagtcggccctacttgactagtcaggtcggggacccaaggtcgggaaggatagaagtctagacttacgtattcgttacacaataganaacgtagtgtaataagtttcggtgggtgtacgggacggagggaacccaaacgttcgaacccgttcgtagggtacacgttccgaaggtccaccgtccccgtacgggtccacctccgttcccgtccccg

SEQ ID NO: 319385 - DNA, 558 bp, Homo sapiens
  misc_feature: GZ8MTXP01EI3QE.4.71.G05.1.454.CMB.2.raw
  modified_base (240)..(240): a, c, t, g, unknown or other
  misc_feature (240)..(240): n is a, c, g, or t
  modified_base (439)..(439): a, c, t, g, unknown or other
  misc_feature (439)..(439): n is a, c, g, or t
tcagagcactgtagcacgaccggtgctcgatttagtgtcgtcgcaagagagagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaatntgcttattggtaccagcagaagtcaggccaggaccccaaaattggtacatctatagaagacgaacaaaccgccctacgggatccctgagagattctcctggctccagcctacagggtctatcgggaccctactttgactagtcgagtgggacccaaggtggaggataggaagtctgactactactgttactcaataganaacagtgattattcgtggtggttacggcgggaggaacctaaacgttgaccgttcgtacggtcgacgttcccgaacgggctaccggccccctacgggtccacttccgttcgtttcccccg

SEQ ID NO: 319386 - DNA, 623 bp, Homo sapiens
  misc_feature: GZ8MTXP01EADEZ.4.71.G05.1.454.CMB.2.raw
  modified_base (225)..(225): a, c, t, g, unknown or other
  misc_feature (225)..(225): n is a, c, g, or t
  modified_base (244)..(244): a, c, t, g, unknown or other
  misc_feature (244)..(244): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctgganatgcattgaacaaaaaatntgcttatggtaccagcagaagtcaggccaggaccccaaagttggtacatctatagaacgacgaacaaaccgacccgtaccgggactcccgtagagagacttctccgcggtctcagtcctaacgagggtaactagtccgggaccctaccgttacgactagtccgaacgggttcggggaccctaagggtggaaggaagtagaaacgtcgtacgtaacttacgtacttagttaacctagaaagttaaggaaataacgtagttagaatttaagtttcggtgggttcgttacgggacgggaacgggtaacctaaacgttcggacccgttcgaacggtcgaacgccgacgctcccgcccctggtcaccgttccgttccgttcccc

SEQ ID NO: 319387 - DNA, 667 bp, Homo sapiens
  misc_feature: GZ8MTXP01BXUBS.4.71.G05.1.454.CMB.2.raw
  modified_base (224)..(224): a, c, t, g, unknown or other
  misc_feature (224)..(224): n is a, c, g, or t
  modified_base (244)..(244): a, c, t, g, unknown or other
  misc_feature (244)..(244): n is a, c, g, or t
  modified_base (472)..(472): a, c, t, g, unknown or other
  misc_feature (472)..(472): n is a, c, g, or t
tcagagcactgtagcacgaccggtgctcgatttagtgtcgtcgcaagagagagggggtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctgganatgcattgaaccaaaaaatntagcttatggtaccagcagaagtcagaccaggaccccaaaagttgtcatctatagaagacgaacaaacgccctacgggatacccgtgagagtattctcctggctcgagctaacgagggtctagtcggaccctacctttgactagtcgaggttcggggaccctaagggtcgggaaggtagtaggaacgtctagacttactacgttagttaactacgtaaataaggtaanaacgtaagtgtaaagttaagttttcggtaggggttcggttacggggacgggtaacgggggtaaaccctaaacggttaccgggtaacccggttaccggtaaacggggtccaaccggttccccggaaacgggtccccgtcccggtaaccccccgttccgggtacccttacccgttcccggttcccgtttcccccccg

SEQ ID NO: 319388 - DNA, 762 bp, Homo sapiens
  misc_feature: GZ8MTXP01ENOMX.4.71.G05.1.454.CMB.2.raw
  modified_base (278)..(278): a, c, t, g, unknown or other
  misc_feature (278)..(278): n is a, c, g, or t
  modified_base (299)..(299): a, c, t, g, unknown or other
  misc_feature (299)..(299): n is a, c, g, or t
tcagagcactgtagcacgaccggtgctcgatttagtgtcgtcgcaagagagagggggaagaccgatgggcccttggtggaggcttggtgaaggccgggggggtcccttagactctcctgtgcagtctctggactcaacctacaaaaatgcctggatgacctgggtccgccagactccgagggaaggggctgcaggtgggttggccgtattataaccaaactgatggtgagacaacagactacgctgcaccgtgaaaggcagattcaccatctacaagngatgattacaacgaacacgtnttgttttaggaaatgaaacagacctaaggaaaacccgaggaccaacgtagtacccgtttttaatttccgtacgttaccactacctccctgaccctacgagtagtacgtttacgacgtaacttaagtaaactcgacctaatacgtcgggtacgttcggtacggggaccaacggggaccaacgtacggttaccctaacccgttcccttaccaccaaaccccttcccaaaccggaaacccggggtccccctacgttttcccccggggttcccctttccccccccgggcggtccccgtcccgttaccggacccgtacccggaaccgggtacccaccccgtaaccccgtccggaacgttccgacccgacccggccgggtccccgggcccgggttcggcccgttaaccgggtcccggttaacggtaacccgtaaccgggttacccctttaacccgttaaccccgtaacg

SEQ ID NO: 319389 - DNA, 689 bp, Homo sapiens
  misc_feature: GZ8MTXP01CW5Y1.4.71.G05.1.454.CMB.2.raw
  modified_base (243)..(243): a, c, t, g, unknown or other
  misc_feature (243)..(243): n is a, c, g, or t
tcagagcactgtagcacgaccggtgctcgatttagtgtcgtcgcaagagagagggggtgggctcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggatcacctgctctggagatgcattgaaccaaaaaatntgacttatggtaccagcagagtcaggccaggaccccaaattggacatctatagaagaccgaacaaaccgaccccgtaccgggactccccgtagacgagtatttctccgtcggcctcgagcctaacgagggctagtcggaccctacgttgactatcgtaggtcggggacccaagggtacgggaggtagtaggaacgtctacggtaaccttacttaacgttacgtttaacctacgtaaacgttaaggaagtaaacgaaggttagtaaagtttaacgttttacggtggggttacggttaccggggacggggtaacgggtaacccgtaaacggttcggtaaccccggttacgttaaacgggccgttacccgggcccgttaaccgggtcccgtaccccggtcccccgttcggggtcccttacccgtttcccgttcccggtttaaccccccc

SEQ ID NO: 319390 - DNA, 732 bp, Homo sapiens
  misc_feature: GZ8MTXP01BUEKL.4.71.G05.1.454.CMB.2.raw
  modified_base (211)..(211): a, c, t, g, unknown or other
  misc_feature (211)..(211): n is a, c, g, or t
  modified_base (386)..(386): a, c, t, g, unknown or other
  misc_feature (386)..(386): n is a, c, g, or t
tcagagcactgtagcacgaccggtgctcgatttagtgtcgtcgcaagagagagggggaagaccgatgggcccttggtggaggcttggtgaaggccgggggggtcccttagactctcctgtgcagtctctggactcaacctacaaaaatgcctggatgacctgggtccgccagactccgaggggaagggctgcagtgggttggccgtattanaaccaaactgatggtgagacaacagactacgctgcaccgtgaaaggcagatcaccatctacaagagatgaacttacaaacgaacacgtcttagttttaggaaatgaaacagacctaaggaaaaccgaggaacactagtcccgttttattctcgttaccactactccctgacctanagatatttcgagaactataatcgactatagtgggactcgtacggggaccaaacggggcctaacgagtacccgtaaccgtcctccctaccaaacccctacccgaacccgtaacgggacccctaacgttcccgggttaccccttccccccgtgggcccccgtccccgttcggcccgttacccgaacggggaccctacccgaacccgtcccggaacggaccggacccaaaccggttaccgggcccggggttcccccggttgggggcccctttcgggcccccgggtttaagggttaacccggaaaaccggggtttaccccgtttaaccccgtttttccccgtaaaccggg

SEQ ID NO: 319391 - DNA, 547 bp, Homo sapiens
  misc_feature: GZ8MTXP01EBE0E.4.71.G05.1.454.CMB.2.raw
  modified_base (241)..(241): a, c, t, g, unknown or other
  misc_feature (241)..(241): n is a, c, g, or t
  modified_base (429)..(429): a, c, t, g, unknown or other
  misc_feature (429)..(429): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctggagatgcattgacaaaaaatntgcttatggtaccagcagaagtcaggccaggaccccaaaattggtacatctaatgaagacgaacaaacgaccctccgggaatccctagagagattctcctggctccagctacgagggctagtcggccctacttgacctatcaggtgggaccaagtggagatagaagctagactactactagttaccanaaatagaagaacagtgaattaattcgtgggtgttcgggcggtaagggaaccaaagttcggaccgttcgtacggtcaacgcccaaggtcctcgccccttcggcttacgtcttcgttccc

SEQ ID NO: 319392 - DNA, 577 bp, Homo sapiens
  misc_feature: GZ8MTXP01AU4QP.4.71.G05.1.454.CMB.2.raw
  modified_base (245)..(245): a, c, t, g, unknown or other
  misc_feature (245)..(245): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctggagatgcattgaaccaaaaaatntgcttattggtaccagcagaagtcaggccacggaccccaaaattggtacatctatagaagacgaacaaaccgaccccgtaccgggactcccgtagagagtacttctccgtcggctccgagctacgagggctagtcggacctacctgactatcgaggtcgggaccaaggtggaggatagaagctagacttactactgttacacgaaagtagaagaactagtataattagtttcgtgggtgttcggacgggaggaacctaaacgttcggaccgttcgtacggtcacggccgacggcctccgccccgttcgtccttacttccgttccgttccccc

SEQ ID NO: 319393 - DNA, 629 bp, Homo sapiens
  misc_feature: GZ8MTXP01DQD8N.4.71.G05.1.454.CMB.2.raw
  modified_base (247)..(247): a, c, t, g, unknown or other
  misc_feature (247)..(247): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctggagatgcattagaaccaaaaaaatntgcttattggtaccagcagaagtcaggaccaggacccctaaaagttcggtacaatctatagaaacgaaccgaacaaaccgaccccgtccgggaactccccgtagaagacgtattcctcgtcggctccagcctaacgagggtctagtcggaccctacgttgactagtcgaggtcgggaccaaggtggaggagtaggaagtctagaacttactattagttaccagtaaagtagaaagaacgagtagtaagttaagtttcgtggggtcgttacgggacgggtaacgggaacctaagttcggaccgttccgtaaacgggtcaacggttccgaacgggtcctaccgccccgttacggtccttaccgttccgttccggtttccccccg

SEQ ID NO: 319394 - DNA, 709 bp, Homo sapiens
  misc_feature: GZ8MTXP01DM9PW.4.71.G05.1.454.CMB.2.raw
  modified_base (223)..(223): a, c, t, g, unknown or other
  misc_feature (223)..(223): n is a, c, g, or t
  modified_base (244)..(244): a, c, t, g, unknown or other
  misc_feature (244)..(244): n is a, c, g, or t
  modified_base (492)..(492): a, c, t, g, unknown or other
  misc_feature (492)..(492): n is a, c, g, or t
  modified_base (545)..(545): a, c, t, g, unknown or other
  misc_feature (545)..(545): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagcccaccctggtgtcagtcgtccccaggacaaacggccaggatcactgctctgganatgcattagaacaaaaaaatntgtacttataggtaccagacaagaagtcacggaccacggacccctaaaagttcggtacaatctaataggaaacgaaccgaaccaaaacccggaccccgtccggggaactccccgtagaagtacgtaactttccgtaccgtcgggtcctacccgaagtcccttaacggaacggggtaacttaacgttccgggaccccttaacccgtttgaaccttacgtccgaacgggttacggggacccctaaagggngggtaaggagttagaacgctagaacttactattagtaacctagaataaggaanaataggtatattaagtttgtaggggttcgtacgggacgggaaacggtaaacccgtaaacgttcggtaaaccccgttacggtaacggtccgaaccggttcccaacggggtccctcccggtccccccgtttacggccttacccgttccgttccccggttccccccg

SEQ ID NO: 319395 - DNA, 673 bp, Homo sapiens
  misc_feature: GZ8MTXP01EVUCN.4.71.G05.1.454.CMB.2.raw
  modified_base (247)..(247): a, c, t, g, unknown or other
  misc_feature (247)..(247): n is a, c, g, or t
  modified_base (480)..(480): a, c, t, g, unknown or other
  misc_feature (480)..(480): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctggagatgcattagaaccaaaaaaatntgacttaattggtaccagacaagaagtcgaggccaacggacccctaaaagttggtacatctaatagaaagaccgaaacaaaccggtaccccgtacccggggaactaccccgtagaacgagtacttctccgtggtctccgagcctacgaagggtctagtcggaccctacgttgactatcgaggtcgggaccaaggtggaggataggaagtctagaacttactacttagtactanaagttagaagaacgtagtagtaagttaagtttcggtgggttcggttacgggacgggaacgggtaaaccctaaacgttccggtaacccgttaccgtaacgggtaaccccaaacccggttacggttcccgtaacccggtcccccgttaacggtaccctacccgttcccgttaacccgttttcccccgtaaccccc

SEQ ID NO: 319396 - DNA, 647 bp, Homo sapiens
  misc_feature: GZ8MTXP01BB32X.4.71.G05.1.454.CMB.2.raw
  modified_base (246)..(246): a, c, t, g, unknown or other
  misc_feature (246)..(246): n is a, c, g, or t
tcagagcactgtagcacgaccggtgctcgatttagtgtcgtcgcaagagagaggggggtgggctcaggaggcagagctctgggaatctcaccatggcctggacccctctcctgcctcccccctcctcactttctgcacagtctctgaggcctcctatgagctgacacagcccaccctcggtgtcagtcgtccccaggacaaacggccaggatcacctgctctggagatgcattgaaccaaaaaatntgcttatggtacagcagaagtcaggccaggaccccaaaattggacatctaatgaagacgaacaaaccgaccccgtaccgggactccctgagagattctcctggctccgagcctacgagggtctagtcggcctaccttagactatcgaggtcggggaccctaaggtagggaggagtagaagctacgtaactactacttgttaactacgaaagttagaacgaaacgtagtaggtaatttaaacggtttcggttaggggttcggtttacgggggacgggaaacggggtaaaccccgtaaacgttccggtaaaccccggttcgtaaacgggtccaccggttacccgaacgggtccccgtacgtccccccgtacggtccacccgttccgttaacccgttccccccc

SEQ ID NO: 319397 - DNA, 684 bp, Homo sapiens
  misc_feature: GZ8MTXP01EYCJD.4.71.G05.1.454.CMB.2.raw
tcagagcactgtagcacgaccggtgctcgatttagtgtcgtcgcaagagagagggggaagaccgatgggcccttggtggaggcttggtgaaggccgggggggtcccttagactctcctgtgcagtctctggactcaacctcaaaatgcctggatgacctgggtccgccagactccgagggaaggggctgcagtgggttggtcgtattataaccaaactgatggtgagacaacagactacgctgcaccgtgaaaggcagattcaccatctacaagagatgattacaacgaacacgtcttgttttaggaaatgaaacagacctagaaaaccgaggaacacgtagtacccgttttatttctgttcccaactacctccccttacgaccccttaagaacggtagttacgttttaccgagggtaaccttaaataaacgtcccgacctaattaagtcgggtaccgtcgtggggacccaaaggggacccacgagtaccaccgttctccctacaaccctccaaccgaccgggccctagttcccggtcctcccccgtggcccctcccgtggccctaccgacggaccgcccaacccgtcggaacgacgcccgaacgcgggcccgggttcccgttcggggacccttcggccgttaacgggtaccaaccggttacccttaaccgtttccccgtaacg

SEQ ID NO: 319398 - DNA, 678 bp, Homo sapiens
  misc_feature: GZ8MTXP01CTAU6.4.71.G05.1.454.CMB.2.raw
  modified_base (248)..(248): a, c, t, g, unknown or other
  misc_feature (248)..(248): n is a, c, g, or t
  modified_base (543)..(543): a, c, t, g, unknown or other
  misc_feature (543)..(543): n is a, c, g, or t
tcagagcactgtagcacgaccggtgctcgatttagtgtcgtcgcaagagagagggggtgggctcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggatcacctgctcgtggagatgctattagaacctaaaaaaatntgtacttagttaggtaccagcaagaagtcgaacggccaacgggaccccctaaaagttcggtacattctaagtagaaacgaaccgaacaaaacccggacccccgtaccgggggaactccccgtaggacgaagtactttcctccgtcgggcctaccgagtccctaacgaagggtaacttaacgtcgggtaccctaccgttagaacttagtccgagggtacggggacccaaagggtgggaaggagtagaacggtctacgtaccttaactacgttagttaacctataaataacggtaanaaacgtaggtataagtttaagtttccggtgggttcgtacgggacgggtaacgggaacctaaacgttcggtacccgttcgtacggcacggttccacggtctaccgcccctaggtccttaccgtcttccgtaacccc

SEQ ID NO: 319399 - DNA, 570 bp, Homo sapiens
  misc_feature: GZ8MTXP01DJVYX.4.71.G05.1.454.CMB.2.raw
  modified_base (243)..(243): a, c, t, g, unknown or other
  misc_feature (243)..(243): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctggagatgcattgaccaaaaaaatntgcttattggtaccagcagaagtcaggccaggcccccaaaattggtcatctatgaaagacgaacaaacgaccctcgggatccctgagagattctctggctccagctacgagggctagtcgggacctaccttgaactatcaggtcggggacccaaaggtcggaggataggaaagctgactactactgttaactcgaaatagaagaaacagtagattaaatttcgtggggttgttcgggacggaaggggaaccctaaagttcggtaacccgttccgtaaggtcacgcccgaaggtctcgccccctgggtccactcgttccgttcccccg

SEQ ID NO: 319400 - DNA, 573 bp, Homo sapiens
  misc_feature: GZ8MTXP01AOSJS.4.71.G05.1.454.CMB.2.raw
  modified_base (460)..(460): a, c, t, g, unknown or other
  misc_feature (460)..(460): n is a, c, g, or t
  modified_base (490)..(490): a, c, t, g, unknown or other
  misc_feature (490)..(490): n is a, c, g, or t
  modified_base (507)..(507): a, c, t, g, unknown or other
  misc_feature (507)..(507): n is a, c, g, or t
  modified_base (510)..(510): a, c, t, g, unknown or other
  misc_feature (510)..(510): n is a, c, g, or t
  modified_base (535)..(535): a, c, t, g, unknown or other
  misc_feature (535)..(535): n is a, c, g, or t
tcagagcactgtagcacgaccggtgctcgatttagtgtcgtcgcaagagagagggggaagaccgatgggcccttggtggaggcttggtgaagccgggggggtcccttagactctcctgtgcagtctctggactcaacctcaaaaatgcctggatgacctgggtccgccagactccagggaagggctgcagtgggttggccgtattataaccaaacctgatggtgagacaacagactacgctgcacccgtgaaaggcagattcaccatctcaagagatgattacaaacgaacacgtcttgtttttaggaaattgaaacagacctagaaaaccgaggacacagtcctttattctgttccacaccttcctcgcctacagatatttcgtaggaactataaatcgacctatagtggtacgtcgtggggaccaagggaccaacagtccaccgtctccctcaacccnccaccgaaggcccagtccggtcctccccgngccgcctgcctcaggcnccncctccgagcgcacgagccggcccgngggctgcctggtcaaggttcctaaccgttcccgtaacg

SEQ ID NO: 319401 - DNA, 613 bp, Homo sapiens
  misc_feature: GZ8MTXP01CGNID.4.71.G05.1.454.CMB.2.raw
  modified_base (224)..(224): a, c, t, g, unknown or other
  misc_feature (224)..(224): n is a, c, g, or t
  modified_base (244)..(244): a, c, t, g, unknown or other
  misc_feature (244)..(244): n is a, c, g, or t
tcagagcactgtagcacgaccggtgctcgatttagtgtcgtcgcaagagagagggggtgggctcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggatcacctgctcgtgganatgcattgaaccaaaaaatntgacttattggtacagcagaatcgaggaccacggaccccaaaagttggtacatctatagaacgacgaacaaaccggaccctccgggaactccctagacgagattctccgtggctccgagctacgacgggctagtcggaccctactgactagtcaggtcgggaccaaggtcgggagagtagaagctagacttactactagttactacgaataaggtagaaacgtagtaacgtatttaagtttcgtgggttgttacggggacggaacgggaaccctaaagttcggaacccgttcgtaacggtccgacggcccgaacgggtccctcccggcccccgttcgggtccttaccgttccttccggtttaacccccc

SEQ ID NO: 319402 - DNA, 643 bp, Homo sapiens
  misc_feature: GZ8MTXP01BNZOG.4.71.G05.1.454.CMB.2.raw
  modified_base (244)..(244): a, c, t, g, unknown or other
  misc_feature (244)..(244): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctggagatgcattgaacaaaaaatntgacttatggtaccagcagaagtcaggccacggacccctaaaagttcggacatctatagaacgaacgaacaaaccgaccctaccgggactcccgtagacgagattctccgtggctccgagctaacgagggctagtcggccctaccttgactatcgaggtcgggacctaaggtgggaaggagtaggaacgtctacgacttacttacgttagttaacctactaaagttagaagtaactaggtagtaagtttaagtttcggtgggttcggttacgggacgggtaacgggaaaccctaaacgttcggtaacccgttacgtaacggtccgaacggttcccgaacgggtccctacccggtcccccgttcgggtacccttaccgttcccgttcccggttccccccg

SEQ ID NO: 319403 - DNA, 623 bp, Homo sapiens
  misc_feature: GZ8MTXP01CZ88G.4.71.G05.1.454.CMB.2.raw
  modified_base (372)..(372): a, c, t, g, unknown or other
  misc_feature (372)..(372): n is a, c, g, or t
  modified_base (386)..(386): a, c, t, g, unknown or other
  misc_feature (386)..(386): n is a, c, g, or t
tcagagcactgtagcacgaccggtgctcgatttagtgtcgtcgcaagagagagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaatatgcttatggtaccagcagaagtcaggccaggccccaaaatggtcatctatgaagacgaacaaacgacccctaccgggactcctgagagattctcctggctccagctacgagggctagtcgcctactgactancagtcgggaccagnggaggatagaagctggaactacgtacttagttaacgtacaaatagaaagaactaagtgtaagtttaaacgttttcgtagggggtttgttaccggggacgggtaaacggggtaaccctaaaacggttcggtaaaccccggttaccggttaaggttcccgaaacggttccccggaaacgggtccctaccggcccccgttccggtacccgttccttaacccgttccgtttaacccccccg

SEQ ID NO: 319404 - DNA, 596 bp, Homo sapiens
  misc_feature: GZ8MTXP01DPY1N.4.71.G05.1.454.CMB.2.raw
  modified_base (245)..(245): a, c, t, g, unknown or other
  misc_feature (245)..(245): n is a, c, g, or t
  modified_base (361)..(361): a, c, t, g, unknown or other
  misc_feature (361)..(361): n is a, c, g, or t
  modified_base (430)..(430): a, c, t, g, unknown or other
  misc_feature (430)..(430): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctggagatgcattgaccaaaaaaatntgcttatggtaccagcagaagtcaggccaggaccccaaaattggcatctatgacggacgaacaaacgccctccgggatcccgtgagagattctcgtggctcagctacgagggctancggacctactgactatcgaggtcgggaccctaaggtggaggatagaagctgactactactagttactanaatagaagaacgagtgtaatttaagtttcgtaggggttcgttacgggacgggtacgggaacctaaacgttcggtacccggttaccgtaaggtcgaccggcccgaaacggtcccgtaccggtcccccggttcgggtcccttaccttccgttcccggtttaacccccc

SEQ ID NO: 319405 - DNA, 663 bp, Homo sapiens
  misc_feature: GZ8MTXP01BFFPV.4.71.G05.1.454.CMB.2.raw
  modified_base (224)..(224): a, c, t, g, unknown or other
  misc_feature (224)..(224): n is a, c, g, or t
  modified_base (245)..(245): a, c, t, g, unknown or other
  misc_feature (245)..(245): n is a, c, g, or t
tcagagcactgtagcacgaccggtgctcgatttagtgtcgtcgcaagagagagggggtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctgganatgcattgaacctaaaaaatntgcttatggtaccagcagaagtcaggaccacggaccccaaattggcatctagtgaagacgaacaaaccgaccccgtcgggactccctgagagacttctcctggactccgagctaacgacgggctagtccggcctaccgttgaactagtacgaggtcggggacccctaagggtggaaggataggaagtcgtacgtaacttactacgtacgttaacctagtaaagtaacggaagtaaactaggtaagtatttaaagtttcgggtagggttacgggttaccgggacggggtaaacggggaaaccctaaacggttcggaccccgttacgttaccggggtacaacgggccccgaaccggtcccgtccccggttcccccgtacgggtaccccttaccgtttccccgttcccgtttccccccccg

SEQ ID NO: 319406 - DNA, 795 bp, Homo sapiens
  misc_feature: GZ8MTXP01A30TC.4.71.G05.1.454.CMB.2.raw
  modified_base (242)..(242): a, c, t, g, unknown or other
  misc_feature (242)..(242): n is a, c, g, or t
tcagagcactgtagcacgaccggtgctcgatttagtgtcgtcgcaagagagagggggtgggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctggagatgcattgaccaaaaaaatntgtacttagttcggtacagacaagaagtcgacggaccaacggaacccctaaaagttcggtactatactaagtagaaacgaaccgaaaccgaaacccgtaccccgtaccgggactcccgtagaacgtacgtactttcgtccgtcggtcctaccgacgtccgtaacggaacgggtaacttacgtaccgggaccctaccgtttagaaccttaacgtacgtacgggtccggggaacccgtaaagggtacgggaaggtagtaacggaaacgtacgtacgtaaccttaacttaacgttacgttaacctacgtaaagttaacggtaaacgtaaacgtaagttacgttaagtttaacggttttacggttagggggtttacggttaccggggtaccggggtaaacgggtaaacccgtaaaccggttaccggtaaccccggttaccggtaaaccgggtacccgaacccggttaccccggttaaccgggtccccgttccccgggtaaccccccggttaccgggtaccccgttacccgtttccccggtttccccggttccccccg

SEQ ID NO: 319407 - DNA, 777 bp, Homo sapiens
  misc_feature: GZ8MTXP01CHFWI.4.71.G05.1.454.CMB.2.raw
  modified_base (249)..(249): a, c, t, g, unknown or other
  misc_feature (249)..(249): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctggagatgctattagaacctaaaaaaatntgtacttattaggtaccagcagaagtcgacggaccaaggaccccctaaaagttcggtactaatcctaatagaaacgaaccgaaacgaaaacccgaccccgtacccgggggaactcccgtaggaagacgtactttcgtacccgttcgggccttaccgagtccgttaaccggaacgggggtaaccttaaacggtccggggtacccctaccgtttacgggaacctttagtcccggtaacgggttcggggggacccctaaaggggttcggggaaagggtagttaaggaaacggtcgttacggtaacttaccgtaacgttacgtttaacctacgtaaagttaaggaacgtaaacgtaaggttagttaagtttaaacgttttcggtagggggttcggttacggggacgggtaacgggtaaaccgtaaacgttacggtaaacccggttcgttaaccggtacgttaccggcccgttaacgggtcctcccggtcccccgttacgggttccttaccgttccgttcccggttccccccg

SEQ ID NO: 319408 - DNA, 698 bp, Homo sapiens
  misc_feature: GZ8MTXP01B44XO.4.71.G05.1.454.CMB.2.raw
  modified_base (257)..(257): a, c, t, g, unknown or other
  misc_feature (257)..(257): n is a, c, g, or t
  modified_base (331)..(331): a, c, t, g, unknown or other
  misc_feature (331)..(331): n is a, c, g, or t
  modified_base (338)..(338): a, c, t, g, unknown or other
  misc_feature (338)..(338): n is a, c, g, or t
  modified_base (565)..(565): a, c, t, g, unknown or other
  misc_feature (565)..(565): n is a, c, g, or t
tcagagcactgtagcacgaccggtgctcgatttagtgtcgtcgcaagagagagggggaagaccgatgggcccttggtggaggcttggtgaaggccgggggggtcccttagactctcctgtgcagtctctggactcaacctacaaaaatgcctggatgacctgggtccgccagactccgagggaagggctgcagtgggttggcgtattataaccaactgatggtgagacaacagactacgctgcaccgtgaaagcagnttcaccatctacaagagatgattacaaacgaacacgtcttggtttttaggaaatgaaacagacctagaaaccgnggaacanagttccgttttatttctgttaccactacctccctgacctaacgagtagtattttacggagtaacttataaactccgactattagtggacgtcgtggggaccgaagggaccacgtagtacccgtacccggttacctacccgtacctaaaccccgtacccgaaccccgtaacggggcccctaacgttcccgggttcccccttccccccgtccggggccctccccggtcncccgttccgaacgggacgccccgtacccgccggacgacggacccacgtacggccccgggttccccgttgggggttcccttcggcccgttaacgggtaccgtaacggttacccttaacccgtttcccctaacgg

SEQ ID NO: 319409 - DNA, 798 bp, Homo sapiens
  misc_feature: GZ8MTXP01AX46C.4.71.G05.1.454.CMB.2.raw
  modified_base (245)..(245): a, c, t, g, unknown or other
  misc_feature (245)..(245): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggatcacctgctctggagatgcattagaaccaaaaaatntgcttatggtaccagcagaagtcaggccaacggacccctaaaagttcggacatctaataggaaagacgaacaaacgaccccgtaccgggaactcccgtagagagtacttctaccgtcggtctccgagcctaacgacgggtaactaggtcgggtaccctaccgtttacgacttacgtaccgaggggttaccgggggacccgtaaaaggggttcggggaaggtaacgttaaggggaaacgtccgttaccgggtaaaccttaaccgttaaccgttaggttttaaacccctaacggtaaaaacggtttaacggaaaagtaaaaccgggttaagttaacggttaaacgtttaaaaggtttttccggttagggggttaccggggttttaccggggaaccgggggttaacgggggaaaacccctaaaacgggtttccgggtaaaccccggttacccgttaaacggggtccgaacccggaaccccggaaagggtccccgtaccccggtccccccggttacgggtcccttacccgttccccgttcccgggtttccccccccc

SEQ ID NO: 319410 - DNA, 645 bp, Homo sapiens
  misc_feature: GZ8MTXP01AZY1D.4.71.G05.1.454.CMB.2.raw
  modified_base (276)..(276): a, c, t, g, unknown or other
  misc_feature (276)..(276): n is a, c, g, or t
tcagagcactgtagcacgaccggtgctcgatttagtgtcgtcgcaagagagagggggaagaccgatgggcccttggtggaggcttggtgaagccgggggggtcccttagactctcctgtgcagtctctggactcaacctcaaaaatgcctggatgacctgggtccgccagactccgagggaaggggctgcagtgggttggccgtattataaccaaacctgatggtgagacaacagactacgctgcaccgtgaaaggcagattcaccatctcaaganatgattcaacgaacacgcttagttttaggaaatgaaacagacctagaaaaccgaggacactagtcccgttttatttctcgttccactactcccctagtacctacagtagtattttacgacggtaactaataaactccgacctaagtagtcgggacgttcgtggggacccaaaggggaccacgagtacccacccgttctaccctaccgaaccctccaacccgtaaccgggccccaacgttccggggtccccttcccccgtggccctcccgttcgaccctccggacggacgcccacccgtccgagcgccacgacggcccggccccgttggggcctaagcccgtggacacggaccttaaccttcccgtaacg

SEQ ID NO: 319411 - DNA, 536 bp, Homo sapiens
  misc_feature: GZ8MTXP01A6H1B.4.71.G05.1.454.CMB.2.raw
  modified_base (240)..(240): a, c, t, g, unknown or other
  misc_feature (240)..(240): n is a, c, g, or t
  modified_base (462)..(462): a, c, t, g, unknown or other
  misc_feature (462)..(462): n is a, c, g, or t
tcagagcactgtagcacgaccggtgctcgatttagtgtcgtcgcaagagagagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaatntgcttattggtaccagcagaagtcaggccaggaccccaaaattggtcatctatgaagacgaacaaaccgaccctccgggatccctgagagattctctggctcagctacagggctatggccacttgactatcaggtcggggccaaggtggaggatgaagctagactatactgtttacacgtaatagagaacagtgataaatttcgtgggtggttcggacgggngggaaccaaacggttgacccgttcgtaggcacgccgaacggctccgccccgtcgtccacgtcttcgtaaccccc

SEQ ID NO: 319412 - DNA, 812 bp, Homo sapiens
  misc_feature: GZ8MTXP01D67L2.4.71.G05.1.454.CMB.2.raw
  modified_base (225)..(225): a, c, t, g, unknown or other
  misc_feature (225)..(225): n is a, c, g, or t
  modified_base (251)..(251): a, c, t, g, unknown or other
  misc_feature (251)..(251): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctgganatgactaattagaaaccaaaaaaatntgtacttagttacggtaccagacaagaagtcgacggaccaacggacccctaaaagttgtacatactaagtagaaacgacgaaaccaaaccgtaccccgtacgggactcccgtagacgtagtacgttcctaccgtcgggtacctccgaacgtccgttaaccggaaacggggtaaccttaacgtacccggggtacccctaaaccgtttcggaaacccgttagttacccggtaaacggggttaccggggggaaccccgtaaagggggttacggggaagggtaacgttaagggaaaccggttacgtaaccgggtaaaccttaaacccgttaagtttaacggtttaaccttaaccggtaaaagtttaacggaaaagtaaaccgtaagttaacgttaaacgttttaaagttttaccgggttggggttacggttaccgggggacgggtaaacggggtaaaccctaaacggttccggtaacccgttacggtaacggtaccgacggttacccgaacgggtccctacccggtccccgtcgggtccttaccgttccgttcccgttccccccg

SEQ ID NO: 319413 - DNA, 689 bp, Homo sapiens
  misc_feature: GZ8MTXP01AZNKO.4.71.G05.1.454.CMB.2.raw
  modified_base (330)..(330): a, c, t, g, unknown or other
  misc_feature (330)..(330): n is a, c, g, or t
  modified_base (375)..(375): a, c, t, g, unknown or other
  misc_feature (375)..(375): n is a, c, g, or t
  modified_base (388)..(388): a, c, t, g, unknown or other
  misc_feature (388)..(388): n is a, c, g, or t
tcagagcactgtagcacgaccggtgctcgatttagtgtcgtcgcaagagagagggggaagaccgatgggcccttggtggaggcttggtgaaggccgggggggtcccttagactctcctgtgcagtctctggactcaacctcaaaaatgcctggatgacctgggtccgccagactccagggaaggggctgcagtgggttgccgtattataaccaaactgatggtgagacaacagactacgctgcacccgtgaaaggcagattcaccatctacaagagatgattacaacgacacgtcttgttttaggaaattgaaacagcctagaaaaccgnggaacacgagtccgtttatttcctgttccactactccctgcctanagtatactttcgngaactataactcgacctatacgtgggaccgttcgacgggggacccaaacggggtaccaacgaacggtcccaacccgttctacccctaccaaacccctacccgaacccgaaacgggcccctaacggttcccgggttccccttaccccccggtggccccgccccttacgcccgtcccgacgggacctccaccccgttaacccggagaaccggccaaccgacggttccccgggccccgttcggggcccttcgggccccttggggtacccaaacgggttacccttaacccggtttcccctaacgg

SEQ ID NO: 319414 - DNA, 892 bp, Homo sapiens
  misc_feature: GZ8MTXP01E1N8A.4.71.G05.1.454.CMB.2.raw
  modified_base (329)..(329): a, c, t, g, unknown or other
  misc_feature (329)..(329): n is a, c, g, or t
tcagagcactgtagcacgaccggtgctcgatttagtgtcgtcgcaagagagagggggaagaccgatgggcccttggtggaggcttggtgaagccgggggggtcccttagactctcctgtgcagtctctggactcaacctcaaaaatgcctggatgacctgggtccgccagactccagggaaggggctgcagtgggttggccgtattataaccaaacctgatggtgagacaacagactacgctgcacccgtgaaaggcagattcaccatctacaagagatgattcaaacgaacacgcttgttttagaaatgaaacagcctagaaaaccgnggaacacgtagtcccgtttttaatttcgtagttaccccactaaccttccccctacgacccttaaacaggtaacgttacgtttttaacccgggttagggaacctttaaactaaaacgttcccgggtacccctaaaagtttaggttacgggggaaacccggtttccggttacggggggaaccccgtaaaacggggggaccccaaaccgtaacggttaccccgtaaccccgggtttaccttacccccttaaccgaaaccccccttacccgaaaccccgtaaacccggggggacccccgttaacggttccccgggggtttaccccctttaccccccccggttcgggggcccccctccccccggtttacggccccgttacccgtaaaccggggtaccggaccccaaacccccggttccccgggaaacgggaaacgccccggaaaaccggacccggggccccggggttcccccggttcggggggccccgttccggggtccccgttaacgggggtttacccaaaacgggggttaccctttaacccccggttttaaccccctaaaccgggg

SEQ ID NO: 319415 - DNA, 730 bp, Homo sapiens
  misc_feature: GZ8MTXP01ACRS7.4.71.G05.1.454.CMB.2.raw
  modified_base (211)..(211): a, c, t, g, unknown or other
  misc_feature (211)..(211): n is a, c, g, or t
  modified_base (225)..(225): a, c, t, g, unknown or other
  misc_feature (225)..(225): n is a, c, g, or t
  modified_base (249)..(249): a, c, t, g, unknown or other
  misc_feature (249)..(249): n is a, c, g, or t
  modified_base (419)..(419): a, c, t, g, unknown or other
  misc_feature (419)..(419): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggancacctgctctgganatgctaattagaaccaaaaaaatntagtctttattcggtaccagcaagaagtcgacggccaacggacccctaaaagttcggtacatactaatagaaagacgaacaaaccgcccgtacgggactcccgtagacgtagtacttaccgcgttacggcttaccgaagtctaacggagggtaactagcggcctacgttnactatcgacggtcggggacctaaggtcgggaagtagaggaacgtcgtacggtacttaactacgttagttacctaacgtaagtaacgtaacgaaacttagttagtaagtttaacgttttcgggtaggggtttcgggtttacggggaccggggtaaacgggtaaacccctaaacgggttacccggtaacccggttaacccggttacgggttacccgaaccgggttaccccgttaaacgggtcccctacccggtccccccggtttaacggttcccgttaaccgtttccctttaaccccgggtttaacccccccg

SEQ ID NO: 319416 - DNA, 674 bp, Homo sapiens
  misc_feature: GZ8MTXP01BT0L1.4.71.G05.1.454.CMB.2.raw
  modified_base (255)..(255): a, c, t, g, unknown or other
  misc_feature (255)..(255): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctcgtggagatgactaattacgaaaccaaaaaaaattnttacgtactttagttggtaaccagacaagaaagtacacggaccaacggaccccctaaaagttggtacaatctaagtagaaacgaccgaaacaaaccgccccgtaccgggatccctagacgtacgtacttctccgtcggctccgagccgtaacgagggtctagtcggacctacttgactagtcgaggtcgggacctaaggtgggaagagtagaacgtcgtacgaacttactacgttagttaactactaaagttaagaagtaaacgtagttacgtaagtttaacgtttcggtggggttacgttcggggacggtaacgggaaacctaaacgttcggtaacccgttacggtacggtccgacgcccgaacggtcccgtccgaacccccgttcgggtaccttaccgttccgttccgttccccccg

SEQ ID NO: 319417 - DNA, 687 bp, Homo sapiens
  misc_feature: GZ8MTXP01CDEUE.4.71.G05.1.454.CMB.2.raw
  modified_base (250)..(250): a, c, t, g, unknown or other
  misc_feature (250)..(250): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacacgccaccctcggtgtcagtcgtccccaggacaaacggccaggatcacctgctctggagatgactattacgaaccaaaaaaatntgacttagttggtaaccagacagaagtcaggccacgacccctaaaattggacatctatagaacgacgaacaaaccgacccgtcgggactccctaggagatacttctcccgtcggactccgagcctaacgacgggaactagtcggaccctacgttcgactactacgaggtcgggaccgtaaggtagggaggtaagtaggaacgtcttacggaaccttaacgtacgttagttaaccttacgaaagttaggaacaacgtaggtagtaattaagttttccggtgggttcggttacgggggtcgggaacgggtaacccgtaaaacgttcgggtaacccgttaccggtaaggtcccgaaccgttcccgggttaagggccccgttccccggccccggtttccggtacccgttcccgtttaacccgttcccggtttaaccccccc

SEQ ID NO: 319418 - DNA, 643 bp, Homo sapiens
  misc_feature: GZ8MTXP01B4V5V.4.71.G05.1.454.CMB.2.raw
  modified_base (550)..(550): a, c, t, g, unknown or other
  misc_feature (550)..(550): n is a, c, g, or t
tcagagcactgtagcacgaccggtgctcgatttagtgtcgtcgcaagagagagggggaagaccgatgggcccttggtggaggcttggtgaaggccgggggggtcccttagactctcctgtgcagtctctggactcaacctcaaaaatgcctggatgacctgggtccgccagactccagggaagggctgcagtgggttgccgtattataaccaaacctgatggtgagacaacagactacgctgcaccgtgaaagcagattcaccatctcaagagatgattacaacgaacacgtcttgtttttaggaaatgaaacagacctagaaaaccgaggacacagtccgtttatttctgttccactactccctgacctacagtagtatttacgagaacttaataactcgaccaagttacgtgggaccgtcgtgggggacccaaagggggacccacgagtaccaccgtcctccctaccaacccctccaaccgtaaacgggcccctaagtcccgggttcccttcccccgtcggccctccccgtggccctcccgaggaccncccgaccctccggagacgccaacgccggcccggccccgttgggccctcggcccgttcggaccaacgggttaccttaacccgttccccgtaacg

SEQ ID NO: 319419 - DNA, 717 bp, Homo sapiens
  misc_feature: GZ8MTXP01EF5LO.4.71.G05.1.454.CMB.2.raw
  modified_base (223)..(223): a, c, t, g, unknown or other
  misc_feature (223)..(223): n is a, c, g, or t
  modified_base (250)..(250): a, c, t, g, unknown or other
  misc_feature (250)..(250): n is a, c, g, or t
tcagagcactgtagcacgaccggtgctcgatttagtgtcgtcgcaagagagaggggggtgggctcaggaggcagagctctgggaatctcaccatcggcctggacccctctcctgcctccccctcctcactttctgcacagtctctgaggcctcctatgagctgacacagccacctcggtgtcagtcgtcccaggacaaacggccaggatcacctgctctgganatgactaattagaaaccaaaaaaattntagtacttagtacgtacagacaagaagcgacgaccgaacgaaccctaaagttcgtactatactaagaacgaaacgaaccgaaaccgaaacccggtaccccgtaccgggtactaccgtagaacgtacgtacttcgtccgtcgtacctacgacgtaccgtaacggaacgggtaactacgtacccgtaccctacgttacgtaacgtacgtacgtacgggtacgggaccgtaaggtaggaagtagtacgacgtacgtacgtacttaactacgttagttaactaacggtaaagtaagaaacgtaacgtagttaagttaacgtttacggtttacggtagggttacgggttacgggtacgggtaacggtaaaccgtaacggttacggtaacccgttacgtacggtacgaccggccgttacggtcccgtcccgtaaccccgtccgtccgttacccgttcccgttcccgtaacccc

SEQ ID NO: 319420 - DNA, 643 bp, Homo sapiens
  misc_feature: GZ8MTXP01A1EK4.4.71.G05.1.454.CMB.2.raw
  modified_base (179)..(179): a, c, t, g, unknown or other
  misc_feature (179)..(179): n is a, c, g, or t
  modified_base (248)..(248): a, c, t, g, unknown or other
  misc_feature (248)..(248): n is a, c, g, or t
tcagagcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtntcagtcgtccccaggacaaacggccaggatcacctgctctggagatgctattacgaacctaaaaaaatntgactttagtggtaccagcagaagtcaggccacggaccccaaattgtacatctatgaagacgaacaaaccgacccctacgggactcccgtagacgacgtattctaccgtggctccgagctacgagggtaactagtcggaccctaccttgactatcgaggtcgggaccctaaagggtgggaagagtaggaacgtctagaccttactacttacgttacctactaaagtagaagaactagtacgtatttaacgtttcgtggggttcggttacgggacggggaacggaaccctaaacgttcggtaacccggttccgttaacgggtccaaccggcccaacgggtccctacccgggtccccctcggggtaccttacccggttccttccgggtttccccccg

SEQ ID NO: 319421 - DNA, 672 bp, Homo sapiens
  misc_feature: GZ8MTXP01BDK1Q.4.71.G05.1.454.CMB.2.raw
  modified_base (246)..(246): a, c, t, g, unknown or other
  misc_feature (246)..(246): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctggagatgcattgaaccaaaaaaatntagcttattggtaccagcagaagtcagcaggaccccaaaatggtcatctatagaacgaacgaacaaacgcccctaccgggaatcccgtagagtagattctaccctggctacagctacgaagggtctaagtccgggacctacccgtttagaactacgtacgtagggtacgggaccgtaagggtaggaaggtacgtaaggtaacgtacgtacgtaaccttaactaacggtttagttaacctaacggtaaagtaaagtaaagtaaacgtaagttaagtaagtttaagtttacggttgggttacgggttacgggtaccgggtaacgggtaaaccgtaaaccgttaccggtaccggttaccgtacggtacgacgaccgacggtaaccgtcccgtccccgtccgtaccgttaccttccgttcccgttccccg

SEQ ID NO: 319422 - DNA, 709 bp, Homo sapiens
  misc_feature: GZ8MTXP01B33M2.4.71.G05.1.454.CMB.2.raw
  modified_base (251)..(251): a, c, t, g, unknown or other
  misc_feature (251)..(251): n is a, c, g, or t
  modified_base (371)..(371): a, c, t, g, unknown or other
  misc_feature (371)..(371): n is a, c, g, or t
  modified_base (682)..(682): a, c, t, g, unknown or other
  misc_feature (682)..(682): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctcgtggagatgctattacgaacctaaaaaaatntagtacttagttaggtaccagcaagaagtcgaggaccaacggacccctaaaagttcggtacatactagtagaaacgaccgaaacaaacccgacccgtaccgggaactcccgtagacgtanactttccgtaccgtcggctaccgacgcctaacgacgggtaacttagtccgggacccttaaccgttacgaaccttagtccggaacgggttacggggacccgtaaagggtggaacgtagtacgtaagcgtacgacgttaactacgttagtttaaccacgggtaaataacggtaagtaactaagtacgtaagtttaacggtttcggtgggttacgggttccggacgggtaacggtaaaccctaaacgttcggtaaccccgttcgtaaaccggtcgaccggttcccgaacggtcccgtccccgtaacccccgttntaccgttacctcccgttcgttcccccg

SEQ ID NO: 319423 - DNA, 584 bp, Homo sapiens
  misc_feature: GZ8MTXP01DOH4M.4.71.G05.1.454.CMB.2.raw
  modified_base (223)..(223): a, c, t, g, unknown or other
  misc_feature (223)..(223): n is a, c, g, or t
  modified_base (245)..(245): a, c, t, g, unknown or other
  misc_feature (245)..(245): n is a, c, g, or t
  modified_base (258)..(259): a, c, t, g, unknown or other
  misc_feature (258)..(259): n is a, c, g, or t
  modified_base (263)..(263): a, c, t, g, unknown or other
  misc_feature (263)..(263): n is a, c, g, or t
  modified_base (280)..(280): a, c, t, g, unknown or other
  misc_feature (280)..(280): n is a, c, g, or t
  modified_base (283)..(283): a, c, t, g, unknown or other
  misc_feature (283)..(283): n is a, c, g, or t
  modified_base (286)..(286): a, c, t, g, unknown or other
  misc_feature (286)..(286): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctgganatgcaattgaccaaaaaaaatntgacttatgacannagancagcacgacctaaatgnatntanagaagaacaacaaacgacctcggactccagagagtacttctccgtcggctacgacgcgtaacgaggtaactagtccgacctacgttagaactatcgaggtcgggaccgaaggtggaggtagtagaagtctagactaactactagttactacgtaaagtaagaagaaagagtagtaagttaagtttacggtgggttcggtacgggacgggaacgggaaacctaaacgttacgtaccgttacgtaacgtcgacgccgaacggcctccgtccccgtcgtccttacctccgttccgttcccc

SEQ ID NO: 319424 - DNA, 692 bp, Homo sapiens
  misc_feature: GZ8MTXP01B56V4.4.71.G05.1.454.CMB.2.raw
  modified_base (245)..(245): a, c, t, g, unknown or other
  misc_feature (245)..(245): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctggagatgcattagaacaaaaaatntgcttatggtacagcaagaagtcagcaacggacccctaaaagttcggtacatctaagtagaaacgaacgaacaaaccggaccccgtaccgggacttaccccgtagaacgacgtactttccgtccgtcgggtccttaccgaacgtccttaacgaacgggtaactagtccgggaccctacctagtaactagtaccgtaggtacggggaccctaaaggtggaaggataggaagctagtaactactattacgttacacgtaaagttagaacgaagtagtagtattagtttcggtagggttcggttacgggacgggtaacggggtaaacctaaacggttaccgggaaccgttaccgtaacgggtccgaaaccggacccggttaaacgggcccgttaccccggtcccccgtttacgggtaccttacccggttccttcccggtttaaccccccc

SEQ ID NO: 319425 - DNA, 615 bp, Homo sapiens
  misc_feature: GZ8MTXP01BHG6H.4.71.G05.1.454.CMB.2.raw
  modified_base (244)..(244): a, c, t, g, unknown or other
  misc_feature (244)..(244): n is a, c, g, or t
  modified_base (300)..(300): a, c, t, g, unknown or other
  misc_feature (300)..(300): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctggagatgcattagaaccaaaaaatntgacttattggtaccagcagaagtcaggccaggaccccaaattggcatctatgaanacgaacaaaccgcccgcgggactcccgtgagagattctccgtggctccagctacgagggtcttagcgggccctaccttgactatcgagggtcggggacccaaggtcgggaaggataggaacgctacgacttactactgtttaacacgaagtagacgaacgtagtagaattaagtttcggtggggttggttaccgggacgggtaacgggaaccctaaacgttcggacccgttacgtaacggtccgacggcccgaacggggtcccttacccggccccccgttagggtcccttaccgtccgttcccggttcccccccg

SEQ ID NO: 319426 - DNA, 757 bp, Homo sapiens
  misc_feature: GZ8MTXP01AELGL.4.71.G05.1.454.CMB.2.raw
  modified_base (225)..(225): a, c, t, g, unknown or other
  misc_feature (225)..(225): n is a, c, g, or t
  modified_base (249)..(249): a, c, t, g, unknown or other
  misc_feature (249)..(249): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacacgccaccctcggcgtcagtcgtccccaggacaaacggccaggatcacctgctctgganatgctattagaacctaaaaaaatntagtacttagttacggtaccagacgaagaagtcgacggaccgaacggaacccctaaaagtttcggactaattaccgtaagtaacggaaacgtaaccgaaaccgaaaaccccggtacccccggtaccgggtaacctaccccgtaggaacgtacgtacttcctaccgttcggcctacgacgctaaccggacgggtaactacgtcgggacccttaccgttagaacgttacgtccgacgggttcggggacccctaagggtacgggaaggtagtaggaacgtgtacgaaccttaacctaacgttagttaacctaacgggtaaagtaacggtaagtaaaccgtaaggttagtaaagtttaacggtttacggttgggggttacggtttacggggacggaacgggtaacctaaacggttcgtaccgttaccgtacggtcaccggttccgttaacggcccgtcccggtaaccccgtcggtacccttaccgttaacccgttccccggtttaacccccg

SEQ ID NO: 319427 - DNA, 686 bp, Homo sapiens
  misc_feature: GZ8MTXP01BPWBT.4.71.G05.1.454.CMB.2.raw
  modified_base (250)..(250): a, c, t, g, unknown or other
  misc_feature (250)..(250): n is a, c, g, or t
  modified_base (383)..(383): a, c, t, g, unknown or other
  misc_feature (383)..(383): n is a, c, g, or t
  modified_base (406)..(406): a, c, t, g, unknown or other
  misc_feature (406)..(406): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctggagatgctattacgaacctaaaaaaatntgactttagttggtaccaagaagaagtcacggccacggaccccaaaagttggacatctatagaagacgaacaaacgccctccgggactcccgtagagagtacttcgtctcggcctcagctacgaacgggactntcggtacccaccgtttgacttancgaggtcgggacccgaaggtcgggaggtataggaacgtctagactacgttacttagttaactacaaaggtacgaagtaaacaggtacgtaagttaagttttcggtaggggtttcggtttaccggggacgggtaacggggtaaaccctaaacggttcggaaccccggtttaccgttaaggggttacccaacggaccccgttaaacgggttcctccccgggtaccccccgttcgggtacccttacccgttcccgttaaccccggtttcccccgtaacccccg

SEQ ID NO: 319428 - DNA, 626 bp, Homo sapiens
  misc_feature: GZ8MTXP01ERG42.4.71.G05.1.454.CMB.2.raw
  modified_base (181)..(181): a, c, t, g, unknown or other
  misc_feature (181)..(181): n is a, c, g, or t
  modified_base (225)..(225): a, c, t, g, unknown or other
  misc_feature (225)..(225): n is a, c, g, or t
  modified_base (249)..(249): a, c, t, g, unknown or other
  misc_feature (249)..(249): n is a, c, g, or t
  modified_base (400)..(400): a, c, t, g, unknown or other
  misc_feature (400)..(400): n is a, c, g, or t
  modified_base (419)..(419): a, c, t, g, unknown or other
  misc_feature (419)..(419): n is a, c, g, or t
  modified_base (470)..(470): a, c, t, g, unknown or other
  misc_feature (470)..(470): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagcccaccctcggtntcagtcgtccccaggacaaacggccaggatcacctgctctgganatgctaattgaaacctaaaaaatntgacttatggaaccagcagagtcagccacggaccccaaagtcgtacatctatgaaacgacgaaacaaaccgccctaccgggactcccgtagacgagtacttctaccgtggcctacgacgtctaacgaagggctagtcgccctactgactancgagtggaccaggtgaggntagagtctagtactactatacgttactacgaaattaggaataacgaagttntaagttaagttttcggagggttcggttacggggaccgggaacggtaaccgtaaacgttcgggtacccgttacgtaacggttaaccgaccgttcccgaaacggttcccgaccgtccccgttccgggtaccttaccgtcccgtttcccgttccccccg

SEQ ID NO: 319429 - DNA, 632 bp, Homo sapiens
  misc_feature: GZ8MTXP01BL65R.4.71.G05.1.454.CMB.2.raw
  modified_base (249)..(249): a, c, t, g, unknown or other
  misc_feature (249)..(249): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctggagatgctattagaacctaaaaaaatntgcttattggtaccagtagagtcaggccaggaccccaaattggacatctatagaagacgaacaaaccgaccccgtacgggactcccgtagagtagattctcgtcggcctcagctcgaacgggactgtcggaccctaccttgactagtcgaggtcgggaccaaggtggaggatagaacgctagactactatagttactacaagtacgaagtaacagtagattaagtttcggtaggggttcgttacgggacgggtaacggaccctaaacgtcggaacccgttaccgttagggtaccgaacggttacccccgttaaggggttcccttaaccggccccccgttcgggttcccacctttcccgttcccgtttaaccccccgtaacccc

SEQ ID NO: 319430 - DNA, 679 bp, Homo sapiens
  misc_feature: GZ8MTXP01B7TI9.4.71.G05.1.454.CMB.2.raw
  modified_base (179)..(179): a, c, t, g, unknown or other
  misc_feature (179)..(179): n is a, c, g, or t
  modified_base (241)..(242): a, c, t, g, unknown or other
  misc_feature (241)..(242): n is a, c, g, or t
  modified_base (256)..(256): a, c, t, g, unknown or other
  misc_feature (256)..(256): n is a, c, g, or t
  modified_base (326)..(326): a, c, t, g, unknown or other
  misc_feature (326)..(326): n is a, c, g, or t
  modified_base (360)..(360): a, c, t, g, unknown or other
  misc_feature (360)..(360): n is a, c, g, or t
  modified_base (443)..(443): a, c, t, g, unknown or other
  misc_feature (443)..(443): n is a, c, g, or t
tcagagcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtntcagtcgtccccaggacaaacggccaggatcactgctctggagatgcattgaccaaaaaatnncttattcggacagnagaagtcaggcacgacccaaatgcatctatgaaagacgaacaaccgacccgtcgggactcctgaagaagnttcctacgtggacctccagtcgtacgaacgggtntacgtcggaccctaacccttcggtaactacgttcgacgggtaccggggtaccgaacgggtgggaaagggttagagggtaaacnccgtagtaaccgtattaccgttagttacttacgaaattacgggaaagtaacgaaagtacgtaagtttaatttaccggtttagggtcggtttaacgggcggggttaacgggaaacccgtaaacgttacccggtacggtttccccggaaggtcccttacggacccccgggaagttaaccccggcgaaccccccccgtttcgggaccccaccgttttaaccggttcccctttaaccccg

SEQ ID NO: 319431 - DNA, 626 bp, Homo sapiens
  misc_feature: GZ8MTXP01AK2J5.4.71.G05.1.454.CMB.2.raw
  modified_base (241)..(241): a, c, t, g, unknown or other
  misc_feature (241)..(241): n is a, c, g, or t
tcagagcactgtagcacgaccggtgctcgatttagtgtcgtcgcaagagagagggggtgggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctggagatgcattgaccaaaaaatntgacttattggtaccagcagaagtcaggccacggaccccaaaagttcggtcatctatgaacgacgaacaaaccgccccgtaccgggactcccgtgagagtattcgtcctggctccgagccgtacgacgggaactagtcgggcctaccttgactatcaggtcggggacccaaggtgggagatagaagctagacttacgtacttgttacacgtaataagagaaacagttagaagttaacgtttggtcggggttagttacgggacggggtaaggaaccgtaaaacgttcggtaaacccgttcccgtaaaggtcccgacggccccgaaacgggtccgtccccgtcccccgttcggtcccttccgttcccgttccgggtttccccccccg

SEQ ID NO: 319432 - DNA, 634 bp, Homo sapiens
  misc_feature: GZ8MTXP01CBK4C.4.71.G05.1.454.CMB.2.raw
  modified_base (225)..(225): a, c, t, g, unknown or other
  misc_feature (225)..(225): n is a, c, g, or t
  modified_base (246)..(246): a, c, t, g, unknown or other
  misc_feature (246)..(246): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctgganatgcattagaaccaaaaaatntgacttatggtacagcaagaagtcaggccaacggacccctaaaagttcggtacatctaatagaagaaccgaacgaaaccgaccccgtaccgggactccccgtagagagtacttcctcctcggctccgagcctacgacgggtctagtcgggaccctaccgttgaacttagtacgaggtcggggacccaagggtcggaggagtaggaagtctagtacttactacgttagttaactacgtaagtaagaagaaacgtagttagtaagtttagtttcggtgggttaggtcgggtacgggaacggtaacctaacgttcggacccgttcgtagggtcgacgcccgacggtcctaccggccccgttcggtccttaccgttccgttccgttcccccg

SEQ ID NO: 319433 - DNA, 708 bp, Homo sapiens
  misc_feature: GZ8MTXP01BBA9V.4.71.G05.1.454.CMB.2.raw
  modified_base (250)..(250): a, c, t, g, unknown or other
  misc_feature (250)..(250): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctcgtggagatgctattacgaaccaaaaaaatntgtacttattggtaccagacaagaagtcacggccacggaccccaaaagttcggacatctatagaaacgaccgaacaaaccgccccgtacccgggactcccgtagagtagtacttccgtccgtcggctaccagccttaacgaacgggtaactagtaccgggaccctaccgtttagactagttccgaacgggttcggggaccctaaagggtggggaaggtagtacggtaaacgtccttaaggtaacccttaaaccgttacttaacgttaacctaacggtaaagttaacggaaacgtaaacgtaggtaagttaagtttaaacgtttcggttaggggttcgggttacggacgggaacgggtaactaaacggttcggacccgttacggtacggtacgacggttcccgaagggtccttacccggcccccgttggtccttacccgttccgttaacccgttccccc

SEQ ID NO: 319434 - DNA, 580 bp, Homo sapiens
  misc_feature: GZ8MTXP02HTQVS.4.71.G05.1.454.CMB.2.raw
  modified_base (240)..(240): a, c, t, g, unknown or other
  misc_feature (240)..(240): n is a, c, g, or t
  modified_base (242)..(242): a, c, t, g, unknown or other
  misc_feature (242)..(242): n is a, c, g, or t
  modified_base (257)..(257): a, c, t, g, unknown or other
  misc_feature (257)..(257): n is a, c, g, or t
  modified_base (282)..(282): a, c, t, g, unknown or other
  misc_feature (282)..(282): n is a, c, g, or t
tcagagcactgtagcacgaccggtgctcgatttagtgtcgtcgcaagagagaggggtgggctcgaggaggcagagctctgggaatctcaccatggcctggacccctctcctgctccccctcctcactttctgcacagtctctgaggcctcctatgagctgacacagccaacctcggtgtcagtgtccccaggacaaacggccaggatcacctgctctggagatgcattgaccaaaaaatntntctatgacagcagancagcacgacccaaagtgacatctanagaagacgaacaaaccgacccgtacgggactccagagagtacttctccgtcgcctccgagctacgacgggtctagtcggaccctaccgttagactatcgaggtcgggaccgaaggtggaggagtagagctagaactactactacgttactactaaagtagaagaacgagtagtaattaacgtttcgtagggttggtacgggacggaacggtaacctaacgtcgaccgtacgtacggtacgaccgaccgaacggtccgtccgtcccccgtacggtacctaccgtccgttacccgtcccc

SEQ ID NO: 319435 - DNA, 526 bp, Homo sapiens
  misc_feature: GZ8MTXP02IMC0Y.4.71.G05.1.454.CMB.2.raw
  modified_base (240)..(240): a, c, t, g, unknown or other
  misc_feature (240)..(240): n is a, c, g, or t
tcagagcactgtagcacgaccggtgctcgatttagtgtcgtcgcaagagagagggggtgggctcaggaggcagagctctgggaatctcaccatggcctggacccctctcctgcctcccctcctcactttctgcacagtctctgaggcctcctatgagctgacacagccaccctcggtgtcagtgtccccaggacaaacggccaggatcacctgctctggagatgcattgaccaaaaaatntgcttatggtaccagcagaagtcaggccaggcccccaaaattggtcatctatgaagacgacaaacgaccctccgggatccctgagagattctcctggctccagctcagggctatggccaccttgactatcagtgggcccagtggagatgaagctgactactactgttactcaatagagaacagtagataatttcgtgggttgttcgggcggaagggaaccaaaacgttcgaaccgtccgtaggtcacgcccgaaggcctcgccccctcggccacctctcgtccccc

SEQ ID NO: 319436 - DNA, 547 bp, Homo sapiens
  misc_feature: GZ8MTXP02GN70Z.4.71.G05.1.454.CMB.2.raw
  modified_base (367)..(367): a, c, t, g, unknown or other
  misc_feature (367)..(367): n is a, c, g, or t
  modified_base (385)..(385): a, c, t, g, unknown or other
  misc_feature (385)..(385): n is a, c, g, or t
  modified_base (407)..(407): a, c, t, g, unknown or other
  misc_feature (407)..(407): n is a, c, g, or t
  modified_base (480)..(480): a, c, t, g, unknown or other
  misc_feature (480)..(480): n is a, c, g, or t
  modified_base (494)..(494): a, c, t, g, unknown or other
  misc_feature (494)..(494): n is a, c, g, or t
tcagagcactgtagcacgaccggtgctcgatttagtgtcgtcgcaagagagaggggaagaccgatgggcccttggtggaggcttggtgaagccggggggtcccttagactctcctgtgcagtctctggactcaacctcaaaaatgcctggatgacctgggtccgccagactccagggaagggctgcagtgggttgccgtatataaccaaacctgatggtgagacaacagactacgctgcacccgtgaaaggcagattcaccatctcaagagatgattcaacgaacacgctgttttgaaatgaacagcctgaaaaccgaggacacagccgtttattctgttccacactcctgcctacagagatttcgngactataaatcgccatangacgtctgggccaagggaccanagtcaccgtctcctcacctccaaccgaacggcccaagtcggtccttccccctgccgccctgcctccaggaccnccacctcgacgacncacgcgccgccgtcggctcgccgtacggtacaacggtacctaccttacctacg

SEQ ID NO: 319437 - DNA, 591 bp, Homo sapiens
  misc_feature: GZ8MTXP02JG6DA.4.71.G05.1.454.CMB.2.raw
  modified_base (221)..(221): a, c, t, g, unknown or other
  misc_feature (221)..(221): n is a, c, g, or t
  modified_base (241)..(241): a, c, t, g, unknown or other
  misc_feature (241)..(241): n is a, c, g, or t
  modified_base (328)..(328): a, c, t, g, unknown or other
  misc_feature (328)..(328): n is a, c, g, or t
  modified_base (334)..(334): a, c, t, g, unknown or other
  misc_feature (334)..(334): n is a, c, g, or t
tcagagcactgtagcacgaccggtgctcgatttagtgtcgtcgcaagagagagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctgganatgcattgaaccaaaaaatntgacttattggtaccagcagaagtcaggccaggaccccaaaattggacatctatgaagacgacaaacgaccctcgggactccctganagatcncgtgctcagctcgagggctagtcggcctaccttgaactagtcaaggtcggggaccctaaggtcggaggagtagaacgctagaactactacttagttactacaaatagacgaaactagtagtattaaactttcgtaggggtagttacgggacgggaggtaacccgaaacgtcggaacccgtaccgttaaggaccaccggtacccgaaaggtccgtaaccgcccccgtaggtcccaaccgttccgtacgtttacccccc

SEQ ID NO: 319438 - DNA, 572 bp, Homo sapiens
  misc_feature: GZ8MTXP02H4PND.4.71.G05.1.454.CMB.2.raw
  modified_base (223)..(223): a, c, t, g, unknown or other
  misc_feature (223)..(223): n is a, c, g, or t
  modified_base (242)..(242): a, c, t, g, unknown or other
  misc_feature (242)..(242): n is a, c, g, or t
  modified_base (291)..(291): a, c, t, g, unknown or other
  misc_feature (291)..(291): n is a, c, g, or t
  modified_base (324)..(324): a, c, t, g, unknown or other
  misc_feature (324)..(324): n is a, c, g, or t
  modified_base (338)..(338): a, c, t, g, unknown or other
  misc_feature (338)..(338): n is a, c, g, or t
  modified_base (458)..(458): a, c, t, g, unknown or other
  misc_feature (458)..(458): n is a, c, g, or t
tcagagcactgtagcacgaccggtgctcgatttagtgtcgtcgcaagagagagggggtgggctcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggatcacctgctctgganatgcattgaccaaaaaatntgcttatggtaccagcagaagtcagccaggaccccaaatggtcatctanagaagacgaacaaacgaccctacgggactcccngagagattctccgngcctccgagctacgaggggcctatcggaccctaccgttgactaatcgaaggtcggggacccaaaggtgggaagagtaggaaagcgtagacctactactagttactacaaagtagaagaanagtagaattaattgtgggtgttcgggagggtacggacgaaaacgtcggaccgtacgtacggcacgaccctaacgggcctccgacccccgtcggtccaccgtcctcggttccccc

SEQ ID NO: 319439 - DNA, 596 bp, Homo sapiens
  misc_feature: GZ8MTXP02HG12A.4.71.G05.1.454.CMB.2.raw
  modified_base (242)..(242): a, c, t, g, unknown or other
  misc_feature (242)..(242): n is a, c, g, or t
tcagagcactgtagcacgaccggtgctcgatttagtgtcgtcgcaagagagagggggtgggctcaggaggcagagctctgggaatctcaccatggcctggacccctctcctgcctccccctcctcactttctgcacagtctctgaggcctcctatgagctgacacagcccaccctcggtgtcagtgtccccaggacaaacggccaggatcacctgctctggagatgcattgaccaaaaaatntgacttatgtacagcagagtcagccacgacccaaatgcatctatagaagacgaacaaaccgacccgtaccgggactcccgtagagagtacttctccgtcggcctccgagtctacgagggtactagtcggacctaccgttgactatcgaggtcgggacccgaggtggaggagtagagcgtagactactacttagttactacaatagaagaacgtagtagtaattaagtttcgtgggttggttacgggacgggaacgggtaaccgtaaacgtcggtaccgttaccgtacggtaccgacgacccgaacggtccgtccggacccccgtcggtacctaccgttccgttccgttcccccg

SEQ ID NO: 319440 - DNA, 576 bp, Homo sapiens
  misc_feature: GZ8MTXP02I04LL.4.71.G05.1.454.CMB.2.raw
  modified_base (239)..(239): a, c, t, g, unknown or other
  misc_feature (239)..(239): n is a, c, g, or t
  modified_base (336)..(336): a, c, t, g, unknown or other
  misc_feature (336)..(336): n is a, c, g, or t
tcagagcactgtagcacgaccggtgctcgatttagtgtcgtcgcaagagagaggggtgggctcaggaggcagagctctgggaatctcaccatggcctggacccctctcctgcctcccctcctcactttctgcacagtctctgaggcctcctatgagctgacacagccaccctcggtgtcagtgtccccaggacaaacggccaggatcacctgctctggagatgcattgaccaaaaaatntgcttattggtaccagcagaagtcaggccaggacccccaaaattggcatctatgaagacgaacaaaacgacccctccgggatccctagagagattcnctggctccagctcgagggctatcggccctaccttgactatcagtgggacccaagtggaggatgaagctagactactactagttactcaaattagagaacagtagattaagtttcgtagggttgttacgggacgggtaacgggaaccgtaaaacgtcggtaaccgttaccgttaacggtccgaacgaccccgaaaggccgtccggtaccccctcgggtccaccgtccttccgtttaccccc

SEQ ID NO: 319441 - DNA, 697 bp, Homo sapiens
  misc_feature: GZ8MTXP02I21VS.4.71.G05.1.454.CMB.2.raw
  modified_base (242)..(242): a, c, t, g, unknown or other
  misc_feature (242)..(242): n is a, c, g, or t
tcagagcactgtagcacgaccggtgctcgatttagtgtcgtcgcaagagagagggggtgggctcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggatcacctgctctggagatgcattgaccaaaaaatntgtacttatcgacagcagagtcaggaccacggaaccctaaagttcggtacatactagtagaaacgaaccgaacaaaccgacccgtaccgggactacccgtagacgacgtacttctccgtcgcctacgacgctacgaagggactacgtcggtaccctaccgttagacttatacgtacgggtaccggggacccgaagggtagggaaggtagtaggaacgtacgttaacgtaaccttaacgttacgtttacgttaaacctaacgtaaagtaagaaacgtaaacgtaagtaagtaagtttaacgtttcggtaggggttacggttacggggacgggtaacgggtaaaccgtaaacggttacggtaacccggttacggtaacggtaccgtaaccggacccgaacggtcccgtacccggtacccccgttacggtaccctaccgttcccgttacccgtacccc

SEQ ID NO: 319442 - DNA, 563 bp, Homo sapiens
  misc_feature: GZ8MTXP02HAQZZ.4.71.G05.1.454.CMB.2.raw
  modified_base (373)..(373): a, c, t, g, unknown or other
  misc_feature (373)..(373): n is a, c, g, or t
  modified_base (418)..(418): a, c, t, g, unknown or other
  misc_feature (418)..(418): n is a, c, g, or t
  modified_base (471)..(471): a, c, t, g, unknown or other
  misc_feature (471)..(471): n is a, c, g, or t
tcagagcactgtagcacgaccggtgctcgatttagtgtcgtcgcaagagagaggggaagaccgatgggcccttggtggaggcttggtgaagccggggggtcccttagactctcctgtgcagtctctggactcaacctcaaaatgcctggatgacctgggtccgccagactccagggaagggctgcagtgggttggccgtattataaccaaacctgatggtgagacaacagactacgctgcacccgtgaaaggcagattcaccatctcaagagatgattcaacgaacacgcttgttttggaaatgaacagcctagaaaaccgaggacacagtccgtttattctgttccacactcctgcctacagagtatttcgngactataactcgccatatggacgtcgtggggcccaaagggaccanagtcaccgtctcctcacctccacaacgggcccatccgtccttcccctggcccnccctgcctccgaggacgcaccctccgagcgccacacggccgccccgtgggcctcggccctggtacaaacggtcctaccgtttacccctaacg

SEQ ID NO: 319443 - DNA, 613 bp, Homo sapiens
  misc_feature: GZ8MTXP02G4RM7.4.71.G05.1.454.CMB.2.raw
  modified_base (386)..(386): a, c, t, g, unknown or other
  misc_feature (386)..(386): n is a, c, g, or t
  modified_base (507)..(507): a, c, t, g, unknown or other
  misc_feature (507)..(507): n is a, c, g, or t
tcagagcactgtagcacgaccggtgctcgatttagtgtcgtcgcaagagagagggggaagaccgatgggcccttggtggaggcttggtgaagccggggggtcccttagactctcctgtgcagtctctggactcaacctcaaaaatgcctggatgacctgggtccgccagactccagggaagggctgcagtgggttggccgtattataaccaaactgatggtgagacaacagactacgctgcaccgtgaaaggcagattcaccatctacaagagatgattacaacgacacgcttgttttaggaaatgaacagcctagaaaacccgaggaaccacgaggtcccgttttaatttctcgtttaccactaccttccctcgcctacagagtntttcgtagacttataaatcgaccatagtggacgtcgtggggcccaaaggggaccagacgtccaccgtctaccctacaaccctcccaaccaacgggccccaagtccggtccctttcccccgnggccccgtccctcggcctacccgagggacccgccacccgtacgacgacgaccgacgacggcccggtccgcggctcgccgtacggtacaacgtccttacctaccacg

SEQ ID NO: 319444 - DNA, 602 bp, Homo sapiens
  misc_feature: GZ8MTXP02GU6GS.4.71.G05.1.454.CMB.2.raw
  modified_base (242)..(242): a, c, t, g, unknown or other
  misc_feature (242)..(242): n is a, c, g, or t
  modified_base (261)..(261): a, c, t, g, unknown or other
  misc_feature (261)..(261): n is a, c, g, or t
  modified_base (283)..(283): a, c, t, g, unknown or other
  misc_feature (283)..(283): n is a, c, g, or t
  modified_base (330)..(330): a, c, t, g, unknown or other
  misc_feature (330)..(330): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctggagatgcattgaccaaaaaatntgtcttatgacagacagancagcacgaccaaatgcatctanagaagacgaacaaacgacccgtacgggactccgtagagagtacttcnccgtcgcctcgacgctacgaggctagtcggacctacgttgactatcgtaggtcgggaccgaaggtaggagagtagacgctacgactactacgttacgttactactaagtagaagtaacgtaagtagtaattaagtttagtagggttacggttacgggacgggtaacgggaaccgtaaacgtacggtaacccggtaccgtacggtaccgacgacccgaacggtccgtacccggtaccccgtaccggtacctaccgttccgttaccgttccccg

SEQ ID NO: 319445 - DNA, 658 bp, Homo sapiens
  misc_feature: GZ8MTXP02IKAZL.4.71.G05.1.454.CMB.2.raw
  modified_base (241)..(241): a, c, t, g, unknown or other
  misc_feature (241)..(241): n is a, c, g, or t
tcagagcactgtagcacgaccggtgctcgatttagtgtcgtcgcaagagagagggggtgggctcaggaggcagagctctgggaatctcaccatggcctggacccctctcctgcctccccctcctcactttctgcacagtctctgaggcctcctatgagctgacacagcccacctcggtgtcagtgtccccaggacaaacggccaggatcacctgctctggagatgcattgaccaaaaaatntgtacttatgtacagacaagaagtcgacggaccgaacggacccctaaagttcggtacatctatagaaacgacgaacaaaaccgacccgtaccgggactcccgtagacgagtacttctccgtcggcctaccgagcctacgaacgggtactagtcggaccctaccgttgactactcgaggtcggggacccgtaaggtgggaggtagtaggaacgtacgtacgtaacttactacgttacgttactaactaaagtaagaagtaacgtaagtagtaattaacgtttacggtaggggttacggttacgggacgggtaacggtaaaccgtaaacgtacggtaccgttaccgtaacggtaccgaaccgaccgaacggtccgtacccggtaccccgtacggtacctaccgttccgttaccgtcccc

SEQ ID NO: 319446 - DNA, 580 bp, Homo sapiens
  misc_feature: GZ8MTXP02IHXGR.4.71.G05.1.454.CMB.2.raw
  modified_base (242)..(242): a, c, t, g, unknown or other
  misc_feature (242)..(242): n is a, c, g, or t
  modified_base (430)..(430): a, c, t, g, unknown or other
  misc_feature (430)..(430): n is a, c, g, or t
tcagagcactgtagcacgaccggtgctcgatttagtgtcgtcgcaagagagagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaaattntgtacttagtcggtacagacaagagtcgacggaccaacggaccctaaagttcggtactatactagtagaaacgaccgaacaaaaccgcccgtaccgggactccgagacgacgtacttctccgtcgcctaccgagctacgagggtctagtcggaccctaccgttgactatcgaggtcgggacctaaggngggaagagtagacgctacgaactactacttacgttactataagtagagactagtagtattagttgtgggttgtacgggacggtacggaactacgtcgaccgtacgtacgtcgacgccgacggccgtccgcccgtcgacctctctcctccc

SEQ ID NO: 319447 - DNA, 601 bp, Homo sapiens
  misc_feature: GZ8MTXP02FVRUI.4.71.G05.1.454.CMB.2.raw
  modified_base (240)..(240): a, c, t, g, unknown or other
  misc_feature (240)..(240): n is a, c, g, or t
  modified_base (346)..(346): a, c, t, g, unknown or other
  misc_feature (346)..(346): n is a, c, g, or t
tcagagcactgtagcacgaccggtgctcgatttagtgtcgtcgcaagagagagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaatntgcttatggtaccagcagaagtcaggccaggaccccaaaattggtacatctatagaagaccgaacaaaccgaccctaccgggatcccctagaacgagaactttccnctacggcctaccagtcctacgagggactagtcggacctaccttgaacttatccgaggtcggggaccctaaggtacggaggagtagaagctagactaactacgttagttactacaaatagaagtaaagagtagtaattaagtttcgtagggttgttcgggacggtacggaaccgaaacgttcgaccggtactacggtcacgacccgaaggccgtccgtacccccgtacggtaccacctccgttccgtttacccccc

SEQ ID NO: 319448 - DNA, 601 bp, Homo sapiens
  misc_feature: GZ8MTXP02GL9BA.4.71.G05.1.454.CMB.2.raw
  modified_base (250)..(250): a, c, t, g, unknown or other
  misc_feature (250)..(250): n is a, c, g, or t
  modified_base (307)..(307): a, c, t, g, unknown or other
  misc_feature (307)..(307): n is a, c, g, or t
  modified_base (352)..(352): a, c, t, g, unknown or other
  misc_feature (352)..(352): n is a, c, g, or t
  modified_base (463)..(463): a, c, t, g, unknown or other
  misc_feature (463)..(463): n is a, c, g, or t
  modified_base (475)..(475): a, c, t, g, unknown or other
  misc_feature (475)..(475): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctcgtggagatgctattagaacctaaaaaaatntgactttattggtaccagcaagaagtcaggccacggaccccaaaattggacatctanagaagacgaacaaacgcccgtaccgggatccctgagagtacttcncgtcgcctccagctacgagggactagcggaccctaccttgactatcgacggtcggggacccaaggtgggaaggagtaggaaacgtctacggactactacttagttacctanaatagaacgaanagtagtaagttaagtttggtagggttcggttacgggacgggtaagggtaaccaaacgtcggtaccggtacgtacggtacgacgaccgaacgcgtccgaccccgtacgcctactccgttactccccc

SEQ ID NO: 319449 - DNA, 589 bp, Homo sapiens
  misc_feature: GZ8MTXP02JIAB3.4.71.G05.1.454.CMB.2.raw
  modified_base (241)..(241): a, c, t, g, unknown or other
  misc_feature (241)..(241): n is a, c, g, or t
  modified_base (282)..(282): a, c, t, g, unknown or other
  misc_feature (282)..(282): n is a, c, g, or t
tcagagcactgtagcacgaccggtgctcgatttagtgtcgtcgcaagagagagggggtgggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctggagatgcattgaccaaaaaatntgcttatgacagcagagcagcacgacccaaatgtcatctanagaagacgaacaaccgacccgtccgggactcccgtaggagagtacttctccgtggcctccgagtcctacgagggtctagtcggaccctaccgttgactatcgaggtcgggacccaaggtacggaggtagtaggaagcgtagaactactacttagttactacaagtagagaactagtagtattagtttcgtgggttgttacgggacgggtaacggtaacctaaacgtcggtaaccgttacgtacggtaccgacgacccgaaggtcccgtcccgtaccccgtacggtcctaccttccgttccgttcccc

SEQ ID NO: 319450 - DNA, 604 bp, Homo sapiens
  misc_feature: GZ8MTXP02HRPVS.4.71.G05.1.454.CMB.2.raw
  modified_base (243)..(243): a, c, t, g, unknown or other
  misc_feature (243)..(243): n is a, c, g, or t
  modified_base (296)..(296): a, c, t, g, unknown or other
  misc_feature (296)..(296): n is a, c, g, or t
tcagagcactgtagcacgaccggtgctcgatttagtgtcgtcgcaagagagagggggtgggctcaggaggcagagctctgggaatctcaccatggcctggacccctctcctgcctcccccctcctcactttctgcacagtctctgaggcctcctatgagctgacacagccaccctcggtgtcagtgtccccaggacaaacggccaggatcacctgctctggagatgcattgaccaaaaaaatntgtacttagtacgacagacagaagcagaccacggacccaaagtgacatactanagaaacgaacgaaacaaaaccgaccccgtacgggactcccgagaagagtacttctcgtgcctaccagtctacgagggtactagtcggaccctacgttgaactatcgaggtcgggacctaaggtggaggatagaagctagaactactatagttactaacaaagtagaagaacaagtagtaattaagtttagttgggttaggttacgggtacgggaacgggaaccgtaaacgtacgtaccgtaccgtacgtacgacgaccgaacgaaccgtccgtaccccgtcccgtaccgtacctaccgttccgtcccg

SEQ ID NO: 319451 - DNA, 675 bp, Homo sapiens
  misc_feature: GZ8MTXP02HDTAH.4.71.G05.1.454.CMB.2.raw
  modified_base (240)..(240): a, c, t, g, unknown or other
  misc_feature (240)..(240): n is a, c, g, or t
tcagagcactgtagcacgaccggtgctcgatttagtgtcgtcgcaagagagagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaatntgcttattggtaccagcagaagtcaggccaggccccaaaatggacatctatgaagacgacaaacgaccctccgggatcccgtgacgagacttctcgtgctccagctcgagggactagtcggccctaccgttgactatcgaaggtcggggacccaaggtcgggaaggacgtaggaaacgcgtaggaaaccttaacctacgttaggtttaacctacgtaaacttaagaacgtaaacgtaaggtagtaaagtttaaacgttttcggttagggggttacggtttacgggggacgggggtaaacggggtaaacccgtaaaacggttcgggtaacccggttaccgttaaacggggttaccgaaccggttacccgaaaacgggtccgttacccggacccccggttcggggtaccctaccgttccgttaaccggtttcccccc

SEQ ID NO: 319452 - DNA, 650 bp, Homo sapiens
  misc_feature: GZ8MTXP02JLC0J.4.71.G05.1.454.CMB.2.raw
  modified_base (224)..(224): a, c, t, g, unknown or other
  misc_feature (224)..(224): n is a, c, g, or t
  modified_base (245)..(245): a, c, t, g, unknown or other
  misc_feature (245)..(245): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagcccaccctcggtgtcagtcgtcccaggacaaacggccaggatcacctgctctgganatgcattcgaaccaaaaaatntgcttattggtaccagcaaggaatcgacggccaacggaccccaaaagttcggtacatctaatagaaacgaccgaacaaacgaccccgtaccgggactcccgtagagatacttctcgtcgctccagctcgagggtctagtcggacctaccgttgacttatcgtaagggtcgggacccgaaggtggaggtagtagagcgtagaaccttactacgttagtacctagtaaatagaagaacgtagtagtaagtttaagtttcgttggggttcggttacggggtacgggaacggggtaaccctaaacggtaccggtaacccggtaccggtacgggtaccacggacccgaacgggtcccgtcccggtacccccggtcggtacccacccggtttccttcccggtttacccccc

SEQ ID NO: 319453 - DNA, 570 bp, Homo sapiens
  misc_feature: GZ8MTXP02JB1S2.4.71.G05.1.454.CMB.2.raw
  modified_base (489)..(489): a, c, t, g, unknown or other
  misc_feature (489)..(489): n is a, c, g, or t
  modified_base (504)..(504): a, c, t, g, unknown or other
  misc_feature (504)..(504): n is a, c, g, or t
tcagagcactgtagcacgaccggtgctcgatttagtgtcgtcgcaagagagagggggaagaccgatgggcccttggtggaggcttggtgaagccggggggtcccttagactctcctgtgcagtctctggactcaacctcaaaaatgcctggatgacctgggtccgccagactccagggaagggctgcagtgggttggccgtattataaccaaacctgatggtgagacaacagactacgctgcacccgtgaaaggcagattcaccatctcaagagatgattcaaacgaacacgcttgttttaggaaatgaacagcctagaaaaccgaggacacagtccgtttatttctgttccactactcctcgcctacagagtattcgtgactataactcgaccatatggacgtcgtggggccaagggaccagagtcaccgtctcctcacctcaccgacggcccagtccgtcctccccgtgccgccctgcctcaggacncgaccctccgagacncacgacggccggcccgtggggcctcggtccgtacggtaccgaacggtaccttaccgttccctaacg

SEQ ID NO: 319454 - DNA, 519 bp, Homo sapiens
  misc_feature: GZ8MTXP02GFGQA.4.71.G05.1.454.CMB.2.raw
  modified_base (241)..(241): a, c, t, g, unknown or other
  misc_feature (241)..(241): n is a, c, g, or t
  modified_base (325)..(325): a, c, t, g, unknown or other
  misc_feature (325)..(325): n is a, c, g, or t
  modified_base (332)..(332): a, c, t, g, unknown or other
  misc_feature (332)..(332): n is a, c, g, or t
tcagagcactgtagcacgaccggtgctcgatttagtgtcgtcgcaagagagagggggtgggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctggagatgcattgaccaaaaaatntgcttattggtaccagcagaagtcaggccaggccccaaaatggtcatctatgaagacgacaaacgaccctccgggatccctganagattcncctggctccagctcgagggctatggccaccttgactatcagtgggacccagtggaggatgaagctgactactactagttactcaaatagagaacagtagataatttcgtaggttgttacgggcggagggacaaacgtgaccgtctagtcacgccaaggctcgcccctacggtcacctcgtcttcccc

SEQ ID NO: 319455 - DNA, 563 bp, Homo sapiens
  misc_feature: GZ8MTXP02GINA4.4.71.G05.1.454.CMB.2.raw
  modified_base (365)..(365): a, c, t, g, unknown or other
  misc_feature (365)..(365): n is a, c, g, or t
  modified_base (372)..(372): a, c, t, g, unknown or other
  misc_feature (372)..(372): n is a, c, g, or t
tcagagcactgtagcacgaccggtgctcgatttagtgtcgtcgcaagagagagggggaagaccgatgggcccttggtggaggcttggtgaagccggggggtcccttagactctcctgtgcagtctctggactcaacctcaaaaatgcctggatgacctgggtccgccagactccagggaagggctgcagtgggttggccgtattataaccaaacctgatggtgagacaacagactacgctgcacccgtgaaaggcagattcaccatctcaagagatgattcaacgaacacgctgttttggaaatgaacagcctagaaaaccgaggacacagccgtttattctgttccacactcctgcctacaganatttcgnggactataaatcgccatatggacgtcgtggggaccaagggaccacagtcaccgtctcctcaacctccaccaacgggcccatccgtccttcccccgtggcccgccctgcctccgaggacgccacctccgagacgccacgacgccggtccccgtgggcctgcccgtaggtccaaggacctacgttccctaacg

SEQ ID NO: 319456 - DNA, 535 bp, Homo sapiens
  misc_feature: GZ8MTXP02ICJ1O.4.71.G05.1.454.CMB.2.raw
  modified_base (224)..(224): a, c, t, g, unknown or other
  misc_feature (224)..(224): n is a, c, g, or t
  modified_base (245)..(245): a, c, t, g, unknown or other
  misc_feature (245)..(245): n is a, c, g, or t
  modified_base (326)..(326): a, c, t, g, unknown or other
  misc_feature (326)..(326): n is a, c, g, or t
  modified_base (332)..(332): a, c, t, g, unknown or other
  misc_feature (332)..(332): n is a, c, g, or t
  modified_base (336)..(336): a, c, t, g, unknown or other
  misc_feature (336)..(336): n is a, c, g, or t
  modified_base (465)..(465): a, c, t, g, unknown or other
  misc_feature (465)..(465): n is a, c, g, or t
tcagagcactgtagcacgaccggtgctcgatttagtgtcgtcgcaagagagagggggtggggctcaggaggcagagctctgggaatctcaccatggcctggacccctctcctgcctccccctcctcactttctgcacagtctctgaggcctcctatgagctgacacagcccaccctcggtgtcagtgtccccaggacaaacggccaggatcacctgctctgganatgcattgaccaaaaaaaatntgcttattggtaccagcagaaagtcaggccaggaccccaaaattggcatctatgaagacgacaaaacgccctcgggatccngagagnttcncctggcctccagctcgagggctatggccctaacttgactatcagtgggacccaagtggaggatgaagctagactactactgttactacaattaagagaacagtagaattaatttgtgggttgttcgggngaacgggaccaaagtgaacctcgacgtcgacaccgaagcgtacgccccgtcgaccactcctcgtcccccg

SEQ ID NO: 319457 - DNA, 612 bp, Homo sapiens
  misc_feature: GZ8MTXP02GLK5K.4.71.G05.1.454.CMB.2.raw
  modified_base (224)..(224): a, c, t, g, unknown or other
  misc_feature (224)..(224): n is a, c, g, or t
  modified_base (244)..(244): a, c, t, g, unknown or other
  misc_feature (244)..(244): n is a, c, g, or t
  modified_base (341)..(341): a, c, t, g, unknown or other
  misc_feature (341)..(341): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggatcacctgctctgganatgcattgaaccaaaaaatntgcttattggtaccagcagaagtcagccaggaccccaaaattggcatctatgaagacgaacaaaccgaccctaccgggactcccgtagagagattcnctggctcagctcgagggactagcggacctaccttgaactatcgagtcggggacccaaggtcggaggatagaagcgtagactactacttagttactactaaatagaacgaaacgagtagtaattaaagtttcgtaggggttcggttacgggacgggaacgggtaacccaaaacggttcggaacccggttaccgtaacgggttaccaaccggacccgaaacggccgtacccgtcccccgtacgggtccaccgttccgtaccgtttaccccccg

SEQ ID NO: 319458 - DNA, 659 bp, Homo sapiens
  misc_feature: GZ8MTXP02FG38L.4.71.G05.1.454.CMB.2.raw
  modified_base (240)..(240): a, c, t, g, unknown or other
  misc_feature (240)..(240): n is a, c, g, or t
  modified_base (242)..(242): a, c, t, g, unknown or other
  misc_feature (242)..(242): n is a, c, g, or t
tcagagcactgtagcacgaccggtgctcgatttagtgtcgtcgcaagagagagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaatntncttatgacagcagagcagcacgaccaaatgacatctatagaagacgaacaaaccgacccgtaccgggactcccgtagagagtacttctccgtcgcctcacgtctacgagggtactacgtcggtacctaccgttagaactagtacgtacgggtcggggacccgtaaggtaggaggtagtagaacgtcgtacgtaacctacgtacgttacgttactaacgtaaagtaagaagtaaacgtaaggtagtaaagttaaacgttttacggtaggggttacgggttacggggtacgggtaaacgggtaaaaccgtaaaacggtacggtaacccggttaccggtaacgggtaccgaccggaacccgaacggtaaccgtcccggtacccccgttcggtaccctaccgttccgttcccgttcccccg

SEQ ID NO: 319459 - DNA, 685 bp, Homo sapiens
  misc_feature: GZ8MTXP02I4SMN.4.71.G05.1.454.CMB.2.raw
  modified_base (239)..(239): a, c, t, g, unknown or other
  misc_feature (239)..(239): n is a, c, g, or t
  modified_base (257)..(257): a, c, t, g, unknown or other
  misc_feature (257)..(257): n is a, c, g, or t
tcagagcactgtagcacgaccggtgctcgatttagtgtcgtcgcaagagagagggggtgggctcaggaggcagagctctgggaatctcaccatggcctggacccctctcctgcctcccctcctcactttctgcacagtctctgaggcctcctatgagctgacacagccaccctcggtgtcagtgtcccaggacaaacggccaggatcacctgctctggagatgcattgaccaaaaaatntgtatatgtacagcagancacgccacgacctaagtgtacatctatagaagacgaacaaaccgacccgtaccggactccgtagagagtacttctccgtcggcctaccgagctacgaacgggtactacgtcggaccctaccgttgtaacctatacgtaacgggtcggggacccgtaaggtagggaaggtaagtaggaacgtacgtacgtaaccttacgttaacgttacgttaacctaacgtaaagtaacgaaagtaaacgtaagttaagtaattaacgtttacggttagggttacgggttaccgggacgggtaaacgggtaaaccgtaaaacggttaccggtaacccgttaccgttaacgggtaccgaaaccggtaacccgaacggtcccgtaccccggtacccccgttaccggtaccctacccgtttaccgttacccggttcccccg

SEQ ID NO: 319460 - DNA, 614 bp, Homo sapiens
  misc_feature: GZ8MTXP02G57L6.4.71.G05.1.454.CMB.2.raw
  modified_base (245)..(245): a, c, t, g, unknown or other
  misc_feature (245)..(245): n is a, c, g, or t
tcagagcactgtagcacgaccggtgctcgatttagtgtcgtcgcaagagagagggggtgggctcaggaggcagagctctgggaatctcaccatggcctggacccctctcctgcctccccctcctcactttctgcacagtctctgaggcctcctatgagctgacacacgccaccctcggtgtcagtcgtccccaggacaaacggccaggatcacctgctcgtggagatgcattgaaccaaaaaatntgtacttattggtaccagcagaagtcgaggaccacggaccccaaaagttcggtactatctaatagaaagaacgaacaaaaccgaccccgtaccgggactcccgtagagagtacttctccgtggcctcgagctacgagggactagtcggcctaccgttgactatcgaaggtcggggacccaggtaggaggatagaagtcagtaactactcttacgttactactaataagaagaaactagtagtaattaacgtttggtgggtggttcgggaacgggacggaaacgtaacgtcggtaaccgtacgttacggacacggacccgaacggccgtcccgtcccccgtcggtacctaccgttccgtccttacccccc

SEQ ID NO: 319461 - DNA, 561 bp, Homo sapiens
  misc_feature: GZ8MTXP02I6RX7.4.71.G05.1.454.CMB.2.raw
  modified_base (240)..(240): a, c, t, g, unknown or other
  misc_feature (240)..(240): n is a, c, g, or t
  modified_base (330)..(330): a, c, t, g, unknown or other
  misc_feature (330)..(330): n is a, c, g, or t
  modified_base (420)..(420): a, c, t, g, unknown or other
  misc_feature (420)..(420): n is a, c, g, or t
  modified_base (427)..(427): a, c, t, g, unknown or other
  misc_feature (427)..(427): n is a, c, g, or t
tcagagcactgtagcacgaccggtgctcgatttagtgtcgtcgcaagagagagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaatntgcttattggtaccagcagaagtcaggccaggccccaaaattggcatctatgaagacgacaaacgaccctcgggatccctgagagattcnctggctcagctcagggctatcggcctaccgttgactatcagtcggggacccaaggtgggaggatagaagctagactactactagttactnaataganacagtagattaattcgtgggtgttcgggacggtacgggaacctaaacgtcggacccgttaccgtacgggtccaacgtcccgaaaggccgtccggcccccgtacgggtcctaccgttccgttccgtttccccccg

SEQ ID NO: 319462 - DNA, 645 bp, Homo sapiens
  misc_feature: GZ8MTXP02H99HT.4.71.G05.1.454.CMB.2.raw
  modified_base (240)..(240): a, c, t, g, unknown or other
  misc_feature (240)..(240): n is a, c, g, or t
tcagagcactgtagcacgaccggtgctcgatttagtgtcgtcgcaagagagagggggtgggctcaggaggcagagctctgggaatctcaccatggcctggacccctctcctgctccccctcctcactttctgcacagtctctgaggcctcctatgagctgacacagccaccctggtgtcagtgtccccaggacaaacggccaggatcacctgctctggagatgcattgaccaaaaaaatntagtacttatgtacagacaagaagacgacggaccgaacggaacccctaaaagttcggtacaatactaatagaaacgaacgaacaaaaccgacccgtacgggactcccagagagtattctccgtcgcctccagtctacgacgggtactagtcgaccctaaccgttagaactatcgacggtacggggaccctaaggtaggaaggagtagaagtcgtacgtactaactaactacgttactactaaagtaaagaagtaaacgaagtagtaagttaaagtttacgttagggttaggttacgggtacgggaacggtaaaccgtaaaacgtacgtaaccgtaccgtacgtacgtacgaaccgaacgaaccgtaccgtacccgtaccgtaccgtacctaccgttaccgtcccg

SEQ ID NO: 319463 - DNA, 687 bp, Homo sapiens
  misc_feature: GZ8MTXP02JQZOA.4.71.G05.1.454.CMB.2.raw
  modified_base (241)..(241): a, c, t, g, unknown or other
  misc_feature (241)..(241): n is a, c, g, or t
  modified_base (331)..(331): a, c, t, g, unknown or other
  misc_feature (331)..(331): n is a, c, g, or t
tcagagcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaatntgcttatggtaccagcagaagtcaggccaggaccccaaattggtcatctatgaagacgacaaacgaccctcgggatccctgagagattcncctggctcagctcgagggtctagtcggcctaccgttgactatcgagtcggggacccaaggtcgggaggagtaggaacgtcgtacggtaaccttacgttaacttggttaacctactaaagttaacggaagtaaacgtagtagtaatttaaagttttaccggtagggggtttacggtttacggggacggggaacggggtaaaccccgtaaaacggttccgggtaaaccccggttacccggttaaacgggttacccgaaccgggtacccccgaaaacggggtcccgttaccccggggtcccccccgttaccggggtaccccttaacccggttcccgtttacccggttttccccccccgg

SEQ ID NO: 319464 - DNA, 670 bp, Homo sapiens
  misc_feature: GZ8MTXP02G5TRF.4.71.G05.1.454.CMB.2.raw
  modified_base (242)..(242): a, c, t, g, unknown or other
  misc_feature (242)..(242): n is a, c, g, or t
  modified_base (244)..(244): a, c, t, g, unknown or other
  misc_feature (244)..(244): n is a, c, g, or t
  modified_base (246)..(246): a, c, t, g, unknown or other
  misc_feature (246)..(246): n is a, c, g, or t
  modified_base (259)..(259): a, c, t, g, unknown or other
  misc_feature (259)..(259): n is a, c, g, or t
  modified_base (283)..(283): a, c, t, g, unknown or other
  misc_feature (283)..(283): n is a, c, g, or t
  modified_base (286)..(286): a, c, t, g, unknown or other
  misc_feature (286)..(286): n is a, c, g, or t
tcagagcactgtagcacgaccggtgctcgatttagtgtcgtcgcaagagagagggggtgggctcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggatcacctgctctggagatgcattgaccaaaaaatntntnttagtcgacaganagagcagcacgacctaatgacatntanagaagacaacgaaccgacccgtacggactccgtagaagagtacttcgtccgtcgcctaccgacgtccgtacgacgggtactacgtaccggaccctaccgttacgtaacttacgtaccggtacggggtccggggaacccgtaagggtacgggaggtaagtaggaacggtcgtaacggtaaccttaacgttaacgttacgttaacctaactaaagtaagaaacgtaacgtaagtaagtaatttaacgtttcggtagggttacgggttacgggacggggtaacggaaaccgtaaacggtacgtaacccggtacgttaacggtaccgaacgtacccgtaacggtccgtcccgtccccgtacgtacctaccgttccgttcccgtccccg

SEQ ID NO: 319465 - DNA, 657 bp, Homo sapiens
  misc_feature: GZ8MTXP02GSFV9.4.71.G05.1.454.CMB.2.raw
  modified_base (224)..(224): a, c, t, g, unknown or other
  misc_feature (224)..(224): n is a, c, g, or t
  modified_base (244)..(244): a, c, t, g, unknown or other
  misc_feature (244)..(244): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggatcacctgctctgganatgcattgaaccaaaaaatntgacttagttcggtaccagcaagaagtcgaggaccaacggacccctaaaagttcggtacatctagtagaaacgaaccgaacaaaaccgaccccgtccgggaactcccgtaggaacgtagtactttctaccgtcggacctccgaagtcctacggaagggtacctagtcggaccctacgttgactatcgaggtcgggaccaaggtggagagtgaagctagtactactactagttaactactaaagtagaagaacgtagtagtaattaagtttcggtaggggttcgttacggggacgggaacggtaaaccgtaaacgtcggtaacccgttacggtaacggtaccgaaccggtacccgtaacggcccgtacccgcccccgttacggtaccctaccgttcccgttccgtttccccccg

SEQ ID NO: 319466 - DNA, 622 bp, Homo sapiens
  misc_feature: GZ8MTXP02GUG50.4.71.G05.1.454.CMB.2.raw
  modified_base (242)..(242): a, c, t, g, unknown or other
  misc_feature (242)..(242): n is a, c, g, or t
  modified_base (353)..(353): a, c, t, g, unknown or other
  misc_feature (353)..(353): n is a, c, g, or t
  modified_base (422)..(422): a, c, t, g, unknown or other
  misc_feature (422)..(422): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctggagatgcattgaccaaaaaatntgcttatggtacaagcagaagtcaggccaggccccaaaattggtcatctatgaagacgacaaacgaccctcgggatccctgagagattctctggctccagctcagggctanggccaccttgactatcagtgggacccaagtggagatgaagctgactactactagttactacaaataganaaacgagtagaattaaatttcgtagggttggtttacgggacggggtaaacgggaaccgtaaaacgtcggtaaaccccggttaccgttaaacgggttaccgaaccggacccccgaaaacggggtcccgttacccgggtccccccccgtttacgggggtacccctaacccgtttacccgttcccggttttaacccccccccg

SEQ ID NO: 319467 - DNA, 748 bp, Homo sapiens
  misc_feature: GZ8MTXP02GXXK9.4.71.G05.1.454.CMB.2.raw
  modified_base (244)..(244): a, c, t, g, unknown or other
  misc_feature (244)..(244): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctggagatgcattgaccaaaaaatntgtcttattggtaccagcagagtcaggccaggaccccaaattggacatctatagaagacgaacaaaccgaccccgtaccgggactccccgtagaagacgtactttctaccgtcgggacctcccgaagtccttacggaacggggtaccttagtacgggtacccctaacccgtttggaaacctttacgtaccgtaaacggggttccgggggacccccgtaaaggggtcggggaagggtaagttagggaaacggtcgttacggaaccttaaccgttacgttacggtttaacctactaaaacgttaaggaaagtaaaccgtaaggtaagttaaatttaaacgtttcggtaagggggttcggttacgggggacgggtaacggggtaaacccgtaaaacgtcggtaaaccccgttaccggtacggtacccgaaccggacccgaaacgggtcccgtacccggtaccccccgttcgggtaccctaccgttcccgttacccggtttccccccg

SEQ ID NO: 319468 - DNA, 739 bp, Homo sapiens
  misc_feature: GZ8MTXP02JZVQM.4.71.G05.1.454.CMB.2.raw
  modified_base (243)..(243): a, c, t, g, unknown or other
  misc_feature (243)..(243): n is a, c, g, or t
tcagagcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcacctgctctggagatgcattgaaccaaaaaatntgcttattggtaccagcagaagtcaggccaggaccccaaaattggtacatctatagaagacgaacaaacgaccccgtcgggactccctagagagacttctctcggctccagctcgagggactagtcggccctaccgtttgaacttagtacgacgggttcgggggaccccgtaaagggttacggggaagggtagtacggaacggtacgttacggaaccttaacgtaacgtttacggtttaaacctaccgtaaaagttaagaaacggtaaacgtaaggttaagtaagtttaaaacgttttccgggtttaggggttacgggtttacccggggaacgggggtaaaccggggtaaaaccccgtaaaaccggttaccgggaaaccccgggtttaccggttaacgggttaccgtaaaccggacccccggaaacgggtcccgttacccggtaccccccggttccgggtaccctacccgtttcccgttaccggtttacccccccg

SEQ ID NO: 319469 - DNA, 655 bp, Homo sapiens
  misc_feature: GZ8MTXP02JUBF3.4.71.G05.1.454.CMB.2.raw
  modified_base (242)..(242): a, c, t, g, unknown or other
  misc_feature (242)..(242): n is a, c, g, or t
  modified_base (275)..(275): a, c, t, g, unknown or other
  misc_feature (275)..(275): n is a, c, g, or t
  modified_base (278)..(278): a, c, t, g, unknown or other
  misc_feature (278)..(278): n is a, c, g, or t
  modified_base (281)..(281): a, c, t, g, unknown or other
  misc_feature (281)..(281): n is a, c, g, or t
tcagagcactgtagcacgaccggtgctcgatttagtgtcgtcgcaagagagagggggtgggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctggagatgcattgaccaaaaaaatngcttatgacagcagagcagccacgaccaaatgnatntanagaagacgaacaaaccgacccgtacgggactccgtagagagtacttctccgtgcctacgagtctacgagggtactagtcgaccctacttgaactatacgacggtacggggacccaaggtgggaaggagtagaagtctagaactactactagttaactaactaaagtaacgaagaaacgtaagtagtaaagtttaacgtttcggtagggttacggttaccggggacgggtaaacgggtaaaaccgtaaaacggtacggtaaaccccggttaaccgttaacgggtaccgaaccggtaccccgaaacgggtaacccgtaccccggtacccccgttaccgggtaccctacccgttacccgttaccccgttaacccccg

SEQ ID NO: 319470 - DNA, 608 bp, Homo sapiens
  misc_feature: GZ8MTXP02HAIPA.4.71.G05.1.454.CMB.2.raw
  modified_base (362)..(362): a, c, t, g, unknown or other
  misc_feature (362)..(362): n is a, c, g, or t
  modified_base (368)..(368): a, c, t, g, unknown or other
  misc_feature (368)..(368): n is a, c, g, or t
  modified_base (372)..(372): a, c, t, g, unknown or other
  misc_feature (372)..(372): n is a, c, g, or t
  modified_base (379)..(379): a, c, t, g, unknown or other
  misc_feature (379)..(379): n is a, c, g, or t
  modified_base (388)..(388): a, c, t, g, unknown or other
  misc_feature (388)..(388): n is a, c, g, or t
  modified_base (422)..(422): a, c, t, g, unknown or other
  misc_feature (422)..(422): n is a, c, g, or t
  modified_base (485)..(485): a, c, t, g, unknown or other
  misc_feature (485)..(485): n is a, c, g, or t
tcagagcactgtagcacgaccggtgctcgatttagtgtcgtcgcaagagagagggggaagaccgatgggcccttggtggaggcttggtgaagccggggggtcccttagactctcctgtgcagtctctggactcaacctcaaaaatgcctggatgacctgggtccgccagactccagggaaggggctgcagtgggttggtcgtattataaccaaacctgatggtgagacaacagactacgctgcaccgtgaaaggcagattcaccatctcaagagatgattcaaacgaacacgcttagttttaggaaatgaacagcctagaaaaccgaggacacagtccgtttaatttctgttccacactccngcctanaganatttcgngactataancgaccatatggacgtctggggccaaagggaccanagtcaaccgtctcctacaaccctcaaccgaaacgggcccaacgttccggtccctttcccccgnggcccgccccgtcgccctccgacggacgcccacccgtcccggagacgaccaaccgacggcccgggacccctggggccttcggccgtacggtacaaacgggtacccttacccgtttacccaacg

SEQ ID NO: 319471 - DNA, 550 bp, Homo sapiens
  misc_feature: GZ8MTXP02FV84M.4.71.G05.1.454.CMB.2.raw
  modified_base (241)..(241): a, c, t, g, unknown or other
  misc_feature (241)..(241): n is a, c, g, or t
  modified_base (425)..(425): a, c, t, g, unknown or other
  misc_feature (425)..(425): n is a, c, g, or t
  modified_base (434)..(434): a, c, t, g, unknown or other
  misc_feature (434)..(434): n is a, c, g, or t
tcagagcactgtagcacgaccggtgctcgatttagtgtcgtcgcaagagagagggggtgggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctggagatgcattgaccaaaaaatntgcttattggtaccagcagaagtcaggccaggccccaaaattggcatctatgaagacgacaaacgaccctaccgggatccctgagagattctcctggcctcagctcgagggtctatcggaccaccttgactatcaggtggggacccaagtggaggataggaagctgactactactgttaactanaactagaanaacgagtagaattaatttcgtagggtgttacgggaggacggaccaaagtcgaccgtacgtacggtcgacgcccgaaggccgtacgcccccgtacggtccactccgtcgttcccccg

SEQ ID NO: 319472 - DNA, 625 bp, Homo sapiens
  misc_feature: GZ8MTXP02F1087.4.71.G05.1.454.CMB.2.raw
  modified_base (242)..(242): a, c, t, g, unknown or other
  misc_feature (242)..(242): n is a, c, g, or t
tcagagcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaaccaaaaaatntgcttattggtaccagcagaagtcaggccaggccccaaaattggacatctatagaaagacgaacaaaaccgaccccgtacccgggatccccgtgaacgagattcctctggcctcagctaccgagggctagtcggacctacccttgaactatcaggtcgggacccaaggtaggaaggtagtagaacgtcgtaggtaacctaactacgttagttaacctacgtaaagtagaagaaactaggtagtaattaagtttcgtaggggttacgtttcggggacggtaacgggaaaccgtaaacgtcggtaacccgtacgttaacggtaccaacggcccgtaaaaggccgtaccgccccgttacggtcctaccgttccgtcgtttcccccg

SEQ ID NO: 319473 - DNA, 576 bp, Homo sapiens
  misc_feature: GZ8MTXP02JAZAB.4.71.G05.1.454.CMB.2.raw
  modified_base (241)..(241): a, c, t, g, unknown or other
  misc_feature (241)..(241): n is a, c, g, or t
tcagagcactgtagcacgaccggtgctcgatttagtgtcgtcgcaagagagagggggtgggctcaggaggcagagctctgggaatctcaccatggcctggacccctctcctgctccccctcctcactttctgcacagtctctgaggcctcctatgagctgacacagcccaccctcggtgtcagtgtccccaggacaaacggccaggatcacctgctctggagatgcattgaccaaaaaatntgcttattggtaccagcagaagtcagccaggccccaaaatggtcatctatgaagacgacaaacgaccctccgggatccctgagagattctcctggcctccagctcagggctatggccaccttgactatcgagtggggacccaaggtcggaggagtgaagctgactactatagttactcaatagagaacagtagtaataatttcgtgggttgttcgggacggaacggggtacccaaaacgttcggaacccgttaccgtaacgggttaccaacggtaccccgaaacggccgtaccggaccccccgtcggtaccacccgttccttcggtttacccccc

SEQ ID NO: 319474 - DNA, 638 bp, Homo sapiens
  misc_feature: GZ8MTXP02FL479.4.71.G05.1.454.CMB.2.raw
  modified_base (243)..(243): a, c, t, g, unknown or other
  misc_feature (243)..(243): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctggagatgcattgaccaaaaaaatntgtacttatgtacagacaagagcagaccacgaccctaaagtgacatctatagaagaacgaacaaaccgacccgtaccgggactcccgtagacgagtacttctccgtcggcctacgacgtctacgacgggtactagtcggacctaccgttagaactacgtcgtacgggtcggggacccgtaagggtagggaaggtaagtaggaacgtcgtacgtaacttactacgttagttaactacaagtaagaagaacgtagtagtaagtttaacgtttcggtagggttcggttacgggacgggaacggtaaccgtaaacgtacggtaccgtacgtacggtaccgacgacccgaacggtccgtacccggccccgtacggtacctaccgtccgttcccgtacccc

SEQ ID NO: 319475 - DNA, 584 bp, Homo sapiens
  misc_feature: GZ8MTXP02HMN2J.4.71.G05.1.454.CMB.2.raw
  modified_base (369)..(369): a, c, t, g, unknown or other
  misc_feature (369)..(369): n is a, c, g, or t
  modified_base (375)..(375): a, c, t, g, unknown or other
  misc_feature (375)..(375): n is a, c, g, or t
  modified_base (496)..(496): a, c, t, g, unknown or other
  misc_feature (496)..(496): n is a, c, g, or t
tcagagcactgtagcacgaccggtgctcgatttagtgtcgtcgcaagagagagggggaagaccgatgggcccttggtggaggcttggtgaagccggggggtcccttagactctcctgtgcagtctctggactcaacctcaaaaatgcctggatgacctgggtccgccagactccagggaaggggctgcagtgggttggccgtattataaccaaacctgatggtgagacaacagactacgctgcacccgtgaaaggcagattcaccatctcaagagatgattcaacgaacacgctgttttggaaatgaacagcctagaaaaccgaggacacagccgttttattctgttccacactccctgcctacagagntttcgngactatatcgccatatggacgtcgtaggggaccaaaggggaccaacgtagtacacccggtctccctaccaaacccttcccaacccgaaacgggccccaagttcccggtccctttcccccgngccgccctagccgtccaggacgcaaccctcgacgacgcaacgtcgccggccctgggctcgccctggtacaacggcctacttcctaacg

SEQ ID NO: 319476 - DNA, 575 bp, Homo sapiens
  misc_feature: GZ8MTXP02F9EMT.4.71.G05.1.454.CMB.2.raw
tcagagcactgtagcacgaccggtgctcgatttagtgtcgtcgcaagagagagggggaagaccgatgggcccttggtggaggcttggtgaagccggggggtcccttagactctcctgtgcagtctctggactcaacctcaaaaatgcctggatgacctgggtccgccagactccagggaagggctgcagtgggttggccgtattataaccaaacctgatggtgagacaacagactacgctgcaccgtgaaaggcagattcaccatctcaagagatgattcaacgaacacgcttgttttggaaatgaacagcctagaaaaccgaggacacagtccgtttattctgttccacactcctgcctacagagtatttcgtggacttataaactcgacctaatacgtgggaacgtcgtggggacccaaaggggaccaacagtccaccgtctccctacaaccctccaaccgaacgggcccacgtccggtcccttccccgtggcccgccctgcctccagcgcacctcgacgcgcacgacgccgccctgggctcgcctcggtacaggtacctaccgttcctaacg

SEQ ID NO: 319477 - DNA, 641 bp, Homo sapiens
  misc_feature: GZ8MTXP02JGEM1.4.71.G05.1.454.CMB.2.raw
  modified_base (224)..(224): a, c, t, g, unknown or other
  misc_feature (224)..(224): n is a, c, g, or t
  modified_base (244)..(244): a, c, t, g, unknown or other
  misc_feature (244)..(244): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggatcacctgctctgganatgcattgaaccaaaaaatntgcttatggaaccagcagaagtcaggccaggaccccaaattggacatctatagaagacgacaaacgaccctaccgggactcccgtagacgagattctccgtaggcctccaagctacgaagggtcctaagtcgggaccctaccgttgaaccttagtaccgtaggggttcgggggacccctaaagggtgggaaggtagtagaacgtctaggtaactactactacgttactacaaataagaagaacgtaagtagtaattaatttacggtggggttacggtttacggggacgggtaacggtaaaccgaacgtacggtacccgtacgtacgggtacaccggacccgaaggtccgtacccggtcccccgttacgggcctaccgtttccggtacctttaccccc

SEQ ID NO: 319478 - DNA, 603 bp, Homo sapiens
  misc_feature: GZ8MTXP02GGQA9.4.71.G05.1.454.CMB.2.raw
  modified_base (243)..(243): a, c, t, g, unknown or other
  misc_feature (243)..(243): n is a, c, g, or t
  modified_base (286)..(286): a, c, t, g, unknown or other
  misc_feature (286)..(286): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctggagatgcattgaccaaaaaaatntgtcttatgacagcagagcagcacgacctaaagtgacatctanagaagacgaacaaaccgacccgtacgggactccgtagagagtacttctccgtgcctacgagtctacgacgggtactagtcggacctacgttagaactatcgagggtcgggacccgaaggtagggaggagtagaagtctacgaacttactacgttagttactactaaagtagaagaacgtagtagtaatttagtttacggtggggttcggttacgggacgggtaacggtaaaccgtaaacgtacggtaaccgtacgtacggtacgacgaccgacggtccgtcccgtccccgtacgtaccaccgtccgttaccgtcccc

SEQ ID NO: 319479 - DNA, 541 bp, Homo sapiens
  misc_feature: GZ8MTXP02H8G96.4.71.G05.1.454.CMB.2.raw
  modified_base (221)..(221): a, c, t, g, unknown or other
  misc_feature (221)..(221): n is a, c, g, or t
  modified_base (240)..(240): a, c, t, g, unknown or other
  misc_feature (240)..(240): n is a, c, g, or t
  modified_base (299)..(299): a, c, t, g, unknown or other
  misc_feature (299)..(299): n is a, c, g, or t
tcagagcactgtagcacgaccggtgctcgatttagtgtcgtcgcaagagagagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctgganatgcattgaccaaaaaatntgcttatggtaccagcagaagtcaggccaggccccaaaattggcatctatgaagacganaaaacgccctcgggatccctgagagattctctggctccagctcagggctatggccacttgactatcagtgggcccagtggagatgagctagactactactgttactacaaatagagaacagtagtataaatttcgtagggttgtttcggacgggtaggggtaaccaaaacgttgaaccgtccgtaacggtcaacgccgaaacggcgtcgcccccgtcgtcgaccttccgtacgtttcccccg

SEQ ID NO: 319480 - DNA, 600 bp, Homo sapiens
  misc_feature: GZ8MTXP02GCROL.4.71.G05.1.454.CMB.2.raw
  modified_base (243)..(243): a, c, t, g, unknown or other
  misc_feature (243)..(243): n is a, c, g, or t
  modified_base (245)..(245): a, c, t, g, unknown or other
  misc_feature (245)..(245): n is a, c, g, or t
  modified_base (263)..(263): a, c, t, g, unknown or other
  misc_feature (263)..(263): n is a, c, g, or t
  modified_base (282)..(282): a, c, t, g, unknown or other
  misc_feature (282)..(282): n is a, c, g, or t
tcagagcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaaattntntacttagtgacagcagancagaccacgaccaaagtgnatctatagaagacgaacaaaccgacccgtacggactccgagacgagtacttctccgtcgcctacgagtctacgacgggctagtcggacctactacgactatcgaggtcgggaccaaggtaggaggagtagaagtctagtaacttactacgttagttaactacaaagtaagaagaaacgtagtagtaagttaagtttcggttgggttaggttacgggacgggtaacggtaaacctaaacgtcggaccgttacgtacggtacgaccgaccgacggtccgtaccgccccgttacggtacctaccgttcgttaccgttcccc

SEQ ID NO: 319481 - DNA, 621 bp, Homo sapiens
  misc_feature: GZ8MTXP02IOZO9.4.71.G05.1.454.CMB.2.raw
  modified_base (241)..(241): a, c, t, g, unknown or other
  misc_feature (241)..(241): n is a, c, g, or t
tcagagcactgtagcacgaccggtgctcgatttagtgtcgtcgcaagagagagggggtgggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctggagatgcattgaccaaaaaatntgcttatggtaccagcagaagtcagccaggaccccaaaatggtacatctatagaaagacgaacaaaaccgacccctacgggactccctagagagaattctacccgtggcctccagctacgaaggggacctaagtcggaccctaccttgaactatcgaagtcggggacccgaaggtggaggagtagaagactagactactaactagttactacaaagtagaagaaacgaagtagaattaaagtttagtgggttaggtttacgggacgggaacggtaaaccggggggaaaactacggaacccgttaccgtacggttaccgacgacccgaacggaaccgtccgacccccgtaccggtccgaccttcccgtccgtttacccccc

SEQ ID NO: 319482 - DNA, 641 bp, Homo sapiens
  misc_feature: GZ8MTXP02JRDOB.4.71.G05.1.454.CMB.2.raw
  modified_base (250)..(250): a, c, t, g, unknown or other
  misc_feature (250)..(250): n is a, c, g, or t
  modified_base (440)..(440): a, c, t, g, unknown or other
  misc_feature (440)..(440): n is a, c, g, or t
  modified_base (490)..(490): a, c, t, g, unknown or other
  misc_feature (490)..(490): n is a, c, g, or t
  modified_base (617)..(617): a, c, t, g, unknown or other
  misc_feature (617)..(617): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcactgctcgtggagatgactattagaaaccaaaaaaatntagtacttagttaggtaaccagacaagaaagtcgacggaccaacggacccctaaaagttcggtacatctaatagaaagacgaacaaaccgacccgtacccgggactcccgtaggaacgaagtactttcctacccgtcggtcctaccgacgtccgtacgacgggtactacgtcggaccctacttagactancgaggtcgggaccaggtggagagtagagctagactactacttagtactanaagtagaagaacgtagtagtaattacgtttcgtgggtcggttacgggaggtacgggaaccaaacgtcggaccgttacggacgtaccgacggtaccgaacggtccgtcccggtccccgtacggtaccnccgtttaccgtcccgttacccccg

SEQ ID NO: 319483 - DNA, 650 bp, Homo sapiens
  misc_feature: GZ8MTXP02JUFN5.4.71.G05.1.454.CMB.2.raw
  modified_base (243)..(243): a, c, t, g, unknown or other
  misc_feature (243)..(243): n is a, c, g, or t
  modified_base (480)..(480): a, c, t, g, unknown or other
  misc_feature (480)..(480): n is a, c, g, or t
tcagagcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcacctgctctggagatgcattgaaccaaaaaatntgcttattggtaccagcagaagtcaggccacggaccccaaattggtcatctatagaagacgaacaaacgacccctcgggactcccagagagacttctctcggcctccagtctcgacgggtactacgtcggaccctaccgttgaaccttatccgaggttcggggacccgtaagggtcgggaaggtagtaggacgacgttacgaacttactacgttagttaacctacgtaaataggaanaaacgtagtagtaaatttaagtttacggttagggtacggtttacggggacgggtaaacgggaacccgtaaaacgttacggaaccccgttcgtaaacgggtccgaccggtacccgaaaggtcccgtaccgcccccgttccggtcctaccgtttcccgtccgttcccccccg

SEQ ID NO: 319484 - DNA, 773 bp, Homo sapiens
  misc_feature: GZ8MTXP02INE0Q.4.71.G05.1.454.CMB.2.raw
  modified_base (226)..(226): a, c, t, g, unknown or other
  misc_feature (226)..(226): n is a, c, g, or t
  modified_base (248)..(248): a, c, t, g, unknown or other
  misc_feature (248)..(248): n is a, c, g, or t
tcagagcactgtagcacgaccggtgctcgatttagtgtcgtcgcaagagagaggggggtgggctcaggaggcatagctctgggaatctcaccatggcctggacccctctcctgcctccccctcctcacttttctgcacagtctctgaggcctcctatgagctgacacagccaccctcggtgtcagtcgtccccaggaacaaacggccaggatcacctgctctgganatgcattgaaccaaaaaaattntagtacttagttacggaaccagacaagaacgtcgacggaccgaacggaacccctaaaagttcggtacattactaagacggaaacgaaccgaaaccgaaaacccggtaccccgtaccgggacctaccgtaggaacgtacgtacttccgtaccgtcggtacctaccgacgaccgtacggaacgggtactacggtcggaccctaccgttacgaactacgtacggtaacgggtaccggggtaacccgtaaaggggtagggaaggtaagtaggaacggtacgtacgtaaaccttacgttaaccgttacgttaactaacgtaaaagtaggaaacgtaacgtagttaagttaagtttaacgtttcgggttacgggggttacggttaccggggaacggggtaacgggtaaaacccgtaaaacggtccggtaacccggtaccggttaacggtaccgaaccggaccccggaacgggtcccgtaccccggtacccccgttaccggtaccctacccgttccgttaccccgtaccccc

SEQ ID NO: 319485 - DNA, 679 bp, Homo sapiens
  misc_feature: GZ8MTXP02F5TPH.4.71.G05.1.454.CMB.2.raw
  modified_base (245)..(245): a, c, t, g, unknown or other
  misc_feature (245)..(245): n is a, c, g, or t
  modified_base (356)..(356): a, c, t, g, unknown or other
  misc_feature (356)..(356): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggatcacctgctctggagatgcattgaaccaaaaaaatntgcttattggtaccagcaagaagtcaggccacggaccccaaaattggacatctatagaaagacgaacaaaaccgaccccgtaccggggactcccgtagaacgagtacttcncctggcctcgagctcgaagggctagtcggacctaccgttgaactatcgaagggtcggggacccgaaagggtggaaggtagtaggaaacgtctacggaactacgtacgttagttaacctacgtaaagtaggaacgaaacgtagtaagtaatttaaagtttcggttaaggggttcggtttacggggacggggtaacggggtaaaccgtaaaacggttacggtaacccggttaccgttaacggttaccgaaccggaacccgtaaacggtccgtacccgtcccccgttacggtaccctaccgtttaccgttcccgtttaaccccccg

SEQ ID NO: 319486 - DNA, 677 bp, Homo sapiens
  misc_feature: GZ8MTXP02I8LTH.4.71.G05.1.454.CMB.2.raw
  modified_base (246)..(246): a, c, t, g, unknown or other
  misc_feature (246)..(246): n is a, c, g, or t
tcagagcactgtagcacgaccggtgctcgatttagtgtcgtcgcaagagagagggggtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctggagatgcattgaaccaaaaaaattntgtactttagttacggtaaccagacaagaagtcgaacggacccgaaccggaacccctaaaagttcggtactattactaagtacggaaacgaaccgaaaccgaaaacccggaccccgtacccgggactcccgtaggaacgtagtacttcctccgtcggcctccacgctacgacgggtactacgtcgaccctaccgttagactactcgaggtcgggaccaaggtgggaggagtagacgcgtagaactactacgttacgttactacgaagtagaagaacgtagtagtaagttagtttcggttggggttacggttacgggacgggtaacggtaaccgtaacgtaccggtacccgtacgtacggtaccgtaccgacccgtaacggtcccgtcccggtccccgtaccggtacctaccgttcccgttaccgtcccccg

SEQ ID NO: 319487 - DNA, 710 bp, Homo sapiens
  misc_feature: GZ8MTXP02JUGC6.4.71.G05.1.454.CMB.2.raw
  modified_base (224)..(224): a, c, t, g, unknown or other
  misc_feature (224)..(224): n is a, c, g, or t
  modified_base (245)..(245): a, c, t, g, unknown or other
  misc_feature (245)..(245): n is a, c, g, or t
tcagagcactgtagcacgaccggtgctcgatttagtgtcgtcgcaagagagaggggggtgggctcaggaggcagagctctgggaatctcaccatggcctggacccctctcctgctccccctcctcactttctacacagtctctgaggcctcctatgagctgacacagcccaccctcggtgtcagtcgtccccaggacaaacggccaggatcacctgctctgganatgcattagaaccaaaaaatntgtacttagtacgacagacagagcacgaccgacgaccctaaagtcgtacatctagagaacgaaccgaacaaccgaccccgtaccggactacccgtagacgtagtacttccgtcgtccggtcctaccgacgtctacgacgggtactcgtccggaccctacgttacgaaccttacgtccgtacggggtaccgggtaacccgtaaggtacgggaaggtagtaggacgtcgtacgtaactacttacgttagttaacctacgtaaagtacgaacgtaacgtaggttaagtaacgtttaacgtttacgggttacggggttacgggttaccggggaacggggtaacgggtaaacccgtaaccggtaccggtaacccgtaccggtacggtaccgaccggtacccgtaacggtcccgtccccggtacccccgtacgtaccctaccgttacccgttacccgtaccccctaccccg

SEQ ID NO: 319488 - DNA, 603 bp, Homo sapiens
  misc_feature: GZ8MTXP02FWQ82.4.71.G05.1.454.CMB.2.raw
  modified_base (243)..(243): a, c, t, g, unknown or other
  misc_feature (243)..(243): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggatcacctgctctggagatgcattgaccaaaaaatntgcttattgtaccagcagaagtcaggccaggaccccaaaattggcatctatagaagacgaacaaaccgaccccgtacgggactcccgtagagagattctccgtgcctccagtctacgagggtactagtcggcctaccttgaaccttagtccgaggtcggggaccctaaggtcgggaggagtagaagctagactactatacgttacactaaagtagagaaacgtagtagtaattaagtttcgtgggtagttacgggacgggtaacggaactaaacggtcgtacccggttacgtacggtacgaaccgtaccgaacggccgtaccgacccccgtcggtacctaccgtcctaccgttacccccg

SEQ ID NO: 319489 - DNA, 615 bp, Homo sapiens
  misc_feature: GZ8MTXP02HJXHX.4.71.G05.1.454.CMB.2.raw
  modified_base (249)..(249): a, c, t, g, unknown or other
  misc_feature (249)..(249): n is a, c, g, or t
  modified_base (489)..(489): a, c, t, g, unknown or other
  misc_feature (489)..(489): n is a, c, g, or t
  modified_base (510)..(510): a, c, t, g, unknown or other
  misc_feature (510)..(510): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctggagatgctattagaacctaaaaaaatntgtacttattggtaaccagcaagaagtcacggccacggaccccaaaagttcggacatactatagaacgaaccgaacaaaaccgaccccgtaccgggactcccgtagaacgtagtacttctaccgtcggcctaccgacgctacgagggtactagtcggaccctacgttgactatcgaggtccgggaccctaaggtgggaagagtagaacgctagactactactagttactacaagtagaanaagtagtataattagttcggngggttgtcgggaggaacggtaacctaacgtcgaccgtacgtacggtccaacgacccgaacggccgtcccgtaccccgtcggtacctccgtccttccggtcccccg

SEQ ID NO: 319490 - DNA, 866 bp, Homo sapiens
  misc_feature: GZ8MTXP02I5RYT.4.71.G05.1.454.CMB.2.raw
  modified_base (241)..(241): a, c, t, g, unknown or other
  misc_feature (241)..(241): n is a, c, g, or t
tcagagcactgtagcacgaccggtgctcgatttagtgtcgtcgcaagagagagggggtgggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcactgctctggagatgcattgaaccaaaaaatntgcttattggtaccagcagaagtcaggccaggaccccaaaatcggtacatctatagaaagacgaacgaaaaccgacccgtacccgggactcccctagaagtacgaattcctactcggcctccaacggtcctcgaacggggtaccttagttaccgggaccctaacccgtttggaaaccctttagttacccgaaacgggggttccgggggaaacccccgtaaaaggggttcgggggaaaacgggtaggtttaaacgggaaaagggtccgttaacggggtaaacccgtttaaaaccgttaacccttttaaagggttttaaaccccctttaaacgggaaaaaactttaaacgggggaaaactttaaaaacgggaaacggggtttaacgtaaaaacttttaaaacgggttttttcggttaaacggggggtttgggtttttaacccggggggtaaccgggggtaaaacgggggaaaacccccttaaaaagggttccgggtaaacccccgggtttaacccggtaaacggggttacccgaaccggtacccccgtaaaacgggcccgtttacccgggcccccccgtttacggggtaccctaacccttcccggtttaccccgtttaacccccccg

SEQ ID NO: 319491 - DNA, 555 bp, Homo sapiens
  misc_feature: GZ8MTXP02ISDT2.4.71.G05.1.454.CMB.2.raw
  modified_base (243)..(243): a, c, t, g, unknown or other
  misc_feature (243)..(243): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagcccaccctcggtgtcagtgtccccaggacaaacggccaggatcacctgctctggagatgcattgaccaaaaaatntgcttattggtacagcagaagtcagccaggccccaaatgcatctatgaagacgacaaacgacccctccgggatccctgagagattctctggctccagctcgagggctatcggaccaccttgactatcagtgggacccagtggagatagagctgactactacttgttactcaaatagagaacagtagtattaagtttcgtggggttgttacgggacgggacggtaacctaaacgtacggaccgttacgtacgtccgaacggccctaaggccgtccgcccccgttacggtcctaccgtccgttccgttcccccg

SEQ ID NO: 319492 - DNA, 555 bp, Homo sapiens
  misc_feature: GZ8MTXP02F0T12.4.71.G05.1.454.CMB.2.raw
  modified_base (241)..(241): a, c, t, g, unknown or other
  misc_feature (241)..(241): n is a, c, g, or t
tcagagcactgtagcacgaccggtgctcgatttagtgtcgtcgcaagagagagggggtgggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctggagatgcattgaccaaaaaatntgacttattggtaccagcagaagtcaggccaggaccccaaaattggtcatctatgaagacgacaaacgacccctacgggactccctgagagattctcctggcctaccagctacgaggggactagtcggaccctaccgttgaacttatcgaggtacggggacccaaggtggaggagtagaagctagacctactacttgttactacaatagaagaacagtagaattaagttcgtaggtgtcggcggaggaccaaacgtgaccgtctacggtcgacgcccgaagccgtcgaccccgtcggtcactcgtcgtaccccc

SEQ ID NO: 319493 - DNA, 597 bp, Homo sapiens
  misc_feature: GZ8MTXP02HESY0.4.71.G05.1.454.CMB.2.raw
  modified_base (223)..(223): a, c, t, g, unknown or other
  misc_feature (223)..(223): n is a, c, g, or t
  modified_base (343)..(343): a, c, t, g, unknown or other
  misc_feature (343)..(343): n is a, c, g, or t
  modified_base (375)..(375): a, c, t, g, unknown or other
  misc_feature (375)..(375): n is a, c, g, or t
  modified_base (402)..(402): a, c, t, g, unknown or other
  misc_feature (402)..(402): n is a, c, g, or t
  modified_base (516)..(516): a, c, t, g, unknown or other
  misc_feature (516)..(516): n is a, c, g, or t
tcagagcactgtagcacgaccggtgctcgatttagtgtcgtcgcaagagagagggggaagaccgatgggcccttggtggaggcttggtgaagccggggggtcccttagactctcctgtgcagtctctggactcaacctcaaaaatgcctggatgacctgggtccgccagactccagggaagggctgcagtgggttggccgtattataaccaaacctgatggtnagacaacagactacgctgcacccgtgaaaggcagattcaccatctcaagagatgattcaacgaacacgctgttttggaaatgaacagcctagaaaaccgaggacacagccgtttatttcngttccatacctcctgcctacagagtatttcgnggactataaatcgacataatggacgtntggggaccaaagggaccacagtcacccgtctccctacaaccctccaaccgaaacgggccccaagttcccggtcctttccccccgtggcccgccccttgcctcccgagggaaccnccacccgtacgacgcgacctacgacggccgtccgtggcctcgtccgtacggtacgaaacggtacctaccttacccgtaacg

SEQ ID NO: 319494 - DNA, 681 bp, Homo sapiens
  misc_feature: GZ8MTXP02HGZB6.4.71.G05.1.454.CMB.2.raw
  modified_base (267)..(267): a, c, t, g, unknown or other
  misc_feature (267)..(267): n is a, c, g, or t
tcagagcactgtagcacgaccggtgctcgatttagtgtcgtcgcaagagagagggggaagaccgatgggcccttggtggaggcttggtgaagccgggggggtcccttagactctcctgtgcagtctctggactcaacctcaaaaatgcctggatgacctgggtccgccagactccagggaaggggctgcagtgggttggccgtatataaccaaactgatggtgagacaacagactacgctgcaccgtgaaaggcagattcaccatcncaagagatgattcaaacgaacacgtcttagtttttaggaaaattgaaacaggtacctaagaaaacccgaggaaccacagtcccgttttatttctcgttaccacacttccctgccctacacgagtatttccgtaggaccttaattaaatccggacctaattacgtcggggaccgtcgtacgggggacccaaaagggggacccaacgtaacggtcctaacccgtcttcccttaaccaaaccccttacccaaaccccgaaaccggggacccccaaacgtttcccgggtccccttccccccggttcggccccgtccctcggccctccggacggacgcaccccgtcgaaacgcgcaacgcgccggtcccgtgggccttcgcccgtaggtaccgaaacggtccttaaccgtccctaacgg

SEQ ID NO: 319495 - DNA, 632 bp, Homo sapiens
  misc_feature: GZ8MTXP02HUG3Y.4.71.G05.1.454.CMB.2.raw
  modified_base (241)..(241): a, c, t, g, unknown or other
  misc_feature (241)..(241): n is a, c, g, or t
tcagagcactgtagcacgaccggtgctcgatttagtgtcgtcgcaagagagagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaaatntgacttattggtaccagcaagaagtcaggccaggaccccaaaattggtcatctatgaaagacgaacaaacgaccctccgggactccctagagagattctctggcctccagtctcgagggctagtcggccaccttgactatcagtcgggcccaagtgggagagtgaagctagacgtactactagttactactaaagtagaagaacgtagtagtaattaaagtttcgtaggggttgttacgggacggggtaacgggaaccgtaaaacgtacggtaacccgttaccggtaaacggttccgaaacccggtacccggaaacgggtaacccgttccggacccccccgttaccgggttacccgtacccgtttacccgtttcccggtttacccccccgg

SEQ ID NO: 319496 - DNA, 619 bp, Homo sapiens
  misc_feature: GZ8MTXP02FUNGR.4.71.G05.1.454.CMB.2.raw
  modified_base (331)..(331): a, c, t, g, unknown or other
  misc_feature (331)..(331): n is a, c, g, or t
  modified_base (511)..(511): a, c, t, g, unknown or other
  misc_feature (511)..(511): n is a, c, g, or t
  modified_base (517)..(517): a, c, t, g, unknown or other
  misc_feature (517)..(517): n is a, c, g, or t
tcagagcactgtagcacgaccggtgctcgatttagtgtcgtcgcaagagagagggggaagaccgatgggcccttggtggaggcttggtgaagccgggggggtcccttagactctcctgtgcagtctctggactcaacctcaaaaatgcctggatgacctgggtccgccagactccagggaaggggctgcagtgggtggccgtattataaccaaacctgatggtgagacaacagactacgctgcaccgtgaaaggcagattcaccatctacaagagatgattacaaacgaacacgtcttgttttaggaaatgaaacagcctaagaaaaccgngacacgagtccgtttattctcgttaccactacctccctgccctacagacgttatttcggtagtactataactcgacctaattacgtgggtaccgtcgtacgggggacccaaagggaccacgacgtccaccgtctccctacaaccctccaaccgaacggcctacgtccgtcccttccccgnggcccnccctcgcctccgacgtacgccaccgtaccggagacgaccaacgacggcccggtacccgtcgggcctcgccgtacggtacaacggtacctccgttaccctacg

SEQ ID NO: 319497 - DNA, 650 bp, Homo sapiens
  misc_feature: GZ8MTXP02HBZVA.4.71.G05.1.454.CMB.2.raw
  modified_base (223)..(223): a, c, t, g, unknown or other
  misc_feature (223)..(223): n is a, c, g, or t
  modified_base (243)..(243): a, c, t, g, unknown or other
  misc_feature (243)..(243): n is a, c, g, or t
  modified_base (245)..(245): a, c, t, g, unknown or other
  misc_feature (245)..(245): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctgganatgcattgaccaaaaaaatntntacttagtcgacagcagagtcagaccacgacctaaagtgacatactagagaacgacgaacaaaccgacccgtaccggactccgtagagagtacttctccgtcgcctcgagctacggacggtactacgtcggacctacgttagaacgtactcgacgggtcgggacccgtaaggtgggaagtagtagaacgtacgtacgtaactacgtacgtacgttactaacaaagtagaacgaacgtagtagttaagttaacgtttcggttagggttacgggttacgggacgggtaaacgggtaaccgtaaacgtacggtaaccgtaccggtaacggtaccgaaccggtacccgtaacggtcccgtacccggtaccccgttacggtacctaccgttccgttacccgttacccccg

SEQ ID NO: 319498 - DNA, 602 bp, Homo sapiens
  misc_feature: GZ8MTXP02JHG3Z.4.71.G05.1.454.CMB.2.raw
  modified_base (365)..(365): a, c, t, g, unknown or other
  misc_feature (365)..(365): n is a, c, g, or t
  modified_base (524)..(524): a, c, t, g, unknown or other
  misc_feature (524)..(524): n is a, c, g, or t
tcagagcactgtagcacgaccggtgctcgatttagtgtcgtcgcaagagagagggggaagaccgatgggcccttggtggaggcttggtgaagccggggggtcccttagactctcctgtgcagtctctggactcaacctcaaaaatgcctggatgacctgggtccgccagactccagggaagggctgcagtgggttggccgtattataaccaaacctgatggtgagacaacagactacgctgcacccgtgaaaggcagattcaccatctcaagagatgattcaacgaacacgtctgttttagaaatgaacagcctagaaaaccgagacacagtccgtttatttctcgttccacactcctgccctanagagtatttcgacggacttaataaactccgacctaatacgttagggacgttcgtggggacccaaacggggaccacagtccacccgtctccctacaaccctccaaccgaacgggcccacgtccggtccttccccctggacccgccctgcctcgacggacnccgaccgtccgagcgaccacgacggccggcccctgggcctgccccgttgggaccaaaggtcctaaccttcccgtaacg

SEQ ID NO: 319499 - DNA, 652 bp, Homo sapiens
  misc_feature: GZ8MTXP02J25R4.4.71.G05.1.454.CMB.2.raw
  modified_base (240)..(240): a, c, t, g, unknown or other
  misc_feature (240)..(240): n is a, c, g, or t
  modified_base (296)..(296): a, c, t, g, unknown or other
  misc_feature (296)..(296): n is a, c, g, or t
  modified_base (328)..(328): a, c, t, g, unknown or other
  misc_feature (328)..(328): n is a, c, g, or t
  modified_base (332)..(332): a, c, t, g, unknown or other
  misc_feature (332)..(332): n is a, c, g, or t
  modified_base (396)..(396): a, c, t, g, unknown or other
  misc_feature (396)..(396): n is a, c, g, or t
  modified_base (453)..(453): a, c, t, g, unknown or other
  misc_feature (453)..(453): n is a, c, g, or t
tcagagcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccagacaaacggccaggatcacctgctctggagatgcattgaccaaaaaatntgcttattggtaccagcagaagtcaggccaggccccaaaattggacatctatgaanacgaacaaacgcccctcgggatcccgtgaganatcncctagctccagctcgagggctagtcggccacttgactatccgagtcgggacccaaggtggaagntggaagctagaccttactactcgtttaactacgaaagtagaagtaaccgtaggttanaaacgttttaaacgtttcggttagggggttacggtttaccggggacgggggaacgggttaaacccaaaacggttacggaacccggttacccttaaacgggggtccaaacccggtacccccgaaaagggttcccccgaaccggtcccccccgtttacggggccctaaccccggtttacccttaccggtttaccccccccc

SEQ ID NO: 319500 - DNA, 609 bp, Homo sapiens
  misc_feature: GZ8MTXP02I7WS4.4.71.G05.1.454.CMB.2.raw
tcagagcactgtagcacgaccggtgctcgatttagtgtcgtcgcaagagagagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaattgcttattggtaccagcagaatcaggccaggccccaaaattggtcatctatgaagacgaacaaacgaccctccgggatccctagagagattctctggctccgagctcgagggctatcggccacgttgactatcgagtcgggcccaagtcggagatgaagctagactactactcgttactacaagtagacgaacagtacgtaattaagtttcgtaggggttacgtttcgggacgggtaacgggtaacctaaaacgttcggaacccggttaccgtaacgggttcccgaaacggcccccgtaaaacggggtccgttacccggaaccccccgttcggggtacccaaccgttacccgtttccggtttaccccccg

SEQ ID NO: 319501 - DNA, 672 bp, Homo sapiens
  misc_feature: GZ8MTXP02GJZJ8.4.71.G05.1.454.CMB.2.raw
  modified_base (242)..(242): a, c, t, g, unknown or other
  misc_feature (242)..(242): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctggagatgcattgaccaaaaaatntgtcttattggacagcagaagtcaggaccacggaccctaaattcgtacatactatagaagaacgaacaaaccgacccgtaccgggactcccgtagacgagtacttctccgtcggcctacgacgtctacgagggactacgtcggaccctacttgactagtcgagggtcgggaccgaaggtacgggaggtagtaggaacgtcgtacgtaaccttacgttacgttacgttaaactacgtaaagtaagaaagtaaactagtaagtaaagtttaacgtttacggtaggggttcggttacgggggacgggtaaacgggtaaaccgtaaacggtccggtaacccggttaccgttacgggtaccgaaccgacccggtaacggcccgttaccggacccccgttcgggtacccaccgtttccgttacccggtttcccccg

SEQ ID NO: 319502 - DNA, 766 bp, Homo sapiens
  misc_feature: GZ8MTXP02JX51I.4.71.G05.1.454.CMB.2.raw
  modified_base (246)..(246): a, c, t, g, unknown or other
  misc_feature (246)..(246): n is a, c, g, or t
tcagagcactgtagcacgaccggtgctcgatttagtgtcgtcgcaagagagagggggtgggctcaggaggcagagctctgggaatctcaccatggcctggacccctctcctgctccccctcctcactttctgcacagtctctgaggcctcctatgagctgacacagcccaccctcggtgtcagtcgtcccaggacaaacggccaggatcacctgctctggagatgctattagaaccaaaaaaattntagtacttagttacggtaccagacaagaacgtcgacggaccgaacggaacccctaaaagttcgtacattactaagtagaaacgaaccgaaaccgaaaacccggtaccccggtaccgggaacctaccgtaggaacgtacgtacttcctaccgtcgcctaccgacgtctacggaacggtactacgtacggtaccctaccgttagtaactagtacgtacggggtaccggggaaccgtaagggtagggaggtagtacggaacgtcgtacgtaaccttacgttacgttagttaactaaactaaagttaagtaaacgtaaacgtaagttagttaaacgtttaaggttttcggtaggggtttacgggttacgggggaacggggtaaaacgggtaaaacccgtaaaacggttccggtaaacccggttaccgtaacgggtacccgaaccggtaacccggtaacggtcccgtaccccggtacccccgttaccggtaccttaccccgttaccgttaccccggtttcccccg

SEQ ID NO: 319503 - DNA, 669 bp, Homo sapiens
  misc_feature: GZ8MTXP02JOJTS.4.71.G05.1.454.CMB.2.raw
  modified_base (223)..(223): a, c, t, g, unknown or other
  misc_feature (223)..(223): n is a, c, g, or t
  modified_base (244)..(244): a, c, t, g, unknown or other
  misc_feature (244)..(244): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggatcactgctctgganatgctattgaaccaaaaaatntgtacttagttgtaccagcaagaagtcaggaccaacggacccctaaaagttcggtacatctaatagaaagaacgaacaaaccgaccccgtaccgggactcccgtaggaacgagtaactttctccgtggcctccgaagtcctacggacgggtactagtcgggaccctaccgttgaactagtcgagggtccgggaccctaagggtcggaggagtagaacgcgtagtactactacttagttactactaaagtagaacgtaacgtagtagtaatttaacgtttggttaggggttcggttacgggacggggaaacggtaaccgtaaaacggtcggtaacccgtaccgtaacggtaccgaaccggaccccgtaaacggcccgtacccggtacccccgtcggtaccctaccgttccgtcccgtttccccccg

SEQ ID NO: 319504 - DNA, 650 bp, Homo sapiens
  misc_feature: GZ8MTXP02GSLY2.4.71.G05.1.454.CMB.2.raw
  modified_base (370)..(370): a, c, t, g, unknown or other
  misc_feature (370)..(370): n is a, c, g, or t
tcagagcactgtagcacgaccggtgctcgatttagtgtcgtcgcaagagagagggggaagaccgatgggcccttggtggaggcttggtgaagccgggggggtcccttagactctcctgtgcagtctctggactcaacctcaaaaatgcctggatgacctgggtccgccagactccgagggaagggctgcagtgggttggccgtattataaccaaacctgatggtgagacaacagactacgctgcaccgtgaaaggcagattcaccatctacaagagatgaattacaaacgaacacgcttagttttaggaaaatgaaacagcctaagaaaaccgaggaacactagtccgtttattctgttccactactccngtacctacagatcttcgtagactataaactcgacctaatagtcgggtaccgtcgtacggggaccaaacggggacccaacgacgtccacccgttctaccctaccaaaccctcccaaacccgaacgggccctaacgttcccggtacccttccccccggtggccccgtccccgtcgccctaccgacggacgacccacccgtccgacgaccggaccaaccgacggcccggaccccgtgggcctcggcccgtcggtaccaacggtacctacccgttaccctaacg

SEQ ID NO: 319505 - DNA, 583 bp, Homo sapiens
  misc_feature: GZ8MTXP02FVYI2.4.71.G05.1.454.CMB.2.raw
  modified_base (221)..(221): a, c, t, g, unknown or other
  misc_feature (221)..(221): n is a, c, g, or t
  modified_base (241)..(241): a, c, t, g, unknown or other
  misc_feature (241)..(241): n is a, c, g, or t
  modified_base (354)..(354): a, c, t, g, unknown or other
  misc_feature (354)..(354): n is a, c, g, or t
tcagagcactgtagcacgaccggtgctcgatttagtgtcgtcgcaagagagagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctgganatgcattgaccaaaaaaatntgcttattggtaccagcagaagtcaggccaggaccccaaaattggcatctatgaagacgacaaaacgaccctccgggatccctgagagattctctggctcagctcagggctanggcctacttgactatcagtggggcccaagtggagatagagctagactacgtattagtactcaaattagaagaaactaggtataattaagtttgtaggggttgtacggggtcgggaacgggtaacctaaaacgtcggtaaacccgtacgtacggggtaaccacggaccccaaaacggggtcctccggtcccccgttacgggtcctaacccgttcgttaccgtttcccccc

SEQ ID NO: 319506 - DNA, 733 bp, Homo sapiens
  misc_feature: GZ8MTXP02JM3ET.4.71.G05.1.454.CMB.2.raw
  modified_base (242)..(242): a, c, t, g, unknown or other
  misc_feature (242)..(242): n is a, c, g, or t
tcagagcactgtagcacgaccggtgctcgatttagtgtcgtcgcaagagagagggggtgggctcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggatcacctgctctggagatgcattgaccaaaaaatntgcttattggtaccagcagaagtcaggccaggacccccaaaagttcggtacatctaatagaaagacgaacaaaaccgacccgtaccgggaactcccctgaacgagattctccgtggctccaagcctacgaagggtactagtcgggccctaaacccgttggaaccttaaagtcgtaaacggggttcgggggtaacccccgaaaagggttcggggaaagggaaacgttaggaaaacggccgtttacgggaaaccttaaacggttaacccttaggtttaacccttaaaacgtaaacgttaacgaaagtaaacgtaagttaacgtaaagtttaacgtttcggtaggggttacggttacggggaacgggtaaacgggtaaacccgtaaacgtaccggtaacccggttacgttaacggtaccgaaccggtacccgaacggtcccgtacccgtaccccggttacgtaccgttaccttcccgttacccggttacccccg

SEQ ID NO: 319507 - DNA, 570 bp, Homo sapiens
  misc_feature: GZ8MTXP02JQTJ0.4.71.G05.1.454.CMB.2.raw
  modified_base (375)..(375): a, c, t, g, unknown or other
  misc_feature (375)..(375): n is a, c, g, or t
  modified_base (419)..(419): a, c, t, g, unknown or other
  misc_feature (419)..(419): n is a, c, g, or t
  modified_base (481)..(481): a, c, t, g, unknown or other
  misc_feature (481)..(481): n is a, c, g, or t
  modified_base (530)..(530): a, c, t, g, unknown or other
  misc_feature (530)..(530): n is a, c, g, or t
tcagagcactgtagcacgaccggtgctcgatttagtgtcgtcgcaagagagagggggaagaccgatgggcccttggtggaggcttggtgaagccgggggggtcccttagactctcctgtgcagtctctggactcaacctcaaaaatgcctggatgacctgggtccgccagactccagggaagggctgcagtgggttgtcgtattataaccaaacctgatggtgagacaacagactacgctgcacccgtgaaaggcagattcaccatctcaagagatgattcaacgacacgctgttttaggaaatgaacagcctagaaaaccgaggacacagtccgtttattctgttccacacctcctgcctacagagtatttcgngactataatcgccatatggacgtcgtggggaccaaggggaccanacgtcaccgtctccctcaaccctccaccgaacggtcccagtccgtccttcccccgtggcccnccctgccctccgaggacgccaacccgtccgagacgcacgacgccgcccnggggctcgcccgtggtacgaacggtcctaccttccctacg

SEQ ID NO: 319508 - DNA, 604 bp, Homo sapiens
  misc_feature: GZ8MTXP02GVPWW.4.71.G05.1.454.CMB.2.raw
  modified_base (491)..(491): a, c, t, g, unknown or other
  misc_feature (491)..(491): n is a, c, g, or t
tcagagcactgtagcacgaccggtgctcgatttagtgtcgtcgcaagagagagggggaagaccgatgggcccttggtggaggcttggtgaagccgggggggtcccttagactctcctgtgcagtctctggactcaacctcaaaaatgcctggatgacctgggtccgccagactccagggaaggggctgcagtgggttggccgtattataaccaaacctgatggtgagacaacagactacgctgcaccgtgaaaggcagattcaccatctcaagagatgattcaacgaacacgctgttttaggaaatgaacagcctagaaaaccgaggacacagtccgtttatttctgttccactactccctgcctacagtagtatttcgtaggactataactcgaccatatggacgtcgtggggacccaaagggaccacgacgtcaccgtctccctacaaccctccaaccgacgggcccacgtccggtacccttcccccgnggtcccgccctcgccctccgacggacgccacccgtccgagacgccacgacgtcccggcccgtcgggctcggcccgtacggtaccaaacgggtaccttaccgtttaccctaacg

SEQ ID NO: 319509 - DNA, 656 bp, Homo sapiens
  misc_feature: GZ8MTXP02JF1EA.4.71.G05.1.454.CMB.2.raw
  modified_base (247)..(247): a, c, t, g, unknown or other
  misc_feature (247)..(247): n is a, c, g, or t
  modified_base (432)..(432): a, c, t, g, unknown or other
  misc_feature (432)..(432): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctggagatgctattagaaccaaaaaatntagtcttattggtaaccagacagaagtcgacggaccacggacccctaaaagtcggtacatctatagaaagaaccgaacgaaaaccgaccccgtacccgggactcccgtagacgagtacttcctcgtcggctaccacgctacgagggctagcggacctacttgactatcgaggtcgggacccaggnggaggagtagaagctagactacgtacttagttacctactaaagtagaaagtaacgtaagtagtaaattaagtttcggtaggggttacggttacgggagggaaccgggtaacctaaacggtccggaaacccgttacgtaacggtaccgaaccggtacccggaaaggtcccgtaccccggacccccgttcggtaccctaccggttcccttacccggttaccccccc

SEQ ID NO: 319510 - DNA, 669 bp, Homo sapiens
  misc_feature: GZ8MTXP02JL9QH.4.71.G05.1.454.CMB.2.raw
  modified_base (251)..(251): a, c, t, g, unknown or other
  misc_feature (251)..(251): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctcgtggagatgactattagaacctaaaaaaatntgtacttagttcggtaaccagcaagaagtcgaggaccacggaaccccaaaagttcggacatactatagaaacgaaccgaacaaaaccgaccccgtaccgggactcccgtagaacgtagtacttcctccgtacggcctaccgacgtctacggagggtactacgtcggaccctacgttgaactagtaccgaggtccggggaccctaaggtcggagtagtagagctagactactacgttagttaccataagtagaacgaatagtagtaattaagtttcggtagggttaggttacgggacgggtaaacggaaaccgtaaacgtcggaaacccgttacggaacggtaccgaaccggtacccgaacggtcccgtaccccggcccccgttacggtacctacccgttccgttacccgttacccccc

SEQ ID NO: 319511 - DNA, 579 bp, Homo sapiens
  misc_feature: GZ8MTXP02JCAPQ.4.71.G05.1.454.CMB.2.raw
  modified_base (372)..(372): a, c, t, g, unknown or other
  misc_feature (372)..(372): n is a, c, g, or t
tcagagcactgtagcacgaccggtgctcgatttagtgtcgtcgcaagagagagggggaagaccgatgggcccttggtggaggcttggtgaagccgggggtcccttagactctcctgtgcagtctctggactcaacctcaaaaatgcctggatgacctgggtccgccagactccagggaagggctgcagtgggttggccgtattataaccaaacctgatggtgagacaacagactacgctgcacccgtgaaaggcagattcaccatctcaagagatgattcaacgaacacgctgttttagaaatgaacagcctagaaaaccgaggacacagccgtttattctgttccacactcctgcctacagagtatttcgngctataaatcgacctatatggaccgtcgtggggaccaaggggaccacgagttccaccgttctcctccaaccctccaacccgaacgggcccaacgttccggtcccttccccgtgcccgccctcgccgtccgaggacgccaaccgtccgagacgcaacgcgccgccctgggcctcggtccacggtcaacggtacctacctttacccacg

SEQ ID NO: 319512 - DNA, 580 bp, Homo sapiens
  misc_feature: GZ8MTXP02JHJUE.4.71.G05.1.454.CMB.2.raw
  modified_base (363)..(363): a, c, t, g, unknown or other
  misc_feature (363)..(363): n is a, c, g, or t
  modified_base (376)..(376): a, c, t, g, unknown or other
  misc_feature (376)..(376): n is a, c, g, or t
  modified_base (483)..(483): a, c, t, g, unknown or other
  misc_feature (483)..(483): n is a, c, g, or t
  modified_base (505)..(505): a, c, t, g, unknown or other
  misc_feature (505)..(505): n is a, c, g, or t
  modified_base (538)..(538): a, c, t, g, unknown or other
  misc_feature (538)..(538): n is a, c, g, or t
tcagagcactgtagcacgaccggtgctcgatttagtgtcgtcgcaagagagagggggaagaccgatgggcccttggtggaggcttggtgaagccggggggtcccttagactctcctgtgcagtctctggactcaacctcaaaaatgcctggatgacctgggtccgccagactccagggaagggctgcagtgggttggccgtattataaccaaacctgatggtgagacaacagactacgctgcaccgtgaaaggcagattcaccatctcaagagatgattcaacgaacacgcttgttttaggaaatgaacagcctagaaaaccgagacacagtccgtttattctgttccactactcctgcctanacgagtatttcgngactataatcgaccatagtgacgtcgtggggaccaagggaccaacgcgtacacccgtctccctacaaccctccaaccgaacgggccctagtccggtccttcccccgnggcccgccctgcctccgaggcnccacctccgagcgaccgacgacgcccggtcccnggggcctcgccgtggtaccaaggtaccttaccgtccctaacg

SEQ ID NO: 319513 - DNA, 653 bp, Homo sapiens
  misc_feature: GZ8MTXP02JCODT.4.71.G05.1.454.CMB.2.raw
  modified_base (327)..(327): a, c, t, g, unknown or other
  misc_feature (327)..(327): n is a, c, g, or t
  modified_base (361)..(361): a, c, t, g, unknown or other
  misc_feature (361)..(361): n is a, c, g, or t
  modified_base (367)..(367): a, c, t, g, unknown or other
  misc_feature (367)..(367): n is a, c, g, or t
  modified_base (372)..(372): a, c, t, g, unknown or other
  misc_feature (372)..(372): n is a, c, g, or t
  modified_base (379)..(379): a, c, t, g, unknown or other
  misc_feature (379)..(379): n is a, c, g, or t
tcagagcactgtagcacgaccggtgctcgatttagtgtcgtcgcaagagagagggggaagaccgatgggcccttggtggaggcttggtgaagccggggggtcccttagactctcctgtgcagtctctggactcaacctcaaaaatgcctggatgacctgggtccgccagactccagggaagggctgcagtgggttgccgtattataaccaaacctgatggtgagacaacagactacgctgcacccgtgaaaggcagattcaccatctcaagagatgaattcaacgaacacgcttgttttaggaaatgaacagacctagaaaacccgngacacagtcccgtttattctgttccacactcccngcctangactntttccgngactataatcgaccattagtggacgttcgtggggacccaaggggacccacgagtccaacccgttctccctacaaccctcccaaacccgaacgggtcccctaacgttcccgggtaccctttccccccgtgggcccgtcccccttggccccttaccgacgggacgaccctacccgtacccggagaccggccaaaccgaccggccggtcccccgtggggtccctaacgccccgtttacgggtaccaaccggtaccttacccgtttacccttaaccgg

SEQ ID NO: 319514 - DNA, 615 bp, Homo sapiens
  misc_feature: GZ8MTXP02JCHGY.4.71.G05.1.454.CMB.2.raw
  modified_base (246)..(246): a, c, t, g, unknown or other
  misc_feature (246)..(246): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggatcacctgctctggagatgcattagaaccaaaaaaatntgcttattggtaccagcaagaagtcgaacggccaacggaccccctaaaagttcggtactatctaagtaggaaacgaaccgaacaaaaccggaccccctaccggggactccccgtagacgagtattcctccgtggcctccagtctaccgaggggactagtcggaccctaccgttgacttactcgaaggtcggggacccaaggtgggaggagtagagctgaactactacttagttactacaatagaagacgagtagaattagttgtgggttgtacgggacggaaggtaaccaaaacgtcggaccgtacgtacggtcgaacgacccgaaggccgtaccgcccccgtcgtaccaccgtccttccgttaccccc

SEQ ID NO: 319515 - DNA, 623 bp, Homo sapiens
  misc_feature: GZ8MTXP02G8N09.4.71.G05.1.454.CMB.2.raw
  modified_base (242)..(242): a, c, t, g, unknown or other
  misc_feature (242)..(242): n is a, c, g, or t
tcagagcactgtagcacgaccggtgctcgatttagtgtcgtcgcaagagagagggggtgggctcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggatcacctgctctggagatgcattgaccaaaaaatntgtacttagtcgacagacaagaagtcgacggaccgaaccggaacccctaaaagttcggtacaattactaagtaggaaacgaaaccgaaaccgaaaacccgaccccgtacccgggactcccgtagaagagtacttctccgtcggcctcgacgctacgaacgggactagcggacctaccttagaactatcgaacggtcggggaccgaaggtaggaaggagtagaacgctagaactacttactattacactaaagtaagaagaactagtagtaattagtttcggtggttggtacgggacgggaacggaaccgtaaacgtacgtaccgtacgtacggacgacgaccgaagccgtccgaccccgtcgtacctactccgtcctcccc

SEQ ID NO: 319516 - DNA, 569 bp, Homo sapiens
  misc_feature: GZ8MTXP02IY0DQ.4.71.G05.1.454.CMB.2.raw
  modified_base (367)..(367): a, c, t, g, unknown or other
  misc_feature (367)..(367): n is a, c, g, or t
  modified_base (378)..(378): a, c, t, g, unknown or other
  misc_feature (378)..(378): n is a, c, g, or t
  modified_base (471)..(471): a, c, t, g, unknown or other
  misc_feature (471)..(471): n is a, c, g, or t
  modified_base (476)..(476): a, c, t, g, unknown or other
  misc_feature (476)..(476): n is a, c, g, or t
  modified_base (512)..(512): a, c, t, g, unknown or other
  misc_feature (512)..(512): n is a, c, g, or t
tcagagcactgtagcacgaccggtgctcgatttagtgtcgtcgcaagagagagggggaagaccgatgggcccttggtggaggcttggtgaagccgggggggtcccttagactctcctgtgcagtctctggactcaacctcaaaaatgcctggatgacctgggtccgccagactccagggaaggggctgcagtgggttggccgtattataaccaaacctgatggtgagacaacagactacgctgcacccgtgaaaggcagattcaccatctcaagagatgaattcaacgaacacgctgttttaggaaatgaacagcctagaaaaccgaggacacagtccgtttattctcgttccacactcctgcctanagatatttcgngactataatcgcatatggactcgtgggcaagggaccagacgtcaccgtctcctcaacctccaaccgaacggcccagtccgtcccttcccccgngcccncccgtcgcctccgacggacgccacccgtccgagacncacgacgccgcccgtggcctcgcccgtaggtaccaaggtcccttacgtacccctaag

SEQ ID NO: 319517 - DNA, 718 bp, Homo sapiens
  misc_feature: GZ8MTXP02FVKWO.4.71.G05.1.454.CMB.2.raw
  modified_base (245)..(245): a, c, t, g, unknown or other
  misc_feature (245)..(245): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggatcacctgctctggagatgctattgaaccaaaaaatntgacttattggtaccagcaagaagtcaggccacggacccctaaaagttggacatctatagaagacgaacaacgccgacccgtacggactccgtagagtacgtactccctcgcgtcctcgacgtaccgtacggacggtactacgtaccggtacccttacgttacgtaactactacgggtagggtacccgggaaccgtaaggggtagggaagtagtaacggtaacgtacgtaacgttaaacctacgtttaacgttaccgttaaacctaagtaaagtaaagaaaccggtaaagtaaggttaagttaaagtttacggtttacggggttaggggttacgggtaccgggggaagggtaaacccggtaaaaccgtaaacggttacccggtaccggttacgttaacggtaccgacccggtaccgaaccggtccgtaccccgtccccggttacggtaccctaccgtttcccggtttcccccg

SEQ ID NO: 319518 - DNA, 747 bp, Homo sapiens
  misc_feature: GZ8MTXP02I9MHX.4.71.G05.1.454.CMB.2.raw
  modified_base (268)..(268): a, c, t, g, unknown or other
  misc_feature (268)..(268): n is a, c, g, or t
  modified_base (388)..(388): a, c, t, g, unknown or other
  misc_feature (388)..(388): n is a, c, g, or t
tcagagcactgtagcacgaccggtgctcgatttagtgtcgtcgcaagagagagggggaagaccgatgggcccttggtggaggcttggtgaagccggggggtcccttagactctcctgtgcagtctctggactcaacctcaaaaatgcctggatgacctgggtccgccagactccagggaagggctgcagtgggttggccgtattataaccaaacctgatggtgagacaacagactacgctgcacccgtgaaaggcagattcaccatcncaagagatgattcaacgaactacgcttgttttaggaaaatgaacagcctaaggaaaaccgaggacacagtaccgttttatttctgttaccactactccctgaccctacagactatttcgnggtactataaactcgcctaatagtcggtacgttaccgtcggggaacccaaaggggaaccccaacgtaacgtccctaacccggttacccttaccctaacccaaaaccccgtccccgaaaaccggaaacccggggtacccctaacgttcccgggttcccccttaccccccggttcgggccccgtcccccgttcgacccgttacccgaacgggtaacccgccctaacccccggttaccggaacgaccggacccaaaccggaccggttccccgggacccccgtggggtccccgttcggtaccccccgttaggggttacccgtaaaaaccgggaaccctttttaccccttacccccgttaaacg

SEQ ID NO: 319519 - DNA, 645 bp, Homo sapiens
  misc_feature: GZ8MTXP02JTI7W.4.71.G05.1.454.CMB.2.raw
  modified_base (245)..(245): a, c, t, g, unknown or other
  misc_feature (245)..(245): n is a, c, g, or t
  modified_base (339)..(339): a, c, t, g, unknown or other
  misc_feature (339)..(339): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagcccaccctcggtgtcagtgtccccaggacaaacggccaggatcacctgctctggagatgcattgaaccaaaaaaatntgcttattggtaccagcagaagtcaggccaggaccccaaaattggtcatctatgaagacgaacaaacgaccctccgggatccctgagagattcnctgctccagctcgagggctagtcggccctacttgactatcgaggtcggggacccaaggtcgggaggagtagagctagactactactagttactacaatagaagaacagtagtaattaacgtttcggtgggttacggtttacggggacgggaacggggtaaacccgtaaaacggttacggtaaccccggttaccggttaacgggttaccgaaccggtacccccggtaaaaggggtccccgtacccggtcccccccggttaccggggtaccctaacccgtttcccgtttacccggtttccccccccgg

SEQ ID NO: 319520 - DNA, 593 bp, Homo sapiens
  misc_feature: GZ8MTXP02GTA00.4.71.G05.1.454.CMB.2.raw
  modified_base (243)..(243): a, c, t, g, unknown or other
  misc_feature (243)..(243): n is a, c, g, or t
  modified_base (469)..(469): a, c, t, g, unknown or other
  misc_feature (469)..(469): n is a, c, g, or t
  modified_base (498)..(498): a, c, t, g, unknown or other
  misc_feature (498)..(498): n is a, c, g, or t
tcagagcactgtagcacgaccggtgctcgatttagtgtcgtcgcaagagagagggggtgggctcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggatcacctgctctggagatgcattgaccaaaaaaatntgacttatggtaccagcagaagcagccaggaccccaaaatgcatctatagaagacgaacaaacgacccctaccgggactcccgtagaacgagacttctcctaggcctccgaagcctacgaacggggacttagtcggaccctacccgttgaactattcgaaggttcgggggaccccaaaggtgggaaggagtaggaaacgcgtagtaactactacttagttacctanaaatagaataacgagtagaattaatttgngggttgttcgggagggaacggacaaaacgtcggaccgtcgtacggtcacgccaaaggcctccgcccccgtacggcctactccgtccgttcccccg

SEQ ID NO: 319521 - DNA, 648 bp, Homo sapiens
  misc_feature: GZ8MTXP02FOAOD.4.71.G05.1.454.CMB.2.raw
tcagagcactgtagcacgaccggtgctcgatttagtgtcgtcgcaagagagagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaaatatgcttaattggtaccagcagaagtcaggccaggccccaaaattggtcatctatgaagacgaacaaacgaccctccgggatccctgagagtattctcctgcctcgagctacgagggtactagtcggcctaccttgaactatacgaggtcggggacccgaaaggtgggaaggtagtaggaacgtcgtaaggtaccttaaacctacgttagtttaacctaactaagtaagaacggaaaactaggtagtaaatttaaagtttcggttggggttggttaccggggacggggtaacggggaaacccgtaaaacgtcggtaacccgtaccgttaacgggtacgaaccggaccccgaaaggtccgtcccggtcccccgttaccgggtccctaacttcccgtccgtttcccccccg

SEQ ID NO: 319522 - DNA, 654 bp, Homo sapiens
  misc_feature: GZ8MTXP02JD8NU.4.71.G05.1.454.CMB.2.raw
  modified_base (180)..(180): a, c, t, g, unknown or other
  misc_feature (180)..(180): n is a, c, g, or t
  modified_base (242)..(242): a, c, t, g, unknown or other
  misc_feature (242)..(242): n is a, c, g, or t
  modified_base (362)..(362): a, c, t, g, unknown or other
  misc_feature (362)..(362): n is a, c, g, or t
  modified_base (377)..(377): a, c, t, g, unknown or other
  misc_feature (377)..(377): n is a, c, g, or t
  modified_base (431)..(431): a, c, t, g, unknown or other
  misc_feature (431)..(431): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagccaccctcggtntcagtcgtccccaggacaaacggccaggatcacctgctctggagatgcattgacaaaaaatntgcttatggtaccagcaagagtcaggcacggaccccaaaatggtcatctatgaagacgacaaacgaccctaccgggactcccgtagagatagttctctacggctcagctcgagggtctancggccacctgactancgagtcgggccctaaggtgagatagaagctagtactactacttagttaacctanaaagttacgaaacggtaacctaagttagtaattaaacgttttcggttaggggttacggtttcggggaacgggaacgggtaacccgtaaaacgttcggtaaaccccggttacgtttaaacgggccgttaaaaccgggtccccgtaaaacgggcccgttacccggtaaccccccgttcggggtacccctaaccggtttacccgtttacccgggtttacccccccg

SEQ ID NO: 319523 - DNA, 652 bp, Homo sapiens
  misc_feature: GZ8MTXP02F7GVJ.4.71.G05.1.454.CMB.2.raw
  modified_base (225)..(225): a, c, t, g, unknown or other
  misc_feature (225)..(225): n is a, c, g, or t
  modified_base (246)..(246): a, c, t, g, unknown or other
  misc_feature (246)..(246): n is a, c, g, or t
  modified_base (464)..(464): a, c, t, g, unknown or other
  misc_feature (464)..(464): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggatcacctgctcgtgganatgcattagaaccaaaaaatntgcttagtggtaccagcaagagtcgagccaggacccctaaattggcatctatagaagacgaacaaaccgacccgtaccgggactcccgtagagagtacttctaccgtcgcctaccgagtcctacgaggggtactagtcggaccctaccgttgactatcgaaggtcgggacccaaggtcgggagagtagaagtctagtactacttagttacgttactanaaagtagaacgtaaacgtagtagtaatttaagtttcggtaggggttcggtacggggtacgggtaacgggtaaccctaaacggttcggtaacccggttcgtaaacggtacccgaaacggaccccgtaaagggtcccgtcccggtacccccgttcgggtaccctacccgttccgttcccgtttccccccg

SEQ ID NO: 319524 - DNA, 616 bp, Homo sapiens
  misc_feature: GZ8MTXP02GQACT.4.71.G05.1.454.CMB.2.raw
  modified_base (327)..(327): a, c, t, g, unknown or other
  misc_feature (327)..(327): n is a, c, g, or t
  modified_base (529)..(529): a, c, t, g, unknown or other
  misc_feature (529)..(529): n is a, c, g, or t
tcagagcactgtagcacgaccggtgctcgatttagtgtcgtcgcaagagagagggggaagaccgatgggcccttggtggaggcttggtgaagccgggggggtcccttagactctcctgtgcagtctctggactcaacctcaaaaatgcctggatgacctgggtccgccagactccagggaagggctgcagtgggttggccgtattataaccaaacctgatggtgagacaacagactacgctgcacccgtgaaaggcagattcaccatctcaagagatgattcaaacgaacacgcttgttttaggaaatgaacagcctagaaaaccgnggacacagtaccgtttatttctgttccacacctccctgccctacagagtactttcgaggactataaatccgacctagtatcggacgtcgtggggaccaagggaccacagtcacccgtctaccctacacctccaccgaacggcccagttccggtcccttcccccgtggcccgcccctcggcctacccgaggaccgcctacccnccggacgacgacaccgtacggcccggccccgtggggcctcggccccgtagggtaccaaacgggtacccttacccgttacccgtaacg

SEQ ID NO: 319525 - DNA, 729 bp, Homo sapiens
  misc_feature: GZ8MTXP02G0U0L.4.71.G05.1.454.CMB.2.raw
  modified_base (279)..(279): a, c, t, g, unknown or other
  misc_feature (279)..(279): n is a, c, g, or t
  modified_base (340)..(340): a, c, t, g, unknown or other
  misc_feature (340)..(340): n is a, c, g, or t
  modified_base (348)..(348): a, c, t, g, unknown or other
  misc_feature (348)..(348): n is a, c, g, or t
  modified_base (605)..(605): a, c, t, g, unknown or other
  misc_feature (605)..(605): n is a, c, g, or t
tcagagcactgtagcacgaccggtgctcgatttagtgtcgtcgcaagagagagggggaagaccgatgggcccttggtggaggcttggtgaaggccgggggggtcccttagactctcctgtgcagtctctggactcaacctcaaaaatgcctggatgacctgggtccgccagactccgaggggaaggggctgcagtgggttggccgtattataaccaaacctgatggtgagacaacagactacgctgcaccgtgaaaggcagattccacatctacaaganatgaacttcaaacgaacacgtcttagttttaggaaaatggaaacagtcctaagaaaaccgnggaaccanacgtccgtttatttctacgttaccactaccttcccgtcgtaccctaacgagtacgttagtttccggtaggtaccttaaataacgtccgaccctaagttaaggtacgggtaaccggtttcgtacgggggaacccgaaaacgggggaacccacgtaacgtacccgtaacccgtccccttaccctaacccgtaaaccccttaccccgaaaccccggaaccgggccccctaacgttccccgggttccctttcccccccggnggcccccgtccccgttccgacccgttccggacggtacgacccacccgtcccggagaccgcccaaacgcggcccggcccttggggcctcggcctcggaccaacggtacccttacgtaccctaacg

SEQ ID NO: 319526 - DNA, 569 bp, Homo sapiens
  misc_feature: GZ8MTXP02JC24D.4.71.G05.1.454.CMB.2.raw
  modified_base (242)..(242): a, c, t, g, unknown or other
  misc_feature (242)..(242): n is a, c, g, or t
  modified_base (459)..(459): a, c, t, g, unknown or other
  misc_feature (459)..(459): n is a, c, g, or t
  modified_base (558)..(558): a, c, t, g, unknown or other
  misc_feature (558)..(558): n is a, c, g, or t
tcagagcactgtagcacgaccggtgctcgatttagtgtcgtcgcaagagagagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaaattntgtacttagtcgtacagacagaagtcgacggaccacggaccctaaagtcgtacatactagtagaaacgaaccgaacaaaccgaccccgtaccgggactcccgtagagagtacttctccgtcgcctacgacgtctacgaggctacgtcgacctacgtgtactatcgacggtcggacctaggtggagagtagagtctagtactactacgttagtactanaagtagaagaacgtagtagtaattagttcggtggtgtacggacggacgacaacgtcgaccgtacgtacgcgacgaccgacgccgtccgcccgtcgtacncgtctactccc

SEQ ID NO: 319527 - DNA, 736 bp, Homo sapiens
  misc_feature: GZ8MTXP02G66A7.4.71.G05.1.454.CMB.2.raw
  modified_base (244)..(244): a, c, t, g, unknown or other
  misc_feature (244)..(244): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctggagatgcattgaaccaaaaaaatntgtacttagtcgacagacaagaagacgacgaccaacggaaccctaaagttgacatactaagtagaaacgaaccgaaacaaaccgacccgtaccgggactacccgtagaacgagtacttcgtccgtcggtacctacgacgtcgtacgaacgggtactacgtacggacccttaaccgttagaacttacgtacgtaacgggtacggggaacccgtaaagggtagggaaggtaagtagaaacgtacgtaacgtaacttaacgtaacgttaacgttaactaaacgtaaagtaagaaacgtaaacgtaagtaacgtaaatttaaacggtttacggttaggggttacgggttaccggggacggggtaaacgggtaaaaccgtaaaacggtaccggtaacccggtaccggttaaacggtaccgaaaccggaacccgtaaacggtcccgtacccggtacccccgtacggtacctacccgttacccgttacccgttaccccc

SEQ ID NO: 319528 - DNA, 685 bp, Homo sapiens
  misc_feature: GZ8MTXP02GOL74.4.71.G05.1.454.CMB.2.raw
  modified_base (248)..(248): a, c, t, g, unknown or other
  misc_feature (248)..(248): n is a, c, g, or t
tcagagcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggatcacctgctctggagatgctattacgaaccaaaaaaatntgacttatggtaccagcaagaagtcgaggccacggacccctaaaattcggacatactatacgaagacgaacgaaaaccgaccccgtccgggactcccgtagaacgacgtactttcctccgtcggcctccgagtccgtacgaacggggtacctacgtcggaccctaccgttagaccttagtccgaaggtcggggaccctaagggtacggaggtacgtaggaacgtcgtacgtaccttaaccgttacgttacgttaacctagtaaagtaggaaacgtaaacgtagttaagtaaagtttaacgtttcggtaggggttcggtacggggtacggaacgggtaacctaaacggtcggtacccgtacgtaacggtaccgaacggacccgtaaggtccgtacccgtccccggttacggtcctaccgttccgttaccgttcccccg

SEQ ID NO: 319529 - DNA, 636 bp, Homo sapiens
  misc_feature: GZ8MTXP02GTR02.4.71.G05.1.454.CMB.2.raw
  modified_base (246)..(246): a, c, t, g, unknown or other
  misc_feature (246)..(246): n is a, c, g, or t
  modified_base (458)..(458): a, c, t, g, unknown or other
  misc_feature (458)..(458): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggatcacctgctctggagatgcattgaacctaaaaaaatntgtcttattggtaccagcaagaagtcaggccacggaccccaaatggtcatctatagaagacgacaaaccgacccgtccgggactcccgtgaagagtacttctccgtggcctcgagctacgagggctagtcgccctactgactatcagggtcggacccaggtacggaggtagtagaacgtctaggactacgtacttagtactacaagtagaanaacgtagtagtattaagtttcgtaggggttacggttacgggacgggtaaacggggaacctaaaacggttaccggtaacccggttaccgtacgggtacccgaaccggaccccgtaaggggcccgtcccggcccccggttaccggtacccgtacccttcccggttaccgttcccccccgg

SEQ ID NO: 319530 - DNA, 536 bp, Homo sapiens
  misc_feature: GZ8MTXP02FKDX1.4.71.G05.1.454.CMB.2.raw
  modified_base (323)..(323): a, c, t, g, unknown or other
  misc_feature (323)..(323): n is a, c, g, or t
  modified_base (374)..(374): a, c, t, g, unknown or other
  misc_feature (374)..(374): n is a, c, g, or t
  modified_base (379)..(379): a, c, t, g, unknown or other
  misc_feature (379)..(379): n is a, c, g, or t
  modified_base (391)..(391): a, c, t, g, unknown or other
  misc_feature (391)..(391): n is a, c, g, or t
  modified_base (510)..(510): a, c, t, g, unknown or other
  misc_feature (510)..(510): n is a, c, g, or t
tcagagcactgtagcacgaccggtgctcgatttagtgtcgtcgcaagagagagggggaagaccgatgggcccttggtggaggcttggtgaagccggggggtcccttagactctcctgtgcagtctctggactcaacctcaaaaatgcctggatgacctgggtccgccagactccagggaagggctgcagtgggttggccgtattataaccaaacctgatggtgagacaacagactacgctgcacccgtgaaaggcagattcaccatctcaagagatgattcaacgaacacgctgttttggaaatgaacagcctagaaaaccgnggacacagccgtttatttctgttccacactccctgcctacagagatttcgngctanaaatcgccatanggactcgtgggaccaagggaccacagtcaccgtctcctcaacctccaaccaggcccatcggtcttcccctgccgccctgcctccaggagcacctccgagagcaccagccgccctgggcngccgtgcaaggacctactccctaacg

SEQ ID NO: 319531 - DNA, 661 bp, Homo sapiens
  misc_feature: GZ8MTXP02GH0TL.4.71.G05.1.454.CMB.2.raw
  modified_base (326)..(326): a, c, t, g, unknown or other
  misc_feature (326)..(326): n is a, c, g, or t
  modified_base (360)..(360): a, c, t, g, unknown or other
  misc_feature (360)..(360): n is a, c, g, or t
  modified_base (366)..(366): a, c, t, g, unknown or other
  misc_feature (366)..(366): n is a, c, g, or t
  modified_base (377)..(377): a, c, t, g, unknown or other
  misc_feature (377)..(377): n is a, c, g, or t
tcagagcactgtagcacgaccggtgctcgatttagtgtcgtcgcaagagagagggggaagaccgatgggcccttggtggaggcttggtgaaggccggggggtcccttagactctcctgtgcagtctctggactcaacctcaaaaatgcctggatgacctgggtccgccagactccagggaagggctgcagtgggttggccgtattataaccaaacctgatggtgagacaacagactacgctgcaccgtgaaaggcagattcaccatctcaagagatgattacaacgaacacgcttgttttggaaatgaacagacctagaaaaccgnggacacagtccgtttatttctgttccacactccngcctanagagtattcgngactataatcgaccatatgggacgtcgtggggacccaaaggggacccacgagtaccaccgtctccccgtacaacccctcccaacccgaaacggggcccctaacgttcccgggttccccttccccccggtcggccccgtccccgttcggcctaccccgagggaccgacccgacccttcccggagaccgccaaccgacggccccgggccccgttcgggggccttccggccccgttacggggtaccctaaaacgggacccttttaaaccgtttcccccgttaaaccg

SEQ ID NO: 319532 - DNA, 743 bp, Homo sapiens
  misc_feature: GZ8MTXP02HJY6H.4.71.G05.1.454.CMB.2.raw
  modified_base (229)..(229): a, c, t, g, unknown or other
  misc_feature (229)..(229): n is a, c, g, or t
  modified_base (253)..(253): a, c, t, g, unknown or other
  misc_feature (253)..(253): n is a, c, g, or t
tcagagcactgtagcacgaccggtgctcgatttagtgtcgtcgcaagagagaggggggtgggctcaggaggcagagctctgggaatctcaccatggcctggacccctctcctgcctcccccctcctcactttctgcacagtctctgaggcctcctatgagctgacacagcccacccgtcggtgtcagtcgtccccgaggacaaacggccaggactcacctgctctgganatgacattagaaaccaaaaaaatntagtacttagtcggtaccagcaagagtcgacggaccacggacccctaaaagttcggtacatctaatagaacgaacgaacaaaccgcccgtacggactccgtagagagtacttctccgtcggcctcgacgtcgtacgaacgggtactacgtacggaccctacgttacgactacgtccggtagggtccggggacccgtaaaggggtcggggaaggtacgtaggaacgtacgttacggtaaccttaaccgttaacgtttacgttaacctaaacgtaaaaggttaaagaaacggtaaaacgtaggttaagtaaacgtttaaggtttcgggttgggggttaccgggttacgggggaaccgggtaaacgggtaaacccgtaaaacggttccggtaacccggttacggttaacgggtaccgtaccggtacccgtaacggtcccgtcccggtacccccgtcggtaccctacccgtttccgttccccggtttccccccg

SEQ ID NO: 319533 - DNA, 620 bp, Homo sapiens
  misc_feature: GZ8MTXP02GEQ38.4.71.G05.1.454.CMB.2.raw
  modified_base (331)..(331): a, c, t, g, unknown or other
  misc_feature (331)..(331): n is a, c, g, or t
  modified_base (386)..(386): a, c, t, g, unknown or other
  misc_feature (386)..(386): n is a, c, g, or t
  modified_base (504)..(504): a, c, t, g, unknown or other
  misc_feature (504)..(504): n is a, c, g, or t
tcagagcactgtagcacgaccggtgctcgatttagtgtcgtcgcaagagagagggggaagaccgatgggcccttggtggaggcttggtgaagccgggggggtcccttagactctcctgtgcagtctctggactcaacctcaaaaatgcctggatgacctgggtccgccagactccagggaagggctgcaggtgggttggccgtattataaccaaacctgatggtgagacaacagactacgctgcacccgtagaaaggcagattcaccatctacaagagatgattacaacgaacacgtcttggttttagaaatgaaacagcctagaaaccgngacactagtccgtttattctgtaccactacctcctacgcctacagtagtattcgnggactataactcgacctatagtggacgtcgtacggggaccaagggaccacgagtccaccgtcctaccgtacaaaccctccaaaccgacgggacccacgttccggtcccttacccccgngcccgccctcgcccgtaccacgggacctccaccgtaccgacgacggccaccgacggcccgggccccgtggggccctcggcccgttagggaccaaacggtcctacccgttccctaag

SEQ ID NO: 319534 - DNA, 582 bp, Homo sapiens
  misc_feature: GZ8MTXP02IQ63Z.4.71.G05.1.454.CMB.2.raw
  modified_base (372)..(372): a, c, t, g, unknown or other
  misc_feature (372)..(372): n is a, c, g, or t
  modified_base (405)..(405): a, c, t, g, unknown or other
  misc_feature (405)..(405): n is a, c, g, or t
  modified_base (428)..(428): a, c, t, g, unknown or other
  misc_feature (428)..(428): n is a, c, g, or t
  modified_base (492)..(492): a, c, t, g, unknown or other
  misc_feature (492)..(492): n is a, c, g, or t
tcagagcactgtagcacgaccggtgctcgatttagtgtcgtcgcaagagagagggggaagaccgatgggcccttggtggaggcttggtgaagccgggggggtcccttagactctcctgtgcagtctctggactcaacctcaaaaatgcctggatgacctggtccgccagactccagggaagggctgcagtgggttggcgtattataaccaaacctgatggtgagacaacagactacgctgcacccgtgaaaggcagattcaccatctacaagagatgaattcaaacgaacacgcttgttttaggaaatgaacagcctagaaaaccgaggacacagtccgttttattctgttccacaccttccctgacctacngaagtatttccggagactataaatcgacattangacgtcgtgggacaagggaccanacgtcaccgtctaccaccaacctccaaccgaacggcccacgttcggtccctttccccgcggccncccgtcgctcccgaggcgaccaccgtccgagacgcaacacggtccgccgtggctcggctttcggaccaacggtacctacctttaccaacg

SEQ ID NO: 319535 - DNA, 610 bp, Homo sapiens
  misc_feature: GZ8MTXP02HMKMD.4.71.G05.1.454.CMB.2.raw
  modified_base (221)..(221): a, c, t, g, unknown or other
  misc_feature (221)..(221): n is a, c, g, or t
  modified_base (238)..(238): a, c, t, g, unknown or other
  misc_feature (238)..(238): n is a, c, g, or t
tcagagcactgtagcacgaccggtgctcgatttagtgtcgtcgcaagagagagggggtgggctcaggaggcagagctctgggaatctcaccatggcctggacccctctccttctccccctcctcactttctgcacagtctctgaggcctcctatgagctgacacagccaccctcggtgtcagtcgtcccaggacaaacggccaggatcacctgctctgganatgcattgacaaaaatntgcttatggtacagcagaatcaggccaggaccccaaaattggacatctatagaagacgaacaaaaccgacccgtaccgggactcccgtagagagtacttctcgtcggcctccagctcgaaggactgtcgcctacttgactatcgacggtcgggacccaaaggtggaacggagtagaagctagtaactactactgttaactactaaatagaagaaactagtagtaagttaagtttcgtaggggttacggttcgggaacggggacggtaaaccgtaaaacgtcggtaacccgtccgtaaggttaccgacggacccgaaacggcctaacccgtcccccgtacggtcctacctccgtaccgtttccccctaccccg

SEQ ID NO: 319536 - DNA, 662 bp, Homo sapiens
  misc_feature: GZ8MTXP02IHO41.4.71.G05.1.454.CMB.2.raw
  modified_base (242)..(242): a, c, t, g, unknown or other
  misc_feature (242)..(242): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctggagatgcattgaccaaaaaatntgcttatggtaccagcagaagtcaggccaggccccaaaattggtcatctatgaagacgacaaaccgccctccgggatccctgagagattctctgctccagctcgacgggactagtcggaccctaccttgaactatacgacggtcggggcccgaaagggtcgggaaggagtaggaaacgtcgtacgtaaccgtaacctacgttacggttaacctacgaaacttaaggaagtaaacgtaaggttagtaatttaaacgttttcgttagggggttcggtttacggggacgggtaacgggtaaaacccgtaaaacggtcggaacccggttaccgtaacgggttccgaacggccccgaaacggggcccttacccgggtcccccgttacgggtccctaacccgttccgttacccgggtttccccccg

SEQ ID NO: 319537 - DNA, 620 bp, Homo sapiens
  misc_feature: GZ8MTXP02GFP3B.4.71.G05.1.454.CMB.2.raw
tcagagcactgtagcacgaccggtgctcgatttagtgtcgtcgcaagagagagggggaagaccgatgggcccttggtggaggcttggtgaagccgggggggtcccttagactctcctgtgcagtctctggactcaacctcaaaaatgcctggatgacctgggtccgccagactccagggaagggctgcagtgggttggccgtattataaccaaacctgatggtgagacaacagactacgctgcaccgtgaaaggcagattcaccatctacaagagatgattacaaacgaacacgcttgttttaggaaatgaacagcctagaaaaccgaggacacagtccgtttattctcgttccactaccgtccctgaccctacagatatttcgaggtactataatcgacctatagtcggacgttcgtcggggaccaaaggggaccagacgtccacccgttctccctacaaaccctcccaaaccgaacgggtccccagttcccggtcccttcccccgcggcccgtccctcgcctaccgaggtaccgccacccgtccgagaccgccaacgcgcccggtccgtcgggcctcggcccgtcggtaccaaacggtaccttacccgttccctaacg

SEQ ID NO: 319538 - DNA, 733 bp, Homo sapiens
  misc_feature: GZ8MTXP02HBIBL.4.71.G05.1.454.CMB.2.raw
  modified_base (240)..(240): a, c, t, g, unknown or other
  misc_feature (240)..(240): n is a, c, g, or t
tcagagcactgtagcacgaccggtgctcgatttagtgtcgtcgcaagagagagggggtgggctcaggaggcagagctctgggaatctcaccatggcctggacccctctcctgctccccctcctcactttctgcacagtctctgaggcctcctatgagctgacacagccaccctcggtgtcagtcgtcccaggacaaacggccaggatcacctgctctggagatgcattgaccaaaaaatntgcttatggtaccagcagaagtcacggccacggaccccaaaagttcggacctatctaatagaaagacgaacaaaaccggacccctaccgggactcccgtgaacgtagtaacgttctaccgtcgggcctaccgacgtcctaccgaacggggtaccttagtcgggacccctaccgtttggaaccttaacgtccgaagggttccgggggaccccgtaaagggtggggaaacggtaagtaggaaacggtcgtacggaaaccttaacgttaaccgttacggtttaacttaaccgtaaagttaaaggaacggtaaaaccgtaaggttaagtaaagttaaacggtttttcggtagggggttacggtttacggggacggggtaaacggggtaacccgtaaaacgtcgggtaacccgtaccggttaacggtaccgaccggacccaagggtccgtacccggacccccgttcggtaccgtaccttccgttccgtttaccccccg

SEQ ID NO: 319539 - DNA, 580 bp, Homo sapiens
  misc_feature: GZ8MTXP02JCETT.4.71.G05.1.454.CMB.2.raw
  modified_base (241)..(241): a, c, t, g, unknown or other
  misc_feature (241)..(241): n is a, c, g, or t
  modified_base (448)..(448): a, c, t, g, unknown or other
  misc_feature (448)..(448): n is a, c, g, or t
  modified_base (456)..(456): a, c, t, g, unknown or other
  misc_feature (456)..(456): n is a, c, g, or t
tcagagcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaatntgacttattggtaccagcagaagtcaggccacggaccccaaaattggtcatctatgaagacgacaaacgaccctccgggatccctgagagattctccgtaggcctaccgagtcctacgaggggtacctagtcgggacctaccttgacctatcgaggtcgggacccaaggtggagatgaagctgactactactgttactacaataganaacagtanaattaagttcgtagggttgttacggacgggtacggaaccaaacgtcggacccgtacgtacggtacacggtacccaaggtcctccggtcccccgtacggtacctacctccgtccgtttccccccg

SEQ ID NO: 319540 - DNA, 560 bp, Homo sapiens
  misc_feature: GZ8MTXP02F5Q8K.4.71.G05.1.454.CMB.2.raw
  modified_base (241)..(241): a, c, t, g, unknown or other
  misc_feature (241)..(241): n is a, c, g, or t
tcagagcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaatntgcttattggtaccagcagagtcaggccaggaccccaaaattggcatctatgaagacgacaaaccgaccctcgggatcccgtagagagtacttctcctggcctcagctcagggctatcggccacttgactatcaggtcgggacccaaggtggaggagtagaggctagactactactgttactacaatagaagaacagtagaattaatttcgtagggtgttcgggacgtacggggaaccaaacgtcgaacccggttacacggtaccaacgcccgaaacggtctaccgccccgtcggtacctacctcgtccgtttcccccg

SEQ ID NO: 319541 - DNA, 595 bp, Homo sapiens
  misc_feature: GZ8MTXP02GPABU.4.71.G05.1.454.CMB.2.raw
  modified_base (331)..(331): a, c, t, g, unknown or other
  misc_feature (331)..(331): n is a, c, g, or t
  modified_base (372)..(372): a, c, t, g, unknown or other
  misc_feature (372)..(372): n is a, c, g, or t
  modified_base (384)..(384): a, c, t, g, unknown or other
  misc_feature (384)..(384): n is a, c, g, or t
tcagagcactgtagcacgaccggtgctcgatttagtgtcgtcgcaagagagagggggaagaccgatgggcccttggtggaggcttggtgaagccgggggggtcccttagactctcctgtgcagtctctggactcaacctcaaaaatgcctggatgacctgggtccgccagactccgagggaaggggctgcaggtgggttggccgtattataaccaaacctgatggtgagacaacagactacgctgcaccgtgaaaggcagattcaccatctacaagagatgattcaaacgaacacgtcttgttttaggaaatgaacagcctagaaaaccgnggacacagtccgtttattctgttccacacctcctgacctanagtatatttcgnggactataatccgaccatagtggacgtcgtggggaccaagggaccacagtccaccgtctccctcaacctcccaaccgaacgggccccagttccggtcccttcccccgtggcccgtccctcgcctccgaggacgccaccctccgacgacgccacgacggccggcccgtcggggctcggccctcggtacaacggtaccttaccgttccctacg

SEQ ID NO: 319542 - DNA, 713 bp, Homo sapiens
  misc_feature: GZ8MTXP02JZUNK.4.71.G05.1.454.CMB.2.raw
  modified_base (246)..(246): a, c, t, g, unknown or other
  misc_feature (246)..(246): n is a, c, g, or t
tcagagcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggatcactgctctggagatgcattagaaccaaaaaaattntacgtacttagttacggtaacagacgaagaacgtcgacggaccgaacggaaccctaaagttcgtactatactagtagaacgaacgaaccgaaaccgacccgtacggactaccgtagagtacgtacttcgtccgtcgcctacgacgtcgtacggacggtactacgtcggtaccctacgttagactacgtacgacgggtaccgggaccgtaagggtacggaggtagtaggacgtcgtacgtacttactacgttacgttactaactaagtaagaagtaacgtagttagtaagtttaacggtttcgggttacgggttacgggtaccgggggtaacggggtaaacgggtaaaccgtaaacggttccggtaacccggttaccggttacggtaccgaaccggtaccccggtacggtcccgtccccggtaccccggtaccggtaccctacccgtttccgttaccccggtcccccg

SEQ ID NO: 319543 - DNA, 744 bp, Homo sapiens
  misc_feature: GZ8MTXP02IIYYH.4.71.G05.1.454.CMB.2.raw
  modified_base (226)..(226): a, c, t, g, unknown or other
  misc_feature (226)..(226): n is a, c, g, or t
  modified_base (247)..(247): a, c, t, g, unknown or other
  misc_feature (247)..(247): n is a, c, g, or t
tcagagcactgtagcacgaccggtgctcgatttagtgtcgtcgcaagagagaggggggtgggctcaggaggcagagctctgggaatctcaccatggcctggacccctctcctgcctcccccctcctcactttctgcacagtctctgaggcctcctatgagctgacacagcccaccctcggtgtcagtcgtccccaggacaacggccaggatcacctgctctggagntgctattagaaccaaaaaatntgtacttattggtaaccagcaagaagtcacggccacggacccccaaaattggtacatctaatgaaacgacgaacaaaaccgacccctaccggggactcccgtagaacgacgtaatttccgtaccgtcggcctccagtccttacgacgggtactagtcggaccctaccgtttgacttatcgaggtcggggaccctaagggtggaggtaagtaggaacgtcgtaggtaaccttaacgttacttacggtttaaaccctaagtaaagttaaacggaaacggtaaacgtaaggttaacgtaaagttttaaacgttttacggttagggggtttacggtttaccgggggaacgggtaaacgggggtaaaaccctaaaacggttaccgggtaaccgtttacccggtaaacgggttcccgaaacggttacccccgaacgggaaccgttccccggccccccgttacgggttaccctacccttacccgtttcccggtttaaccccccc

SEQ ID NO: 319544 - DNA, 572 bp, Homo sapiens
  misc_feature: GZ8MTXP02F50Z9.4.71.G05.1.454.CMB.2.raw
  modified_base (498)..(498): a, c, t, g, unknown or other
  misc_feature (498)..(498): n is a, c, g, or t
tcagagcactgtagcacgaccggtgctcgatttagtgtcgtcgcaagagagagggggaagaccgatgggcccttggtggaggcttggtgaagccggggggtcccttagactctcctgtgcagtctctggactcaacctcaaaaatgcctggatgacctgggtccgccagactccagggaagggctgcagtgggttggccgtattataaccaaacctgatggtgagacaacagactacgctgcacccgtgaaaggcagattcaccatctcaagagatgattcaacgaacacgctgtttttaggaaatgaacagcctagaaaaccgaggacacagccgtttatttctgttccacactcctcgcctacagagatttcgtgctataaatcgaccatatggacgtcgtggggccaaagggaccagagtcaccgttctccctcaaaccctccaccaacgggcccagtccgtccttcccccgtggcccgccctgcctcgcggacncacctccgagacgccacacgccggcccctggggcctcgccgtcggtaccaaacggaccttaaccttccctaacg

SEQ ID NO: 319545 - DNA, 815 bp, Homo sapiens
  misc_feature: GZ8MTXP02JO0SE.4.71.G05.1.454.CMB.2.raw
  modified_base (221)..(221): a, c, t, g, unknown or other
  misc_feature (221)..(221): n is a, c, g, or t
  modified_base (242)..(242): a, c, t, g, unknown or other
  misc_feature (242)..(242): n is a, c, g, or t
tcagagcactgtagcacgaccggtgctcgatttagtgtcgtcgcaagagagagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctgganatgcattgaaccaaaaaaatntagcttagttggtaccagcaagaagtcaggaccaaggacccccaaaagttcggtacaatctaataggaaagaaccgaaccgaaaaccgaccccgtacccggggaactcccctaggaacgtagtaactttccgtaccgtcgggccctaccaaggtcctacgaacggggtaccttaacgttcgggaccccctaaccgtttacgaaccgttaacgttaccgaaacgggttccgggggaccccgtaaaggggttcgggaacgggtaagttagaaacggtcgttaacggtaaccttaccgttacgtttaaacggtttaacccttaactaaaacgttaaggtaaaccggaaaactaaagggttagtttaaaacttaaaggtttttaccggttgggggtttacggttaccgggggttaacgggaaaccgggggtttaaaacccgaaaacgggtttcccgaaacccgggtttacccggttaaacggtacccgtaaccggtaccccgaaacggggttccccgtaccccggtacccccgttaccggtacccttacccgttcccgtttaccccggttacccccg

SEQ ID NO: 319546 - DNA, 669 bp, Homo sapiens
  misc_feature: GZ8MTXP02GRAOT.4.71.G05.1.454.CMB.2.raw
  modified_base (244)..(244): a, c, t, g, unknown or other
  misc_feature (244)..(244): n is a, c, g, or t
tcagagcactgtagcacgaccggtgctcgatttagtgtcgtcgcaagagagaggggggtggactcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggatcacctgctctggagatgcattgaaccaaaaaatntgacttattggtaccagcagaagtcaggccaggaccccaaattggacatctatagaagacgaacaaacgaccctacgggactccctagagagtattctaccgtcggacctccaagcgtacgaagggtactacgtcgggacccctacgttacgacttataccgaacggggttccgggggaccctaaagggtaggggaaggaagttacggaaagtccgtaggtaacctaactacgtttagttaacctacaaagttagaacgaaagtagtaagtaattaaagtttccgtaggggttcggttacgggacgggtaacggtaacctaaaacggttcggtacccggtacgtaacggtaccgaaccggtacccgaaagggtccgtacccgtcccccggtacggtacctaccgtttccgtaccgtttacccccc

SEQ ID NO: 319547 - DNA, 568 bp, Homo sapiens
  misc_feature: GZ8MTXP02F7VXL.4.71.G05.1.454.CMB.2.raw
  modified_base (244)..(244): a, c, t, g, unknown or other
  misc_feature (244)..(244): n is a, c, g, or t
  modified_base (258)..(258): a, c, t, g, unknown or other
  misc_feature (258)..(258): n is a, c, g, or t
  modified_base (280)..(280): a, c, t, g, unknown or other
  misc_feature (280)..(280): n is a, c, g, or t
  modified_base (286)..(286): a, c, t, g, unknown or other
  misc_feature (286)..(286): n is a, c, g, or t
  modified_base (321)..(321): a, c, t, g, unknown or other
  misc_feature (321)..(321): n is a, c, g, or t
  modified_base (335)..(335): a, c, t, g, unknown or other
  misc_feature (335)..(335): n is a, c, g, or t
  modified_base (337)..(337): a, c, t, g, unknown or other
  misc_feature (337)..(337): n is a, c, g, or t
tcagagcactgtagcacgaccggtgctcgatttagtgtcgtcgcaagagagaggggggtgggctcaggaggcagagctctgggaatctcaccatggcctggacccctctcctgcctcccccctcctcactttctgcacagtctctgaggcctcctatgagctgacacagccaccctcggtgtcagtgtccccaggacaaacggccaggatcacctgctctggagatgcattgaccaaaaaaatntgacttatgacagnagagcagacacgaccaaatganatatanagaagaacgaacaaacgacccacggactcctaganatatctctgcacancncgagatatcgacacctatactatcgagacggaccgaagtaggagagagagactagactactacttagttaactaactaaagtaagaaagaaagtaagtaagtaagttaagtttagttagggttaggttacgggtacgggaacgggtaaacgtaaaacgtaacgtaccgtaccgtacgtacgacgaccgaacgaaccgtccgtacccgtccgtaccgtacctctacgtcccg

SEQ ID NO: 319548 - DNA, 635 bp, Homo sapiens
  misc_feature: GZ8MTXP02F52GW.4.71.G05.1.454.CMB.2.raw
  modified_base (243)..(243): a, c, t, g, unknown or other
  misc_feature (243)..(243): n is a, c, g, or t
  modified_base (323)..(323): a, c, t, g, unknown or other
  misc_feature (323)..(323): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggatcacctgctctggagatgcattgaccaaaaaatntgcttatgtaccagcagagtcaggccggaccccaaattggcatctatgaagacgaacaaacgaccccgtacggactcccngagagtattctctcggcctccgagctcgagggactgtcggacctaccttgactagtcgagggtcggggacccaaggtcgggaagatagaagctagaactacgtactgtttacacgaaatacgaagaactaggtataaattaagtttcggtaggggttacgttcgggacgggtaacgggaaaccctaaaacggtcggtaacccgttccgtaaaggtaccgaaccgaccccggtaacggtcccgtaacccggtacccccccgttacgggtaccctaccgtttaccccgttcccggtttacccccgttccccccg

SEQ ID NO: 319549 - DNA, 660 bp, Homo sapiens
  misc_feature: GZ8MTXP02GIYHT.4.71.G05.1.454.CMB.2.raw
  modified_base (223)..(223): a, c, t, g, unknown or other
  misc_feature (223)..(223): n is a, c, g, or t
  modified_base (245)..(245): a, c, t, g, unknown or other
  misc_feature (245)..(245): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggatcactgctctgganatgctattcgaaccaaaaaatntgtacttagtaggtaccagcaagaagtcgaacggaccaacggaaccccctaaaaagttcggtacctaatactaagtagaaagaaccgaaacaaaaccgaccccgtaccgggactacccgtagaacgtagtacttctacgtcgcctcagctacgacgggtactagtcggacctaccgttagactagtcgaggtcgggaccaagggtacggaggagtagaacgtctacgtaactactacgttagttaacctataaagtaagaacgtaaacgagttaagtaagttaagtttcggtagggttcggtacgggtacggaacggtaaacctaaacgtacgtaccgtacgtaacggtccgaacgcccgaaacggcccgtccgtaccccgtacggtacctaccgttcccgttccgttaaccccc

SEQ ID NO: 319550 - DNA, 665 bp, Homo sapiens
  misc_feature: GZ8MTXP02GDRK4.4.71.G05.1.454.CMB.2.raw
  modified_base (223)..(223): a, c, t, g, unknown or other
  misc_feature (223)..(223): n is a, c, g, or t
  modified_base (245)..(245): a, c, t, g, unknown or other
  misc_feature (245)..(245): n is a, c, g, or t
  modified_base (443)..(443): a, c, t, g, unknown or other
  misc_feature (443)..(443): n is a, c, g, or t
  modified_base (521)..(521): a, c, t, g, unknown or other
  misc_feature (521)..(521): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagccaccctggtgtcagtcgtccccaggacaaacggccaggatcacctgctctgganatgcattagaaccaaaaaaatntagtacttagttcggtaaccagacaagaagtcgaaggacccaacggaccccctaaaaagttcggtactaatcctaataggaaacgaaccgaaaccgaaaaccgaccccgtacccgggactccccgtagacgagtactttcgtccgtggcctaccgagtcctacgaagggtactagtcggaccctaccgttgaacttancgtagggtcgggacccaaagggtggacggagtagacgtactagactaacgtacgttagttaccaagtaaagtagaaanaacgtagtaagtaagtttaaagtttcggtaggggttacgttacggggacggtaagggaacctaaaacgtcggtaccgtacgtaacggtcaacgtacccgaagccgttccgaccccgtcggtacctaccttcctacgttaccccc

SEQ ID NO: 319551 - DNA, 755 bp, Homo sapiens
  misc_feature: GZ8MTXP02F193I.4.71.G05.1.454.CMB.2.raw
  modified_base (180)..(180): a, c, t, g, unknown or other
  misc_feature (180)..(180): n is a, c, g, or t
  modified_base (224)..(224): a, c, t, g, unknown or other
  misc_feature (224)..(224): n is a, c, g, or t
  modified_base (246)..(246): a, c, t, g, unknown or other
  misc_feature (246)..(246): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagccaccctcggtntcagtcgtccccaggacaaacggccaggatcacctgctctgganatgctattgaaccaaaaaaatntgtactttagttggtaccagacaagaagtcaggccacggacccctaaaagttcggtacatctaagtagaaacgaaccgaaacgaaaccgacccgtaccgggactacccgtagaagacgtaactttcctaccgtcggtacctaccgaagtccgttaaccgaaggggtacctaacggtacgggacccttaaccgttacgtaacttacgtaccgtaaggggtccggggaacccgtaaagggtagggaaggtaagtaggaacgtacgtacggaacttaaactacgttaacgttacctaactaaaagtagaagtaaataaggtaactaaatttaacgtttcggtaagggttcggttacgggtaacggggtaacggaaaaccgtaaaacgttacggtaacccgttaccggttaaacggacccgtaaacggaccccgttaaaacggggccctttccccggacccccggtttaccgggacccgtaaccttccccggtttcccggtttaacccccccg

SEQ ID NO: 319552 - DNA, 698 bp, Homo sapiens
  misc_feature: GZ8MTXP02FOQKL.4.71.G05.1.454.CMB.2.raw
  modified_base (242)..(242): a, c, t, g, unknown or other
  misc_feature (242)..(242): n is a, c, g, or t
tcagagcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccagacaaacggccaggatcacctgctctggagatgcattgaccaaaaaaattntgtacttagttgtaccagacaagaagtcgacggccacggacccctaaagttggtacatctatagaacgaacgaaccaaaccgaccccgtaccgggactcccgtagagtagtactttctccgtcggcctaccgacgtcctacgaacgggtactacgtcggaccctaccgttagaacttagtacgtacgggtacggggacccgtaaaggtagggaaggtagtaggaacgtcgtacgtaaccttaacttacgttacgttaacctactaaagtaagtaacgtaaacgtagtagtaagtttaacgtttcggttaggggttacggttacggggacgggtaaacgggtaaacccgtaaaacgtaccggtaacccggttaccgtaacggtaccgaccggacccgaacggtcccgtacccggtcccccgtaccggtaccctaccgttcccgttcccgttaccccc

SEQ ID NO: 319553 - DNA, 676 bp, Homo sapiens
  misc_feature: GZ8MTXP02H5NI8.4.71.G05.1.454.CMB.2.raw
tcagagcactgtagcacgaccggtgctcgattttagtgtcgtcgcaagagagagggggaagaccgatgggcccttggtggaggcttggtgaagccgggggggtcccttagactctcctgtgcagtctctggactcaacctcaaaaatgcctggatgacctgggtccgccagactccagggaagggctgcagtgggttggccgtattataaccaaacctgatggtgagacaacagactacgctgcacccgtgaaaggcagattcacatctacaagagatgattacaacgaacacgtcttgttttaggaaatgaacagcctagaaaaccgaggacacagtccgtttattctagttccacactcctcgcctacagacgtatttcgtggactataactccgctatagtcggtacgtcgtacggggaccgaaacggggtaccaacgacgttaccgacccgttcctaccctaccgaaccctcccgaaacccgtaaacggggtaccccctacggttacccggttcccctttcccccgtcgggccccgtccccgttacgtcccgttcccggaacggaccgacccctaaccccgtaccggacgaccggccaaaccgcggacccggtcccgttgggcctcggcccggttacggtaccgaacggtacctttaccgttacccctaacg

SEQ ID NO: 319554 - DNA, 851 bp, Homo sapiens
  misc_feature: GZ8MTXP02JJ4GL.4.71.G05.1.454.CMB.2.raw
  modified_base (181)..(181): a, c, t, g, unknown or other
  misc_feature (181)..(181): n is a, c, g, or t
  modified_base (225)..(225): a, c, t, g, unknown or other
  misc_feature (225)..(225): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcacttttctgcacagtctctgaggcctcctatgagctgacacacgccacctcggtntcagtcgtcccaggacaacggccaggactcacctgctctagganatgactattacgaaaccaaaaaaatctagtacttaagttacggtaaccagacaagaaagtcgaacggcccaacggaccccctaaaagttcggactaatctaagtaggaaacgaacgaaccaaaaccgaccccgtaccggggactaccccgtagaagacgtaacttccgtacccgttcggcccttaccgaaggcccttacggaacggggtaccgtttaaacgtcccggggtacccttaacccgttttacggaaacttaccgttaccggtaaacgggggttcccgggggaaaccccctaaaagggggttacggggaaaggggtaacgttaaagggtaaacggaccccgtttaagggtaaaacccgtttaaaccttaaccggtttaacggtttttaaacccaaccggtaaaagttacccggggaaaataaaccgtaaagttaaccgttaagtttaaaacggtttttcgggtacgggtttacgggggttacggtaaacgggggaaccggtaaaacccgtaaaacggtccggtaaacccggtacggttacggtaccgtaaaccggaccgaacggggaacccttccccggaacccgttcggtacctaccgttacccgttccgttaccccccc

SEQ ID NO: 319555 - DNA, 690 bp, Homo sapiens
  misc_feature: GZ8MTXP02F44SK.4.71.G05.1.454.CMB.2.raw
  modified_base (223)..(223): a, c, t, g, unknown or other
  misc_feature (223)..(223): n is a, c, g, or t
  modified_base (244)..(244): a, c, t, g, unknown or other
  misc_feature (244)..(244): n is a, c, g, or t
tcagagcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggcaggatcacctgctctgganatgctattgaaccaaaaaatntagacttagtggtaccagcaagaagtcgacggaccaacggacccctaaaagttcggtactaattctaagtacggaaacgaaccgaaaccaaaaccggtaccccgtaccgggaactcccccgtaggaaacgtacgtaactttctacccgtcggtacctaccgaacgtcctacggaacgggtacttacgtcgggaccctaaccgtttagaacttacgtcgtacgggtcgggacccgtaaagggtcgggaaggagtagaacgtcgtaacgtactaaccgtattacgttaacataagtagaacaagtagtagtaatttaacgtttggtaaggggttcgttacgggacggggtaacggaaccgtaaaacgtccgtacccgttacgtacggtacgaaccgccgtaacggtccgacccgtcccgtacggtcctacgtccgttccgttcccccg

SEQ ID NO: 319556 - DNA, 625 bp, Homo sapiens
  misc_feature: GZ8MTXP02FZK89.4.71.G05.1.454.CMB.2.raw
  modified_base (244)..(244): a, c, t, g, unknown or other
  misc_feature (244)..(244): n is a, c, g, or t
  modified_base (392)..(392): a, c, t, g, unknown or other
  misc_feature (392)..(392): n is a, c, g, or t
tcagagcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtcgtccccaggaccaaacggccaggatcacctgctctggagatgcattgaaccaaaaaatntgacttattggtaccagcagaagtcaggccacggacccctaaaattggcatctatagaagacgaacaaaccgaccccgtaccgggactccctagagagtacttctcgtcgctcagctcgagggtctagcggtccctaccgttgactancgtaggtcggggacccaggtggagagtgaagctagactactattagttacactaagtacgaagaacgtagtagtatttaacgtttcggtagggggttcgttacggggacggggtaaccggtaaaccgtaacggttacgaacccggttacgttaacgggtcgaacccggtacccgaacggtcccgtacccgtacccccgttacggtccctacccgttcttcccggtttaccccc

SEQ ID NO: 319557 - DNA, 590 bp, Homo sapiens
  misc_feature: GZ8MTXP02FQAWB.4.71.G05.1.454.CMB.2.raw
  modified_base (322)..(322): a, c, t, g, unknown or other
  misc_feature (322)..(322): n is a, c, g, or t
  modified_base (529)..(529): a, c, t, g, unknown or other
  misc_feature (529)..(529): n is a, c, g, or t
tcagagcactgtagcacgaccggtgctcgatttagtgtcgtcgcaagagagagggggaagaccgatgggcccttggtggaggcttggtgaagccggggggtcccttagactctcctgtgcagtctctggactcaacctcaaaaatgcctggatgacctgggtccgccagactccagggaagggctgcagtgggttgccgtattataaccaaacctgatggtgagacaacagactacgctgcacccgtgaaaggcagattcaccatctcaagagatgattcaacgaacacgctgttttggaaatgaacagcctagaaaaccgnggacacagtccgtttattctgttccacactcctgcctacagacgtatttccgtggactataaactcgaccatagtggacgtcgtggggacccaagggaccacagtccacccgttctccctcaaccctccaacctaacgggccccagtcccggtcccttcccccgtggcccgcccgtcgcctccgacggacgccacccgtccgagacncacgacgccggccctggggcctcggcccgtcggtaccaaggtacctaccgttcccgtaacg

SEQ ID NO: 319558 - DNA, 673 bp, Homo sapiens
  misc_feature: GZ8MTXP02F26H9.4.71.G05.1.454.CMB.2.raw
  modified_base (224)..(224): a, c, t, g, unknown or other
  misc_feature (224)..(224): n is a, c, g, or t
  modified_base (248)..(248): a, c, t, g, unknown or other
  misc_feature (248)..(248): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggatcacctgctctgganatgctattacgaaccaaaaaaatntgactttagttggtaccagcaagaagtcgaggccaacggaccccaaaattggcatctatagaacgacgaacaaaccgacccgtaccgggactcccgtagagagtacttctccgtcggcctcgacgtctacgaagggtctagtcggaccctaccgttgaacttagcgtagggtcgggacccgaaggtacgggaggagtagacgtctacgaacttacgtacttagttaactacgtaaatagaagtaaacgtagtaagtaatttaagtttcggttagggttacggttacggggacggggtaacgggtaaaccgtaaacggttacggtaacccggttaccgtacgggtaccgtaaccggacccggtaaacggtcccgtcccggtacccccgttcggtacctaccgttcccgttacccgtttaccccccg

SEQ ID NO: 319559 - DNA, 721 bp, Homo sapiens
  misc_feature: GZ8MTXP02G41TD.4.71.G05.1.454.CMB.2.raw
  modified_base (225)..(225): a, c, t, g, unknown or other
  misc_feature (225)..(225): n is a, c, g, or t
  modified_base (247)..(247): a, c, t, g, unknown or other
  misc_feature (247)..(247): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctgganatgctattcgaaccaaaaaatntgtacttagttacggtaccagacaagaacgtcgacggaccaacggaacccctaaaagttcggtacatctaagtagaacgaacgaacgaaaccgaccccgtacgggactcccgtagaacgtagtacttctccgtcggcctacgacgtcgtacgagggtactacgtcggaccctaccttgtaactagtcggtaacgggtcggggacccgtaagggtacggggtaaggaagtacggaaacgtctaacggtaacttaaccgttacgttacgttaaccgttaaacaaacgtttaacggaaacgtaaaccgtaaggttaacgtaaagtttaacggttttcggtaggggtttcgggttacggggacgggtaaccggtaaccgtaaaacgtcgggtaacccgttacgtacggtaccgaccgtacccgtaacgggtcctcccggtacccccgtcggtaccctcgttcccgtcctttacccccg

SEQ ID NO: 319560 - DNA, 762 bp, Homo sapiens
  misc_feature: GZ8MTXP02HD8EI.4.71.G05.1.454.CMB.2.raw
  modified_base (225)..(225): a, c, t, g, unknown or other
  misc_feature (225)..(225): n is a, c, g, or t
  modified_base (245)..(245): a, c, t, g, unknown or other
  misc_feature (245)..(245): n is a, c, g, or t
  modified_base (294)..(294): a, c, t, g, unknown or other
  misc_feature (294)..(294): n is a, c, g, or t
tcagagcactgtagcacgaccggtgctcgatttagtgtcgtcgcaagagagagggggtgggctcaggaggcagagctctgggaatctcaccatggcctggacccctctcctgctcccccctcctcacttttctgcacagtctctgaggcctcctatgagctgacacagcccaccctcggtgtcagtcgtccccaggacaaacggccaggatcacctgctctgganatgcattgaaccaaaaaatntgtcttattggtaccagcagaagtcaggccaacggaccccaaaattcgnatctatagaacgaacgaacaaaaccgaccccgtaccgggactcccgtaggaacgagtactttcctaccgtcggtccctaccgaagtccgttaccgaacgggtaccgtagttcgggaccctaaccgttaggaaccttaacgtacgtacggggttacggggacccccgtaaagggtacgggaaggtagtaaggtacgtaccgtaggtaaccttaacgtaacttacggttaacctaactaaagttaagaacgtaaaacgtaagtacgttaaagttaaacgtttggttacggggtttacggtttacggggaacgggtaaccgggttaaaaccgtaaacccggttacggtaaccccggttaccgttacgggttaccgtaacccggaaccccggtaaacggtccccgttaacccggccccccggtttacgggtacccttaacccgtttcccgtttacccggtttaccccccccg

SEQ ID NO: 319561 - DNA, 720 bp, Homo sapiens
  misc_feature: GZ8MTXP02IOVN5.4.71.G05.1.454.CMB.2.raw
  modified_base (248)..(248): a, c, t, g, unknown or other
  misc_feature (248)..(248): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggcaggatcacctgctctggagatgctattagaacctaaaaaaatntgtacttagttggtaaccagcgaaagaacgtcgaacggtacccaacgggaacccctaaaagttcggtacctaattactaagtaaggaaaacgtaacgaaaccgaaaacccggtcccccgtaccggggactaccccgtaggaagtaacgtaactttcctacccgtcggtaccctaccgaacgcccgttacggaacgggtaccttacgtccgggaccccttacttacggactacgtacgacgggttcggacccgtagtacggggagtagtacgaacgtctaggaaacttaccgttacttacttaacaacgtaaataacggaagtaagtaagtagttaatttaacgtttcggtaggggttggttaccggggagggtaacggtaaacccgtaagtcggaaccggtacggtacgtaccgaaccgtccgaaacggtccgtaccgccccggtcgtaactccgttcttacccgttccccc

SEQ ID NO: 319562 - DNA, 651 bp, Homo sapiens
  misc_feature: GZ8MTXP02IDEC9.4.71.G05.1.454.CMB.2.raw
  modified_base (226)..(226): a, c, t, g, unknown or other
  misc_feature (226)..(226): n is a, c, g, or t
  modified_base (247)..(247): a, c, t, g, unknown or other
  misc_feature (247)..(247): n is a, c, g, or t
  modified_base (345)..(345): a, c, t, g, unknown or other
  misc_feature (345)..(345): n is a, c, g, or t
tcagagcactgtagcacgaccggtgctcgatttagtgtcgtcgcaagagagaggggggtgggctcaggaggcagagctctgggaatctcaccatggcctggacccctctcctgcctcccccctcctcactttctgcacagtctctgaggcctcctatgagctgacacagcccaccctcggtgtcagtcgtccccaggacaaacggccaggatcacctgctctgganatgcattgaaccaaaaaaatntgacttatggtaccagcagaagtcaggccaacggaccccaaaattggcatctatgaagacgacaaaccgcccgtaccgggactccctgagacgattcncgtgctccagctacgagggacctagtcggaccctacttgaactatcgaggtcgggacccaaaggtggaggagtagaaacggctaggtaactacttacttagttaaacctactaaaagtagaaaggaaacctaagttaagtaaatttaaaagttttccggtagggggtttggtttaacccggggaggggaaacgggtaaaaccctaaaacggttcgaaacccggttacccgtaggttaccgaaccggacccgtaaacggcctcccggtaccccctcggtacctaccttccgttcccttaaccccccg

SEQ ID NO: 319563 - DNA, 668 bp, Homo sapiens
  misc_feature: GZ8MTXP02HHMVW.4.71.G05.1.454.CMB.2.raw
  modified_base (248)..(248): a, c, t, g, unknown or other
  misc_feature (248)..(248): n is a, c, g, or t
  modified_base (615)..(615): a, c, t, g, unknown or other
  misc_feature (615)..(615): n is a, c, g, or t
  modified_base (638)..(638): a, c, t, g, unknown or other
  misc_feature (638)..(638): n is a, c, g, or t
  modified_base (654)..(654): a, c, t, g, unknown or other
  misc_feature (654)..(654): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagcccaccctcggtgtcagtcgtccccaggacaacggccaggatcacctgctcgtggagatgctatacgaaacaaaaaaatntgtacttataggtaccagcaagaacgtcgaaggccaacggaaccccctaaaagttcggtactaataccgtaaagtaggaaaacgaacccggaaaccctaaaacccggtacccccgtacccggggaaccttcccccgtaggaaacggtaacgtactttccgtccgtcgggacccttccgacgtcctacggaacggggtacctagttcggacccctacttacgactagtccgtagggccggacccgtaaggtgggaagtaggtagaacgtctacggtaaccttacgtagttacttaaacgtactaaaagtaagaataaaccgagtaagtattaagttcggtggttaggtcggaggtacggaactaacgngaccgtcgagtcgaccgtccganccgcgtcccctggacncctctccgtacccc

SEQ ID NO: 319564 - DNA, 600 bp, Homo sapiens
  misc_feature: GZ8MTXP02I5Q0J.4.71.G05.1.454.CMB.2.raw
  modified_base (245)..(245): a, c, t, g, unknown or other
  misc_feature (245)..(245): n is a, c, g, or t
  modified_base (308)..(308): a, c, t, g, unknown or other
  misc_feature (308)..(308): n is a, c, g, or t
  modified_base (468)..(468): a, c, t, g, unknown or other
  misc_feature (468)..(468): n is a, c, g, or t
tcagagcactgtagcacgaccggtgctcgatttagtgtcgtcgcaagagagaggagggggggctcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggatcacctgctctggagatgctattgaccaaaaaaatntgacttagtggtaccagcgtaagaagtcaggcctaacggaccccaaaagttggtacatcttanaggaagacgaacaaaaccgccgtaccgggatcccgtgagagattcgacctggcctcgagtctccgagggtactactcgggacctacctgtactactcgacgtggggacccaaggtacgggaggatggaaacgctacgaactacgtacttagtacctaaanaaagtagaagtaagtagtagtaagttacgttcgtaggtggtacgggaggaacggtaacctaacgacggtaccgtacgtacggacgacgaccgacgtcgtcccgtacccgtcgcgtaccttcgtcgttccccg

SEQ ID NO: 319565 - DNA, 608 bp, Homo sapiens
  misc_feature: GZ8MTXP02GXE5V.4.71.G05.1.454.CMB.2.raw
  modified_base (377)..(377): a, c, t, g, unknown or other
  misc_feature (377)..(377): n is a, c, g, or t
  modified_base (510)..(510): a, c, t, g, unknown or other
  misc_feature (510)..(510): n is a, c, g, or t
tcagagcactgtagcacgaccggtgctcgatttagtgtcgtcgcaagagagagggggaagaccgatgggcccttggtggaggcttggtgaagccgggggggtcccttagactctcctgtgcagtctctggactcaacctcaaaaatgcctggatgacctgggtccgccagactccagggaagggctgcagtgggttggccgtattataaccaaacctgatggtgagacaacagactacgctgcaccgtgaaaggcagattcaccatctacaagagatgattcaacgaacacgtctagttttaggaaatgaacagcctagaaaaccgaggacacgagtcccgtttatttctgttaccactacctccctgacccctaanagtagtattttcgagacctataaactcgaccaatatggactcgtggggaccaaaggggaccaacgagtccaacccgtctaccctaccaaccctaccaacccgaaagggccccaacgtccgtcccttcccccgnggtcccgcccgtcgcctccgacgacgacaccgaccgacgacgacacgacgccgcccgtcggcgtcgccgtcggtacgtacggactacctaccctaccg

SEQ ID NO: 319566 - DNA, 686 bp, Homo sapiens
  misc_feature: GZ8MTXP02HQ1Q7.4.71.G05.1.454.CMB.2.raw
  modified_base (246)..(246): a, c, t, g, unknown or other
  misc_feature (246)..(246): n is a, c, g, or t
tcagagcactgtagcacgaccggtgctcgatttagtgtcgtcgcaagagagaggggggtgggctcaggaggcagagctctgggaatctcaccatggcctggacccctctcctgcctcccccctcctcactttctgcacagtctctgaggcctcctatgagctgacacagcccaccctcggtgtcagtcgtcccaggacaacggccaggatcacctgctcgtggagatgctattgaaccaaaaaatntagcttatggtaccagcaagaagtcaggaccacggaccccaaaagttggacatctaagtgaaagacaacaaaccgaccctcgggaactccgtgacgagtacttctaccgtggtcctacgacggtctaccggaaggggtaccttagtacggaccctaccgtttcgaacttagtcgagggtcggggacccgtaaggtacggggaggagtaggaaacgtcgtacgaacttactaccgttagtttaacctactaaaagttaagaaacgaacgtaagttagtaaatttaaacggtttggtaggggtttacggttacggggacgggtaaaccgggaaccgttaaaacggtcggtaaaccccggttacgttaaacggtcccgaaccgacccgtaacggcccgttcccgtcccccgtccggtaacctccctccgttcccgttcccccg

SEQ ID NO: 319567 - DNA, 659 bp, Homo sapiens
  misc_feature: GZ8MTXP02JGPNP.4.71.G05.1.454.CMB.2.raw
  modified_base (225)..(225): a, c, t, g, unknown or other
  misc_feature (225)..(225): n is a, c, g, or t
  modified_base (246)..(246): a, c, t, g, unknown or other
  misc_feature (246)..(246): n is a, c, g, or t
tcagagcactgtagcacgaccggtgctcgatttagtgtcgtcgcaagagagaggggggtgggctcaggaggcagagctctgggaatctcaccatggcctggacccctctcctgcctcccccctcctcactttctgcacagtctctgaggcctcctatgagctgacacagccaccctcggtgtcagtcgtccccaggacaaacggccaggatcacctgctctggantgctattagaaccaaaaaatntgtacttagttcggtaaccagcagaagtcaggccacgacccaaatgcatctatgaagacgacaaccgacccctcgggactccctagagagtacttctcgtcgcctcacgtctacgagggtactagtcggccctaccgtagattacgtcgacgggtcgggtacccgtaaagggtcgggaaggagtaggacgtcgtagtacctacgtacgttaagttactaactaacgttaagaacgtaaacgtaaggttagtaagtttaggtttacggttggggttacggttaccggggacggggtaacggtaaacccgtaaacgtaccggtacccggtaccgtacgggtaccaaccggacccggaacggtcccgtacccgtccccggttacggtccctaccgttccgttaccgtttacccccc

SEQ ID NO: 319568 - DNA, 746 bp, Homo sapiens
  misc_feature: GZ8MTXP02FLPBR.4.71.G05.1.454.CMB.2.raw
  modified_base (261)..(261): a, c, t, g, unknown or other
  misc_feature (261)..(261): n is a, c, g, or t
tcagagcactgtagcacgaccggtgctcgatttagtgtcgtcgcaagagagaggggggtgggctcaggaggcagagctctgggaatctcaccatggcctggacccctctcctgctcccccctcctcactttctgcacagtctctgaggcctcctatgagctgacacacgcccacccgtcggtgtcagtcgtaccccgaggaaccaaacggccaggatccacctgctcgtaggagatgactattacgaaacctaaaaaattntagtactttagttacggtaaccagacaagaacgtcgaccggaccgaaccggaacccctaaaagttcggactaacgtactaagtacgaaacggaaccgaaaccgtaaaacccggacccccggtacccggggaccttaccccgtaggaaacgtagtaactttcgtcccgtcgccttacgacgtcctacggaacgggtacctacggtccggtaccctaccgttagaacttacgtacggtacgggtaccggggaacccgtaagggtaggggaaggtaagtacggaacgtcgtacgtaccttacgtacttacgttaacctataaacgtaagtaacgaaagtagtagtaattaagtttcggtagggttcggttacggggacgggtaacggaaaccgtaacgtacggtacccgttacgtacggtaccgaccgccgaacggtcccgtcccggtaccccgtccggtacctaccgttccttccccgttacccccc

SEQ ID NO: 319569 - DNA, 617 bp, Homo sapiens
  misc_feature: GZ8MTXP02IJ269.4.71.G05.1.454.CMB.2.raw
  modified_base (225)..(225): a, c, t, g, unknown or other
  misc_feature (225)..(225): n is a, c, g, or t
  modified_base (246)..(246): a, c, t, g, unknown or other
  misc_feature (246)..(246): n is a, c, g, or t
  modified_base (455)..(455): a, c, t, g, unknown or other
  misc_feature (455)..(455): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacacgccaccctcggtgtcagtcgtccccaggacaaacggccaggatcacctgctctgganatgcattgaaccaaaaaaatntgcttatggtaccagcaagagtcaggccaggaccccaaaattggacatctaatagaaacgaacgaacaaaaccgccctacgggactcccgtagacgtagacttctctaggcctccagtctacgagggactagtcggaccctaccgttgactaattccgaggtcggggacccaaaggtcgggaaggatgaaagtctagaactacttagtnttaactataataagaactaagagtagaaatttaagttcggtggggttacgttacgggacggaacggtaaccgtaaaacgttcggaacccgtacttaacgggccaacggacccgaaggtccgtcgacccccgtttcggcctaccctccgtttcgttccccccg

SEQ ID NO: 319570 - DNA, 815 bp, Homo sapiens
  misc_feature: GZ8MTXP02J3FZN.4.71.G05.1.454.CMB.2.raw
  modified_base (248)..(248): a, c, t, g, unknown or other
  misc_feature (248)..(248): n is a, c, g, or t
tcagagcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggatcacctgctctggagatgctattagaaccaaaaaaattntagtacctttagttacggtaaccagaccaagaaacgtcaacgaaccgacggaccccctaaaaagtttcggtactaatacctaatacggaaacgaaccgaaaccgaaaaccggccccgtaccggggtactccccgtaggaacgagtacttccgtccgtcggtacctccgaagtcctacggaacggggtacctagtaccgggtaccctaccgtttaggaacctttacgtccgaacggggtttaccgggggaccctaaaggggttggggaaacggttagacgggtaaacgacgtacgtaaaccgttactacgttacgttaacctacaaagttacgaaacgtaaacgtaagggttactaacgttttaaagttccgggtttaggggttaccggttacggggaaaccgggggtaacggtaaaaccccgtaaaacggtccggtaaaccccggttaccgttaaccgggaccgtaacccgggacccccgtaaaacggggtcccgttaaccccgggtaaccccccggttcgggtaaccccttaacccgttacccggttccccgtttaaccccccccg

SEQ ID NO: 319571 - DNA, 623 bp, Homo sapiens
  misc_feature: GZ8MTXP02H1H98.4.71.G05.1.454.CMB.2.raw
  modified_base (223)..(223): a, c, t, g, unknown or other
  misc_feature (223)..(223): n is a, c, g, or t
  modified_base (230)..(230): a, c, t, g, unknown or other
  misc_feature (230)..(230): n is a, c, g, or t
  modified_base (560)..(560): a, c, t, g, unknown or other
  misc_feature (560)..(560): n is a, c, g, or t
  modified_base (583)..(583): a, c, t, g, unknown or other
  misc_feature (583)..(583): n is a, c, g, or t
  modified_base (599)..(599): a, c, t, g, unknown or other
  misc_feature (599)..(599): n is a, c, g, or t
tcagagcactgtagcacgaccggtgctcgattttagtgtcgtcgcaagagagagggggaagaccgatgggcccttggtggaggcttggtgaagccgggggggtcccttagactctcctgtgcagtctctggactcaacctcaaaaatgcctggatgacctgggtccgccagactccagggaagggctgcagtgggttgccgtattataaccaaactgatggtnagacaangactacgctgcaccgtgaaaggcagattccacatctacaagagatgaattacaacgacacgtcttgttttagaaatgaacagtacctagaaaaccgaggacaacgtacgtccgttttatttctcgttccaactacctcccgtagaccctaacaggacgttaactttcggtacggacttaattaaactccgaccttaagtagcgggtaaccgtcgtacggggaccgaacgggacctaacgtacgttaccacccgttctaccctaccaaccctacccgaaccgaaccgggccctaacgtccggttcccctcccgtcgcccgtccctcgtccnccgaggcaccaccgtcgagaccncacgcgtccgcgtgcncgcgtacgacacgtcctactcacg

SEQ ID NO: 319572 - DNA, 783 bp, Homo sapiens
  misc_feature: GZ8MTXP02GDCW3.4.71.G05.1.454.CMB.2.raw
  modified_base (246)..(246): a, c, t, g, unknown or other
  misc_feature (246)..(246): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctggagatgctattgaaccaaaaaatntgcttagttggtaccagcaagaagtcacggccacggaccccaaaagttcggacatctatagaaagaccgaacaaaccgcccctacgggactcccgtagagagtacttctccgtcggaccctcgaacgtcctaccggaacggggtaccttacgtccgggtacccttaaccgtttcggaaacttacgttccgaaacggggttccgggggaacccctaagggtacgggaacggtaagttacggaacgtccgttaggtaaaccttaccgttaacgttacggtttaaccctaacgtaaaggttaaacggaaacgtaaaccggtaagttaacgtaaattttaaaggttttccggtagggggtttaccggttaccgggggtaacgggggaaacccggtaaaaccgttaacgtaccggggttacccgtttaccgggaacggttacccgaaccggaaccccgtaaagggtccccgtttaccccgggaccccccgtttccggggtaacctaccccggtttcccgttaccccgggtttaccccccccg

SEQ ID NO: 319573 - DNA, 742 bp, Homo sapiens
  misc_feature: GZ8MTXP02I8KT5.4.71.G05.1.454.CMB.2.raw
  modified_base (251)..(251): a, c, t, g, unknown or other
  misc_feature (251)..(251): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagcccaccctcggtgtcagtcgtccccgaggacaaacggccaggatcacctgctcgtggagatgctattacgaacctaaaaaatntgtacttagttacggtaccagacaaggaagtcgacggacccgaacggaaccccctaaaagttcggtactaactactaagtagaaacgaaccgaaccgaaaacccggtaccccgtacccggggacttaccccgtaggaacgtacgtaactttccgtccgtcggtacctacccgacggtcctaccggaacgggtacctacgtaccgggtacccctaccgttacggacttacgtacgtaggggtccggggaaacccgtaagggtgggaaggtagtagaacgtacgtagtaacctacgttacgttaggttaacccaataaaacgtagaaactaacgtaagtagtaatttaacgtttcgggtgggttacggtcgggaagggtaaccgtaaccgtaacgtacggaaccgttaccgtaacgggtacccgaacggacccgtaacggtcccgtacccggtcccccgtacgtccctaaccgttcccgtcccgttacccccc

SEQ ID NO: 319574 - DNA, 612 bp, Homo sapiens
  misc_feature: GZ8MTXP02FK0MB.4.71.G05.1.454.CMB.2.raw
  modified_base (226)..(226): a, c, t, g, unknown or other
  misc_feature (226)..(226): n is a, c, g, or t
  modified_base (246)..(246): a, c, t, g, unknown or other
  misc_feature (246)..(246): n is a, c, g, or t
  modified_base (347)..(347): a, c, t, g, unknown or other
  misc_feature (347)..(347): n is a, c, g, or t
  modified_base (393)..(393): a, c, t, g, unknown or other
  misc_feature (393)..(393): n is a, c, g, or t
tcagagcactgtagcacgaccggtgctcgatttagtgtcgtcgcaagagagaggggggtggggctcaggaggcagagctctgggaatctcaccatggcctggacccctctcctgctcccccctcctcactttctgcacagtctctgaggcctcctatgagctgacacagcccaccctcggtgtcagtcgtccccaggacaaacggccaggatcacctgctctgganatgcattgaccaaaaaaatntgattatggtaccagcagaagtcagccaggaccccaaagttggtacatctatagaagacgaacaaaccgacccctaccgggatcccgtagagagtacttcnccgtgcctcagctacgagggtactgacggccctaccgttagactanacgagggtcggggacccaaggtggtaggagtagaacgtctacgtactactagttagttaactacaaagtagaagaaacgtagttagaatttaacgtttcggtaggggttgttaccggggagggtaacggaaacgtaacgtaggtacccgtacgtacggtacgacgacccgaacggccgtcccgtaccccgtcgtaccgtacgtcccgtacgttcccccg

SEQ ID NO: 319575 - DNA, 557 bp, Homo sapiens
  misc_feature: GZ8MTXP02GJJ1T.4.71.G05.1.454.CMB.2.raw
  modified_base (240)..(240): a, c, t, g, unknown or other
  misc_feature (240)..(240): n is a, c, g, or t
  modified_base (259)..(259): a, c, t, g, unknown or other
  misc_feature (259)..(259): n is a, c, g, or t
  modified_base (403)..(403): a, c, t, g, unknown or other
  misc_feature (403)..(403): n is a, c, g, or t
  modified_base (448)..(448): a, c, t, g, unknown or other
  misc_feature (448)..(448): n is a, c, g, or t
  modified_base (453)..(453): a, c, t, g, unknown or other
  misc_feature (453)..(453): n is a, c, g, or t
tcagagcactgtagcacgaccggtgctcgattagtgtcgtcgcaagagagagggggtgggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctggagatgcattgaccaaaaaatntgcttatggacagcagtancagccaggaccccaaagttgcatctatagaagacgaacaaaccgtacccgtaccgggatcccgtagaagagtattctccgttggactccagctacgagggctagcggcctaccgttgactatcgaaggtggggaccctaaaggnggaagagtacgaagtcctagtactactactagtttacacgtaaanagaanaacgagtagaattaacttgtgggtgttcgggagggaacggacaaacgttgaccgtcgtacgcacgcccgtaagccgtcgcccctcggtcactcctctaaccccc

SEQ ID NO: 319576 - DNA, 682 bp, Homo sapiens
  misc_feature: GZ8MTXP02IF05K.4.71.G05.1.454.CMB.2.raw
  modified_base (251)..(251): a, c, t, g, unknown or other
  misc_feature (251)..(251): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagcccacccgtcggtgtcagtgtccccaggacaacggccaggatcacctgctcgtggagatgactattagaacctaaaaaaattntgtactttagttacggtaccagcaagaagtcgacggaccacggacccctaaaagttcggtacatctaataggaaacgacgaaccgaaaaccgaccccgtaccggggacttccccgtaggaacgtagtactttccgtaccgtcggtcctcccgaagtcctacggacgggtactacgtcgggtaccctaccgtttagaactacgtacgagggtccggggtacccaaaggggtggaaggagtagaacgtctacgtactaacgttacgttagttaaccctataaacgtagaaacggtaactaagtagtaaactttaagtttcggtaagggttcggttacgggacgggtaacggtaaaccgtacgtcgaaccgttaccgacggtcacgacccgtaggcccgtacgccccgtcgtcctaccgtcctccggttccccc

SEQ ID NO: 319577 - DNA, 604 bp, Homo sapiens
  misc_feature: GZ8MTXP02I3FWG.4.71.G05.1.454.CMB.2.raw
  modified_base (310)..(310): a, c, t, g, unknown or other
  misc_feature (310)..(310): n is a, c, g, or t
  modified_base (323)..(323): a, c, t, g, unknown or other
  misc_feature (323)..(323): n is a, c, g, or t
  modified_base (357)..(357): a, c, t, g, unknown or other
  misc_feature (357)..(357): n is a, c, g, or t
  modified_base (364)..(364): a, c, t, g, unknown or other
  misc_feature (364)..(364): n is a, c, g, or t
  modified_base (376)..(376): a, c, t, g, unknown or other
  misc_feature (376)..(376): n is a, c, g, or t
tcagagcactgtagcacgaccggtgctcgatttagtgtcgtcgcaagagagaggggaagaccgatgggcccttggtggaggcttggtgaagccggggggtcccttagactctcctgtgcagtctctggactcaacctcaaaaatgcctggatgacctgggtccgccagactccagggaaggggctgcagtgggttggccgtattataaccaaacctgatggtgagacaacagactacggctgcacccgtgaaaggcagattcaccatctcaagagatgattcaacgaacacgctgttttagaaatgaacngactagaaaccgngacacagtcccgtttattctgttaccacactccncgcctanagactatttcgngactataactcgacctagtactggacgtcgtagggccaagggaccacagtacacccgtctaccctcaaaccctccaaccgaacggcccaactcaaccgttccttacccccgtggccctcccgtcgtccttacccgaggacgacccgaacccgttccgaacgacgacgacacggcccggcccttagggccgtcggtcctcggggtacaacggccttaaccgtttccccg

SEQ ID NO: 319578 - DNA, 590 bp, Homo sapiens
  misc_feature: GZ8MTXP02FXYCV.4.71.G05.1.454.CMB.2.raw
tcagagcactgtagcacgaccggtgctcgatttagtgtcgtcgcaagagagagggggaagaccgatgggcccttggtggaggcttggtgaagccggggggtcccttagactctcctgtgcagtctctggactcaacctcaaaaatgcctggatgacctgggtccgccagactccagggaaggggctgcagtgggttggccgtattataaccaaacctgatggtgagacaaacagactacgctgcacccgtgaaaggcagattcaccatctcaagagatgattcaaacgaaacacgctagtttttggaaaatgaaacagcctagaaaaaccgaggacacagaccgtttatttctgttccacactccctgcctacagagatttcgagctataaatcgacctatagtggacgtcgtgggggacccaaagggaccaacgagttccaccgttctccctcaaaaccctccaaccgaacggacccagtccgtcccttcccccgtcggcccgccctgcctccgaggacgccaccctccgacgacgacacacgccgcccgcggcgcgcgtcggtacgaacgaacgtaacctaccctacg

SEQ ID NO: 319579 - DNA, 747 bp, Homo sapiens
  misc_feature: GZ8MTXP02FI2IC.4.71.G05.1.454.CMB.2.raw
  modified_base (249)..(249): a, c, t, g, unknown or other
  misc_feature (249)..(249): n is a, c, g, or t
  modified_base (311)..(311): a, c, t, g, unknown or other
  misc_feature (311)..(311): n is a, c, g, or t
  modified_base (363)..(363): a, c, t, g, unknown or other
  misc_feature (363)..(363): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctcgtggagatgcattacgaaccaaaaaaatntgtacttaagttggtaaccagcaagaagtcaggccacggacccctaaaattcggacatctanagaaacgacaacgaaaccgacccgtacgggactcccgtagagagtactttcnccgtcggacctcgacgctacggaacgggtctaagcggtacctaccgttacgaacgttactcgtagggtacggggaccccgtaaaggggttacgggaaggtaagttacggaacgtacgtaacggtaaccttaaaccgttaacgttaacggtttacctaaacgtaaacggttaaggaaacgtaaaaccggtaaggttacgtaaaagttttacgtttacgggttggggttacggggttacgggggtaacgggaacggggtaaaaccctaacggttacggtaaccccggttacggtaaccggtccgaaccggacccggtaaacggcccgttaacccggtcccccgttacgggtaccctaacccgtttccgtaccccgtttaccccccg

SEQ ID NO: 319580 - DNA, 798 bp, Homo sapiens
  misc_feature: GZ8MTXP02HA491.4.71.G05.1.454.CMB.2.raw
  modified_base (247)..(247): a, c, t, g, unknown or other
  misc_feature (247)..(247): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagccaccctcggtgtcagtcgtccccaggacaaacggcaggatcacctgctctggagatgcattacgaaaccaaaaaaatntagtacttaagttacggtaaccagacaagaaagtcgaacggccgaacggaaccccctaaaagttcggtactaatactaagtagaaacgaaccgaaacgaaaaccgaccccgtaccggggaactccccgtagaagacgtacttctaccgtcggcctaccgagcctacggaacgggtaccttacgtcgggtacccctaccgttacggtaactacgtaccggtacggggttaccgggggaaccccggtaaaggggttacgggggaaagggtaagttacgggaaacggtaccgtaacggtaaccttaaccgttaacgttaacggtttaaaccctaaagtaaaacgttaaacggaaacgtaaaacgtaaggttaagttaaactttaaggttttacggttaggggtttacgggttaccggggtaacgggtaaaccggggtaaaacctaaacggtaccggtaaccccggtacgtaacggtaccgaaccggacccgaacggtccgtaccccggtcccccgttacggtccctaccgttcccgttacccgtttaccccccg

SEQ ID NO: 319581 - DNA, 709 bp, Homo sapiens
  misc_feature: GZ8MTXP02FF26A.4.71.G05.1.454.CMB.2.raw
  modified_base (248)..(248): a, c, t, g, unknown or other
  misc_feature (248)..(248): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggatcacctgctctggagatgcattacgaaaccaaaaaaatntgtacttagttcggtaccagcaagaagtcgaggccacggacccctaaaattggacatctatagaagacgaacgaaccgacccgtacgggactcccgtagagagtacttctacgtcggacctcgacgctacggagggtacttacgcggacctaccgtagtaactagtacgagggtacggggacccaaagggtgggaaggagtaggaaacgtcgtacgtacttaacgtaacgttacgttaacctaaacgtaagtaagaacgtaaaaccgtagttaaggtaaatttaaacgttttcgggtaggggttacggttaccggggacggggtaaaaccggggaaaccctaaaacggtccggtaaacccggttaccggttaaacggacccgtaaccggacccgaaacgggtccgtaccccggtcccccgtaacggtccctaaccgttcccgttcccggtttaaccccccc

SEQ ID NO: 319582 - DNA, 688 bp, Homo sapiens
  misc_feature: GZ8MTXP02IM43D.4.71.G05.1.454.CMB.2.raw
  modified_base (228)..(228): a, c, t, g, unknown or other
  misc_feature (228)..(228): n is a, c, g, or t
  modified_base (253)..(253): a, c, t, g, unknown or other
  misc_feature (253)..(253): n is a, c, g, or t
tcagagcactgtagcacgaccggtgctcgatttagtgtcgtcgcaagagagaggggggtgggctcaggaggcagagctctgggaatctcaccatggcctggacccctctcctgcctcccccctcctcactttcctgcacagtctctgaggcctcctatgagctgacacagcccaccctcggtgtcagtcgtccccaggacaaacggccaggatcacctgctcgtgganatgctattacgaaaccaaaaaaatntagtacttagttggtaaccagcaagaacgtcgacggaccacggacccctaaagttcggtacatctaagtagaacgaaccgaacaaaccgccccgtaccgggactcccgtaggagtacgtatttccgcgtacggtcctccgacgccttacggacgggtactacgtccgggaccctaccgttagaacttacgtaccgtaggggtccgggtaacccgtaagggtagggaggtacgtaggacgtcgtacgtaacttacgtacgttacgttactaacaagtagaacgtaagtaacgtagtaatttagtttcgggttagggttacggttacgggacgggtaaccggtaaaccgtacgtaccggtaacccggttcgtaaacggtcgaaccgcccgaacgtccgtcccgtcccgtacgtcctaccgttccgtccgttcccccg

SEQ ID NO: 319583 - DNA, 732 bp, Homo sapiens
  misc_feature: GZ8MTXP02IQJSL.4.71.G05.1.454.CMB.2.raw
  modified_base (252)..(252): a, c, t, g, unknown or other
  misc_feature (252)..(252): n is a, c, g, or t
tcagagcactgtagcacgaccggtgctcgattttagtgtcgtcgcaagagagaggggggtgggctcaggaggcagagctctgggaatctcaccatggcctggacccctctcctgcctcccccctcctcactttctgcacagtctctgaggcctcctatgagctgacacagcccaccctcggtgtcagtcgtccccaggacaaacggccaggatcacctgctcgtggagatgctattagaacctaaaaaaatntgtactttattcggtaaccagacaagaagtcgacggaccacggacccctaaaagttcggtacatctagtagaacgaacgaacaaaccgaccccgtccgggactcccgtagagagtattcctaccgtggacctccgagtcctacgaacgggtcctaagtccgggaccctaaccgttcgaacttcgtacgagggtccggggaccctaaagggtggggaacggtagtaggaacgtacgtgtaaccgttactacgttaggtttaccctaagtaaacgttaggaacgtaaacggtaagttaaggttaatttaacggttttcgggtagggggttacggttacggggacggggtaaacggtaaccgtaaaaccggttcggaacccggtttaccggtaacgggttccaaacggtccccgtaaaggtcccgtaccccgggacccccgttccgggtacctaacccgtttccgtacccggtttcccccccg

SEQ ID NO: 319584 - DNA, 641 bp, Homo sapiens
  misc_feature: GZ8MTXP02JJTK3.4.71.G05.1.454.CMB.2.raw
  modified_base (435)..(435): a, c, t, g, unknown or other
  misc_feature (435)..(435): n is a, c, g, or t
  modified_base (529)..(529): a, c, t, g, unknown or other
  misc_feature (529)..(529): n is a, c, g, or t
tcagagcactgtagcacgaccggtgctcgatttagtgtcgtcgcaagagagagggggaagaccgatgggcccttggtggaggcttggtgaagccgggggggtcccttagactctcctgtgcagtctctggactcaacctcaaaaatgcctggatgacctgggtccgccagactccagggaaggggctgcagtgggttggccgtattataaccaaacctgatggtgagacaacagactacgctgccacccgtagaaaggcagattcaccatctacaagtagatgtacttacaaccgaacacgtcttagttttaggaaattgaacagtacctagaaaacccgaggaacaacagttcccgtttattctacgttacccactacctccctacgtacctagacgagtactttcggagtacttataactcgaccattaacgngtaccgttacgtcgggaccgaaaggaccacacgttaccacccgtctacctccaacctccaaccgacggtaccactccggtacccttacccccgngcccgaccctgcctaccgacgaccgccaacccgcgtacggacaccgaaccgcgccggcccgtcgggtacctcggtaccgccggtacaaccggtacctacccgtacctaaccg

SEQ ID NO: 319585 - DNA, 594 bp, Homo sapiens
  misc_feature: GZ8MTXP02IOBKE.4.71.G05.1.454.CMB.2.raw
  modified_base (221)..(221): a, c, t, g, unknown or other
  misc_feature (221)..(221): n is a, c, g, or t
  modified_base (241)..(241): a, c, t, g, unknown or other
  misc_feature (241)..(241): n is a, c, g, or t
  modified_base (441)..(441): a, c, t, g, unknown or other
  misc_feature (441)..(441): n is a, c, g, or t
tcagagcactgtagcacgaccggtgctcgatttagtgtcgtcgcaagagagagggggtgggctcaggaggcagagctctgggaatctcaccatggcctggacccctctcctgcctccccctcctcactttctgcacagtctctgaggcctcctatgagctgacacagccaccctcggtgtcagtgtcccaggacaaacggccaggatcacctgctctgganatgcattgaccaaaaaattntgtacttatacgtacagacagagtcacgaccacggaccctaaagttgtacatctatagaacgacgaacaaaccgacccgtaccggactcctagagagtacttctcgtcgcctcagctcgaggctagtcgcctacgttagtactatcgagtcgggaccaggtggagagtagaagcgtacgaactactacgttagttactanaaagtagaacgtaagtagtagtaattagtttcgtagggttcggtacgggacgggtaacggtaaccgaacgtacggtaccgtacgtacggtaccgaacgaccgaacggtccgtcccggtaccccgtcggtcctaccgttccgttccgttccccg

SEQ ID NO: 319586 - DNA, 600 bp, Homo sapiens
  misc_feature: GZ8MTXP02IT4S2.4.71.G05.1.454.CMB.2.raw
  modified_base (225)..(225): a, c, t, g, unknown or other
  misc_feature (225)..(225): n is a, c, g, or t
  modified_base (246)..(246): a, c, t, g, unknown or other
  misc_feature (246)..(246): n is a, c, g, or t
tcagagcactgtagcacgaccggtgctcgatttagtgtcgtcgcaagagagagggggtgggctcaggaggcagagctctgggaatctcaccatggcctggacccctctcctgcctcccccctcctcactttctgcacagtctctgaggcctcctatgagctgacacagcccaccctcggtgtcagtcgtccccaggacaaacggccaggatcacctgctctgganatgctattgaaccaaaaaatntgacttattggtaccagcaagaagtcaggccacggaccccaaatggtcatctatgaagacgacaaacgacccctcgggactcccgtagacgagtattctccgtcggcctccgagctacagggcttaagtcggccctaccgttgactatccaagggtcgggaccctaaggtggacggaatagaacgctagactactacttagttactacaatagaagtacgagtagtaacttaagttcgtaggggttagttcgggacggaacgggtaacaaacgtcggacccgttacgtacggtccgacgtaccaaacggcgtacccgaccccggttcgtaccctacgttccgtcggtttccccc

SEQ ID NO: 319587 - DNA, 933 bp, Homo sapiens
  misc_feature: GZ8MTXP02FJIZ7.4.71.G05.1.454.CMB.2.raw
  modified_base (226)..(226): a, c, t, g, unknown or other
  misc_feature (226)..(226): n is a, c, g, or t
  modified_base (248)..(248): a, c, t, g, unknown or other
  misc_feature (248)..(248): n is a, c, g, or t
tcagagcactgtagcacgaccggtgctcgatttagtgtcgtcgcaagagagaggggggtgggctcaggaggcagagctctgggaatctcaccatggcctggacccctctcctgcctccccctcctcactttctgcacagtctctgacggcctcctatgagctgacacagccaccctcggtgtcagtcgtccccaggacaaacggccaggatcacctgctctggagntgcattagaacctaaaaaaatntagactttattggtaaccagaccgaagtaagtacgaacggaccacggaacccccgtaaaaatttcggtacagttacctagtacgaaagaaccgaaccaaaaccgaccccgtacccgggactaccccgtaggaacgtagtaacgtttccgtaccccgttacgggtacccctaccgacggttactaccggtaaccggggtacgttaaacggtccggtacccccgtaacccgtttacggtaacttacgttaccccggtaaagggggtttcccgggggggacccccgtaaagggggtttaccggggtaaacggggaacgtttaaaggggaaaccggtaccgtttaaacccggggtaaaaccgtttaaacccgtttaactttaaacgggtttttaaacccctaaacgttaaaaagttaaccgggaaaaggttaaaaacccgtaacgggtttaacgggttaaattttaaacccggtttttaacgggttgggggttttaaccgggtccgggggtaaaccgggtaaacggggaaaaccgttaaaaccggttaccgggtaaccccggttaccggtaaaaccgggtttcccgtaaaccgggtacccccgaaaagggggttcccaaaccccggggttacccccccctacgggggtttccctaacccggttttcccaacccccggttttcccccccg

SEQ ID NO: 319588 - DNA, 726 bp, Homo sapiens
  misc_feature: GZ8MTXP02FZU5P.4.71.G05.1.454.CMB.2.raw
  modified_base (275)..(275): a, c, t, g, unknown or other
  misc_feature (275)..(275): n is a, c, g, or t
  modified_base (399)..(399): a, c, t, g, unknown or other
  misc_feature (399)..(399): n is a, c, g, or t
tcagagcactgtagcacgaccggtgctcgatttagtgtcgtcgcaagagagaggggaagaccgatgggcccttggtggaggcttggtgaagccggggggtcccttagactctcctgtgcagtctctggactcaacctcaaaatgcctggatgacctgggtccgccagactccagggaagggctgcagtgggttgccgtattataaccaaacctgatggtgagacaacagactacgctgccacccgtagaaaggcagattcacctatctacaaganatgattcaacgacacgtcttagttttagaaatgaacagacctaagaaaccgaggacactagtccgtttttatttccgtgttacccacgtaccttcctacgtaccctacgagtacgtactttcgnggaccttagtaaactccgacctaagttacgtcgggtaaccgttcgtacggggacccaacggggaccacgtacgtaccctacccgtctacccgtcaaaccccgtcaaacccggacggacctacgttccggtaccccttccccggtaggccccgtcccgtacgtacccgttacccgacggtacccgaccctaccccggttaccggacgaaccgcccgtaaacccggacgggtaccccggtacccccgttgggggccccctcgggttaaccccgtcgggtttaaacccggaaccggtaaccctttacccgttaacccccgtttaaaccgg

SEQ ID NO: 319589 - DNA, 729 bp, Homo sapiens
  misc_feature: GZ8MTXP02G71ZB.4.71.G05.1.454.CMB.2.raw
  modified_base (248)..(248): a, c, t, g, unknown or other
  misc_feature (248)..(248): n is a, c, g, or t
  modified_base (267)..(267): a, c, t, g, unknown or other
  misc_feature (267)..(267): n is a, c, g, or t
tcagagcactgtagcacgaccggtgctcgatttagtgtcgtcgcaagagagaggggggtgggctcaggaggcagagctctgggaatctcaccatggcctggacccctctcctgcctcccccctcctcactttctgcacagtctctgaggcctcctatgagctgacacagcccaccctcggtgtcagtcgtccccaggacaaacggccaggatcacctgctctggagatgctattagaccaaaaaaatntgacttatggtaccagcanaagtcaggaccacgacccctaaatcggtcagtactagtagaaagacgaacgaaaccgtaccccgaccgggactacccgagaacgagtacttaccgtccttcggaccttccgacgtctaccgaaggggtaccttaggtaccggacccttaccgttacgaacttaaccgttacgaacgggttaccggggaaaccccgtaagggtacggggaggtaacgtagaacggtacctagtaaccgttacctaacgttaacggttaacctacgtaaaagttaacggaaagtaaaccgtagtaacgttaaagttaaacgttttcggttagggggttacgttcggggtacgggaaacggggttaaacccaaacgggttacgtacccgtacccggttaaggaccaacgtacccccgaagggtcccttacccggaccccgtccggtaccctacgttcccggtcccgttacccccg

SEQ ID NO: 319590 - DNA, 622 bp, Homo sapiens
  misc_feature: GZ8MTXP02FX6WS.4.71.G05.1.454.CMB.2.raw
  modified_base (224)..(224): a, c, t, g, unknown or other
  misc_feature (224)..(224): n is a, c, g, or t
  modified_base (243)..(243): a, c, t, g, unknown or other
  misc_feature (243)..(243): n is a, c, g, or t
  modified_base (437)..(437): a, c, t, g, unknown or other
  misc_feature (437)..(437): n is a, c, g, or t
  modified_base (477)..(477): a, c, t, g, unknown or other
  misc_feature (477)..(477): n is a, c, g, or t
  modified_base (599)..(599): a, c, t, g, unknown or other
  misc_feature (599)..(599): n is a, c, g, or t
tcagagcactgtagcacgaccggtgctcgatttagtgtcgtcgcaagagagagggggtgggctcaggaggcagagctctgggaatctcaccatggcctggaccccctctcctgcctccccctcctcactttctgcacagtctctgaggcctcctatgagctgacacagccaccctcggtgtcagtcgtccccaggacaaacggccaggatcacctgctctggantgctattgaactaaaaatntgacttatggtaaccagcaagagtcaggccacggacccctaaagttcgacatctatacgaagacccgaacgaaacccgacccgtaccgggactcccgtagagtagtcttccgtccgtcggcctaccgagaccttacgaagggactgcggtacctaacttgaacttagcgtaggtcggacccgaggtggaggtanacggaagcgttagacttactattacgtaaccataacgtanacgaaatagtaagtatttattacggtggttcgtacggtacgggaacgtaaccgaacgttccgaaccgttacgaacgttacccgaaagtccccgaaagtcccgtaccggtccctacggtaccnccgttacctccggtttaaccccc

SEQ ID NO: 319591 - DNA, 629 bp, Homo sapiens
  misc_feature: GZ8MTXP02GYVHT.4.71.G05.1.454.CMB.2.raw
  modified_base (166)..(166): a, c, t, g, unknown or other
  misc_feature (166)..(166): n is a, c, g, or t
  modified_base (269)..(269): a, c, t, g, unknown or other
  misc_feature (269)..(269): n is a, c, g, or t
  modified_base (395)..(395): a, c, t, g, unknown or other
  misc_feature (395)..(395): n is a, c, g, or t
tcagagcactgtagcacgaccggtgctcgatttagtgtcgtcgcaagagagagggggaagaccgatgggccattggtggaggcttggtgaagccgggggggtcccttagactctcctgtgcagtctctggactcaacctcaaaaatgcctggatgacctgggtccncagactcagggaagggctgcagtgggttgcctatataaccaaactgatggtgagacaacagactacgctgcaccgtgaaaggcagattcaccatctacaaganatgtatcaaagacacgtcttagttttagaaatgaacagacctaagaaaaccgaggtaacacaggttaccgtttatttcgtacgttcccaactacctacccccgtcgacctaacagagtatttacgnggtactaataacgtcgacctatagtgacgtcgtgggacaagggtaccacgaggtcctaacgtcttacccactaacccgtccaaccgaacggaccctacgtccggtcccttacccccgagtccgacccctcggtacctcccgtaaggctacccgtacccaccggaataccggacaaaccgcggcccgaccgtcggaacgtcggaccgtgaccgaacggtacctacgtttaacccg

SEQ ID NO: 319592 - DNA, 508 bp, Homo sapiens
  misc_feature: GZ8MTXP01DSLJA.51.41.D08.1.454.CMB.2.raw
  modified_base (258)..(258): a, c, t, g, unknown or other
  misc_feature (258)..(258): n is a, c, g, or t
  modified_base (485)..(485): a, c, t, g, unknown or other
  misc_feature (485)..(485): n is a, c, g, or t
tcagcgatcgtatacacgaccggtgctcgatttagtcacgcgagaaagggaaagggtggggcacttctccctctaacactctcccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaatggtatcagcagaaaccaggaaancccctaaatcctgatctatgctgcatccagtttgacaaagtgaggtcccatccaggttcagtgcagtggatctgggacaagatttcactctcaccatcagtagtctgacaacctgaatattttgactaaactttacactgtacaaacagtacggtttacggtacccttgctctacgtttcgggcggtagggacctaaggtggagataacaaacgactgttggctgcncatctgtctcattcttccgctaa

SEQ ID NO: 319593 - DNA, 500 bp, Homo sapiens
  misc_feature: GZ8MTXP01D9MLT.51.41.D08.1.454.CMB.2.raw
  modified_base (476)..(476): a, c, t, g, unknown or other
  misc_feature (476)..(476): n is a, c, g, or t
  modified_base (480)..(480): a, c, t, g, unknown or other
  misc_feature (480)..(480): n is a, c, g, or t
tcagcgatcgtatacacgaccggtgctcgatttagtcacgcgagaaagggaaaggggtggggcacttctccctctaacactctcccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccaggaaacgcccctaaatcctgatctatgctgcatccagtttgcaaagtgaggtcccatccaggttcagtggcagtggatctgggacaagatttcactctcaccatcagtagtctgcaactgaagtatttttagactaaacttactactgtacaactagtacggttacggtacctgctcacgttcggcggaggacaggtgagataacaaacgactgttgctgcncatntgtctcacttcttccgctaa

SEQ ID NO: 319594 - DNA, 507 bp, Homo sapiens
  misc_feature: GZ8MTXP01CR1SU.51.41.D08.1.454.CMB.2.raw
  modified_base (476)..(476): a, c, t, g, unknown or other
  misc_feature (476)..(476): n is a, c, g, or t
  modified_base (483)..(483): a, c, t, g, unknown or other
  misc_feature (483)..(483): n is a, c, g, or t
  modified_base (493)..(493): a, c, t, g, unknown or other
  misc_feature (493)..(493): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaatggtatcagcagaaaccaggaaagcccctaaatcctgatctatgctgcatccagtttgacaaagtgaggtcccatccaggttcagtggcagtggatctgggacaagatttcactctcaccatcagtacgtctgacaacctgaaagtattttgactaacttactactgtacaaacagaggtttaacggtaccctgactcacgttcggcggagggccaaggtggagataacaaacgacgtgnggctgcncatctgtctnacttcttccgctaa

SEQ ID NO: 319595 - DNA, 499 bp, Homo sapiens
  misc_feature: GZ8MTXP01AJ0UK.51.41.D08.1.454.CMB.2.raw
  modified_base (477)..(477): a, c, t, g, unknown or other
  misc_feature (477)..(477): n is a, c, g, or t
  modified_base (499)..(499): a, c, t, g, unknown or other
  misc_feature (499)..(499): n is a, c, g, or t
tcagcgatcgtatacacgaccggtgctcgatttagtcacgcgagaaagggaaagggtggggcacttctccctctaacactctcccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaatggtatcagcagaaaccagggaaagcccctaaatcctgatctatgctgcatccagtttgcaaagtgaggtcccatccaggttcagtggcagtggatcgtgggacaagatttcactctcaccatcagtagtctgacaactgaagtattttgactaacttactactgtacaactagaggttacgtaccctgctcacttcgggcggaggaccgtaaggtcgagataacaaacgactgttggctgcncatctgtcttcattctccgctn

SEQ ID NO: 319596 - DNA, 597 bp, Homo sapiens
  misc_feature: GZ8MTXP01C9WKW.51.41.D08.1.454.CMB.2.raw
  modified_base (183)..(183): a, c, t, g, unknown or other
  misc_feature (183)..(183): n is a, c, g, or t
  modified_base (208)..(208): a, c, t, g, unknown or other
  misc_feature (208)..(208): n is a, c, g, or t
  modified_base (263)..(263): a, c, t, g, unknown or other
  misc_feature (263)..(263): n is a, c, g, or t
tcagcgatcgtatacacgaccggtgctcgatttagtcacgcgagaaagggaaaggggtggggcacttctccctctaacactctcccgctcagctcctgggctcctgctactctggctccgaggtgccagatgtgacatccagatgacccagtctccatcctccctgtcctgcatctgtagganacagagtcaccatcacttgccgggnaagtcagagcattagcagtcttaattaatggtatcagcaagaaaccagggaaacncccctaaactcctagaatcctatcgctgcatcctagtttcgacaaaggtcgaggtccccaatccaggttcagtgcagtggatcgtgggacaagtatttcactctcacatcagtagtctgcaactgaattatttagctaaacttactacttgtactaacgtagaggtttaacccggtaacctgtaccttacgtacgttttcggggacggtaaaccgggtacccgtaaaggggttcggaaacgtaagtaacgtaaaacggttaccgttggacgggtacctggacccttacccttagttcccttagttccctttcacgtttccttccccgcttaacg

SEQ ID NO: 319597 - DNA, 504 bp, Homo sapiens
  misc_feature: GZ8MTXP01B2YNS.51.41.D08.1.454.CMB.2.raw
  modified_base (472)..(472): a, c, t, g, unknown or other
  misc_feature (472)..(472): n is a, c, g, or t
  modified_base (478)..(478): a, c, t, g, unknown or other
  misc_feature (478)..(478): n is a, c, g, or t
tcagcgatcgtatacacgaccggtgctcgatttagtcacgcgagaaagggaaaggggtgggggcacttctccctctaacactctcccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaacgcccctaaactcctgatctatgctgcatccagtttgcaaagtgaggtcccatccaggttcagtggcagtggatcgtgggacaagatttcactctcaccatcagtagtctgcaactgaagtattttagactaacttactactgtacaactagacggttacggtaccctgctcacgttcggcggaggacaaggtgagataacaaacgactgngctgcncatctgtcttcacttccttcccgctc

SEQ ID NO: 319598 - DNA, 580 bp, Homo sapiens
  misc_feature: GZ8MTXP01CDKDA.51.41.D08.1.454.CMB.2.raw
  modified_base (259)..(259): a, c, t, g, unknown or other
  misc_feature (259)..(259): n is a, c, g, or t
tcagcgatcgtatacacgaccggtgctcgatttagtcacgcgagaaagggaaaggggtgggggcacttctccctctaacactctcccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaatggtatcagcagaaacaggaaancccctaaatcctgatctatgctgcatccagtttgacaaagtgacgtcccatccaggttcagtggcagtggatcgtgggacaagtatttcacttctacaccatcagtacgtctgactaacgtgaacgtattttagacttaactttactactgtacaacgtagtacggtttaccggtacccttgaccttcgtaaccgtttcgggacggggtaacggggaccgtaaaggggttcggaagaacgttaaccgaaaacggttacgtggttcgggacttggacccgaccttattcgtagttccttcacttccctttccccgcttaacg

SEQ ID NO: 319599 - DNA, 507 bp, Homo sapiens
  misc_feature: GZ8MTXP01B6YC6.51.41.D08.1.454.CMB.2.raw
  modified_base (263)..(263): a, c, t, g, unknown or other
  misc_feature (263)..(263): n is a, c, g, or t
  modified_base (439)..(439): a, c, t, g, unknown or other
  misc_feature (439)..(439): n is a, c, g, or t
  modified_base (482)..(482): a, c, t, g, unknown or other
  misc_feature (482)..(482): n is a, c, g, or t
  modified_base (486)..(486): a, c, t, g, unknown or other
  misc_feature (486)..(486): n is a, c, g, or t
  modified_base (488)..(488): a, c, t, g, unknown or other
  misc_feature (488)..(488): n is a, c, g, or t
  modified_base (495)..(495): a, c, t, g, unknown or other
  misc_feature (495)..(495): n is a, c, g, or t
  modified_base (507)..(507): a, c, t, g, unknown or other
  misc_feature (507)..(507): n is a, c, g, or t
tcagcgatcgtatacacgaccggtgctcgatttagtcacgcgagaaagggaaaggggtggggcacttctccctctaacactctccccgctcagctcctggggctcctgctactctggctccgaggtgccagatgtgacatccagatgacccagtctccatcctccctgtctgcatctgtaggagacagagtcaccatcacttgccgggcaagtcagagcattagcagcttatttaaatggtatcagcagaaaccagggaaacncccctaaatcctgatctatgctgcatccagtttgacaaagtgaggtcccatccaggttcagtgcagtggatcgtggacaagatttcactctcaccatcagtatctgacaactgaagtattttgactaacttactactgtacaaacagtaggttacggtacctgctcacgtttcggnggaagggacctaaggtggagataacaaagactgttggactgcncatntntcttacncttcctccgctn

SEQ ID NO: 319600 - DNA, 520 bp, Homo sapiens
  misc_feature: GZ8MTXP01D945Z.51.41.D08.1.454.CMB.2.raw
  modified_base (257)..(257): a, c, t, g, unknown or other
  misc_feature (257)..(257): n is a, c, g, or t
  modified_base (266)..(266): a, c, t, g, unknown or other
  misc_feature (266)..(266): n is a, c, g, or t
  modified_base (516)..(516): a, c, t, g, unknown or other
  misc_feature (516)..(516): n is a, c, g, or t
tcagcgatcgtatacacgaccggtgctcgatttagtcacgcgagaaagggaaaggggtgggggcacttctccctctaacactctcccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaatggtatcagcagaacaggaancccctaaancctgatctatgctgcatccagtttgacaaagtgaggtcccatccgaggttcagtggcagtggatcgtgggacaagtatttcactctacaccatcagtagtctgacaactgaagtattttagactaacttactactgtacaaactagtacggtttaccggtacctgactcgtacgttcggcggaacgggaccgtaagggtgagataacaaacgactgttagctgcaccatctgtcttcacttccttcccgntaac

SEQ ID NO: 319601 - DNA, 585 bp, Homo sapiens
  misc_feature: GZ8MTXP01EILS5.51.41.D08.1.454.CMB.2.raw
  modified_base (243)..(243): a, c, t, g, unknown or other
  misc_feature (243)..(243): n is a, c, g, or t
  modified_base (248)..(248): a, c, t, g, unknown or other
  misc_feature (248)..(248): n is a, c, g, or t
  modified_base (271)..(271): a, c, t, g, unknown or other
  misc_feature (271)..(271): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcaccatcacttgccgggcaagtcagagcattagcagcttaatttaaagttnggtancaagacaagaaaccacggaaacnccctaaatctagatctatgctgctatccagtttagacaaagtcgacgtcccagtcaggttcagtggcgagtggagtcgtaggtaactagtaactttcactacctactaccagttactagtacgtactagactaaacttagtaagtactttacgtactaacttacgtactagtacgtaacgtacgggtacgttacggtacctcgtcgtcgacgttacgggacggaggtacgaaggtacgaagaactaacgaaacgtacgttcgtacggcttacgcttacctaattcttcgttccttccttacctccgttcccgtc

SEQ ID NO: 319602 - DNA, 562 bp, Homo sapiens
  misc_feature: GZ8MTXP01CP3L2.51.41.D08.1.454.CMB.2.raw
  modified_base (264)..(264): a, c, t, g, unknown or other
  misc_feature (264)..(264): n is a, c, g, or t
  modified_base (338)..(338): a, c, t, g, unknown or other
  misc_feature (338)..(338): n is a, c, g, or t
  modified_base (512)..(512): a, c, t, g, unknown or other
  misc_feature (512)..(512): n is a, c, g, or t
tcagcgatcgtatacacgaccggtgctcgatttagtcacgcgagaaagggaaggggtgggggcacttctccctctaacactctccccgctcagctcctggggctcctgctactctggctccgaggtgccagatgtgacatccagatgacccagtctccatcctccctgtctgcatctgtaggagacagagtcaccatcacttgccggcaagtcagagcattagcagcttaatttaaattggtatcagcaagaaaccaggaaacncccctaaatcctgatctatgctgcatcctagtttgacaaagtgacgtcccatccgagttcagtgcagtgatcgngggacaagtatttcactctacacctatcgagtacgtctagactaacgtgtaaattatttagtactaacttactactgtacaatagtacggttacggtaccctgcctacgtaccgtttcgggcggtaacggggacctaaggggtacgaagtaactaacgaaaacggttacgttgnggtacctgcccacttacttcgtacgttccttcacttcccttcccgctaac

SEQ ID NO: 319603 - DNA, 588 bp, Homo sapiens
  misc_feature: GZ8MTXP01CNUA0.51.41.D08.1.454.CMB.2.raw
tcagcgatcgtatacacgaccggtgctcgatttagtcacgcgagaaagggaaggggtgggggcacttctccctctaacactctcccgctcagctcctggggctcctgctactctggctccgaggtgccagatgtgacatccagatgacccagtctccatcctccctgtctgcatctgtaggagacagagtcaccatcacttggccgggacaagtcagagctaattagcagtcttaatttaaattggtatcagcaagaaaccgagggaaacacccctaaatcctagatctatgctgctatcctagtttcgaactaaagtgacggtcccatccgaggttcaggtgctagtggatcgtgggacaagttatttcactctcacgatcagtagtcctagactaaacgtggaaacttattttacgacttaaacttactactacgtacaaacgtagttacgggttacccggtaccttgtaccttacgtaccgttcgggacggtaacgggtacctaagggtggaatactaaccgtaaaacgcgttggcggtctggcccacttcgtttctgttccttacgctttccctcccgctaacg

SEQ ID NO: 319604 - DNA, 615 bp, Homo sapiens
  misc_feature: GZ8MTXP01DFXVI.51.41.D08.1.454.CMB.2.raw
  modified_base (260)..(260): a, c, t, g, unknown or other
  misc_feature (260)..(260): n is a, c, g, or t
  modified_base (338)..(338): a, c, t, g, unknown or other
  misc_feature (338)..(338): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaatggtatcagcagaaaccaggaaancccctaaactcctgatctatgctgcatccagtttgacaaagtgaggtcccatccgaggttcagtggctagtggatcgngggacaagtatttcactctacacctatcagtacgtctgactaactgaagtatttagactaaactttactactagtacaaacgagtacgggtttaaccggtacccttggtaccttaccgttacgtttccggggacgggtaaacggggtaacccgtaaaggggttcgggaaagtacgttaaacgaaaacggttaaaccgttggacggtacgttcggaccgttaccttacgttccgttcggtttcctttacacgtttaccctttccccggcccgttaacg

SEQ ID NO: 319605 - DNA, 564 bp, Homo sapiens
  misc_feature: GZ8MTXP01D3X00.51.41.D08.1.454.CMB.2.raw
  modified_base (211)..(211): a, c, t, g, unknown or other
  misc_feature (211)..(211): n is a, c, g, or t
  modified_base (267)..(267): a, c, t, g, unknown or other
  misc_feature (267)..(267): n is a, c, g, or t
tcagcgatcgtatacacgaccggtgctcgatttagtcacgcgagaaagggaaaggggtgggggcacttctccctctaacactctcccgctcagctcctggggctcctgctactctggctccgaggtgccagatgtgacatccagatgacccagtctccatcctccctgtctgcatctggtaggagacagagtcaccatcacttggccgggnaagtcagagcattagcagtcttaatttaaatggtatcagcaagaaacagggaaacncccctaaatcctgatctatgctgcatccagtttgacaaagtgacgtcccatcagttcagtgcagtggatcgtagggacaagtatttcactctcacctatcagtatctagactaactgaatattttagacttaaacttactatcgtacaaacgtagtaacggttacggtaccctgtcctacgtacgttcgggacggaacgggaaccgaagggtagaagaacgtaacgaaaacggttagtggttacggcctggaccaccttagtcttacgttcctttcacttccctttccccgcgtaac

SEQ ID NO: 319606 - DNA, 545 bp, Homo sapiens
  misc_feature: GZ8MTXP01B9NBW.51.41.D08.1.454.CMB.2.raw
  modified_base (269)..(269): a, c, t, g, unknown or other
  misc_feature (269)..(269): n is a, c, g, or t
  modified_base (400)..(400): a, c, t, g, unknown or other
  misc_feature (400)..(400): n is a, c, g, or t
  modified_base (519)..(519): a, c, t, g, unknown or other
  misc_feature (519)..(519): n is a, c, g, or t
  modified_base (524)..(524): a, c, t, g, unknown or other
  misc_feature (524)..(524): n is a, c, g, or t
  modified_base (539)..(539): a, c, t, g, unknown or other
  misc_feature (539)..(539): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgaccccagtctccatcctccctgtctgcatctgtaggagacagagtcaccatcacttaccgggcaagtcagagcattagcagtctaatttaaattggtatcagcaagaaaccgagggaaacncccctaaatcctagatctatgctgcatcctagtttgactaaagtgacggtcccatccgaggttcagtggcagtcggatcgtgggactagtaactttcaactctacactatcagtagtctgacaactgaatntttagactaacttatatgtacaatagtacgttacgggtaccctgtctcgtacgtttcggcgggtaacggaccgaagggtcggaatactacgaaacgtcgttgtacggctagcaccgttnttctnttctctctccttccncttgtc

SEQ ID NO: 319607 - DNA, 556 bp, Homo sapiens
  misc_feature: GZ8MTXP01D540O.51.41.D08.1.454.CMB.2.raw
  modified_base (209)..(209): a, c, t, g, unknown or other
  misc_feature (209)..(209): n is a, c, g, or t
  modified_base (343)..(343): a, c, t, g, unknown or other
  misc_feature (343)..(343): n is a, c, g, or t
  modified_base (529)..(529): a, c, t, g, unknown or other
  misc_feature (529)..(529): n is a, c, g, or t
  modified_base (536)..(536): a, c, t, g, unknown or other
  misc_feature (536)..(536): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcaccatcacttgccggnaagtcagagcattagcagtcttaatttaaattggtatcagacaagaaaccgagggaaacacccctaaatcctagatctatgctgcatccagttgacaaagtgacgtcccatccaggttcagtgcagtggatcgnggactaagtatttcacttcacactatcagtacgtctagacaacgtagaagttattttacgacttaacttactactatacaaacgtagtacggttacggtacctgactactaccgttcggacggaaggtacgaaggtagaacgaataacgaaagttacgtagttcggctcgaccttacacttcgttnttccttntaccgttccttcccgcctaa

SEQ ID NO: 319608 - DNA, 517 bp, Homo sapiens
  misc_feature: GZ8MTXP01D2N1P.51.41.D08.1.454.CMB.2.raw
  modified_base (262)..(262): a, c, t, g, unknown or other
  misc_feature (262)..(262): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaatggtatcagcagaaaccagggaaancccctaaatcctgatctatgctgcatccagtttgcaaagtgaggtcccatccaggttcagtggcagtggatctgggacaagatttcactctcaccatcagtagtctgcaacctgaagatttttgctaaacttactactgtcaaacagaggttaacggtaccctgctcacttcggcggagggacaaggtaggagataacaaacgaactgttggcgtgcgcactaactctcttctacttcttcccgttcccgtaacc

SEQ ID NO: 319609 - DNA, 559 bp, Homo sapiens
  misc_feature: GZ8MTXP01BPF9A.51.41.D08.1.454.CMB.2.raw
  modified_base (269)..(269): a, c, t, g, unknown or other
  misc_feature (269)..(269): n is a, c, g, or t
  modified_base (303)..(303): a, c, t, g, unknown or other
  misc_feature (303)..(303): n is a, c, g, or t
  modified_base (341)..(341): a, c, t, g, unknown or other
  misc_feature (341)..(341): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcaccatcacttgccgggcaagtcagagcattagcagtcttaatttaaattggtatcagcaagaaaccgagggaaacncccctaaatcctgatctatgctgcatccagtttncaaagtgacggtcccatcaggttcagtgcagtgatcgnggacaagtctttcactctacactatcagtacgtctgacctaacgtgtaaagtattttacgactaacttactactacgtacaacgtagtaacgggtttaccgtaccgtgtccttacgtaccggtttcgggacgggaacgggaccgtaaggggtacgagactaacgaaacgttacgtggttaggctagccacttatctgtcttcacttcctcccgctaac

SEQ ID NO: 319610 - DNA, 587 bp, Homo sapiens
  misc_feature: GZ8MTXP01D8O79.51.41.D08.1.454.CMB.2.raw
  modified_base (265)..(265): a, c, t, g, unknown or other
  misc_feature (265)..(265): n is a, c, g, or t
  modified_base (356)..(356): a, c, t, g, unknown or other
  misc_feature (356)..(356): n is a, c, g, or t
  modified_base (383)..(383): a, c, t, g, unknown or other
  misc_feature (383)..(383): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcaccatcacttgccgggcaagtcagagcattagcagcttatttaaatggtatcagcaagaaaccagggaaacncccctaaatcctagatctatgctgcatccagtttgacaaagtgacgtcccatccagttcagtgcagtggatcgtggacaagtattcactcncacatcagtatctgactaactgaagtntttacgactaacttactacttgtacaaacgtaggttaacgggtttaaccggtaccctgtaccttacgtaacggtttccgggacgggtaacgggaaccgtaaggggtcggaagtaactaaacgtaaacgttaacgttggttcggaccgttgacccgttaccttacttccgttagttccttacacttcccctttccccgcttaacg

SEQ ID NO: 319611 - DNA, 600 bp, Homo sapiens
  misc_feature: GZ8MTXP01EOHZS.51.41.D08.1.454.CMB.2.raw
  modified_base (210)..(210): a, c, t, g, unknown or other
  misc_feature (210)..(210): n is a, c, g, or t
  modified_base (266)..(266): a, c, t, g, unknown or other
  misc_feature (266)..(266): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcaccatcacttgccgggnaagtcagagcattagcagcttaatttaaatggtatcagcaagaaaccagggaaacncccctaaatcctagatctatgctgcatccagtttgacaaagtgagtcccatccagttcagtggcagtggatcgtggacaagtatttcactctacactatcagtagtctgacaactgaagtattttacgacttaacttactactagtacaaacgtagtaacgggtttaaccggtaccctgtaccttacgtaccgtttcgggacgggtaaacggggtaccgtaagggttaggaagtaacgtaacgaaaacggttacgttggttacgggacctacggaccttacccgttattcccgttcgttcccttactaccttcccgttccccgaaccgttaacg

SEQ ID NO: 319612 - DNA, 579 bp, Homo sapiens
  misc_feature: GZ8MTXP01ATKP6.51.41.D08.1.454.CMB.2.raw
  modified_base (269)..(269): a, c, t, g, unknown or other
  misc_feature (269)..(269): n is a, c, g, or t
  modified_base (388)..(388): a, c, t, g, unknown or other
  misc_feature (388)..(388): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcaccatcacttggccgggcaagtcagagcattagcagtcttaatttaaatggtatcagcaagaaaccgagggaaacncccctaaatcctgatctatgctgcatcctagtttgacaaagtgacgtcccatccgaggttcaggtgcaggtggatcgtgggactaagtactttcactctacaccgtatcaggtattccngacctaacgtagtaagttacttttagaccttaaactttacgtacgtactacaaacgtacgtacggttaccggtacctgcttcgtacgttcgggacgggtaacggacaaggggtgaagaactaacgaagttacgtggcgacgtacaccgttacttcgttctcgttcttacgtccttcccgtcccgcgtaacg

SEQ ID NO: 319613 - DNA, 556 bp, Homo sapiens
  misc_feature: GZ8MTXP01BKXSS.51.41.D08.1.454.CMB.2.raw
  modified_base (209)..(209): a, c, t, g, unknown or other
  misc_feature (209)..(209): n is a, c, g, or t
  modified_base (268)..(268): a, c, t, g, unknown or other
  misc_feature (268)..(268): n is a, c, g, or t
  modified_base (520)..(520): a, c, t, g, unknown or other
  misc_feature (520)..(520): n is a, c, g, or t
  modified_base (534)..(534): a, c, t, g, unknown or other
  misc_feature (534)..(534): n is a, c, g, or t
  modified_base (541)..(541): a, c, t, g, unknown or other
  misc_feature (541)..(541): n is a, c, g, or t
  modified_base (556)..(556): a, c, t, g, unknown or other
  misc_feature (556)..(556): n is a, c, g, or t
tcagcgatcgtatacacgaccggtgctcgatttagtcacgcgagaaagggaaaggggtgggggcacttctccctctaacactctcccgctcagctcctggggctcctgctactctggctccgaggtgccagatgtgacatccagatgacccagtctccatcctccctgtctgcatctgtaggagacagagtcaccatcacttgccgggnaagtcagagcattagcagtcttaatttaaattggtatcagacaagaaaccagggaaacncccctaaactcctgatctatgctgcatcctagttgacgaaagtgacgtcccatccgagttcagtgcagtggatcgtggactaagtactttcgactcctacacctatacacgttagtctgactaacgtagtaagttattttacgacttaacttactactagtactaacgtagttacggttaaccgtcctcgctcgtacgttcggacggtaggaccgtagggtacgatagtaacgaaacgacgtggttgtcgtnaccgcttatcgttntcttacncttcctccgttcgtn

SEQ ID NO: 319614 - DNA, 628 bp, Homo sapiens
  misc_feature: GZ8MTXP01C488W.51.41.D08.1.454.CMB.2.raw
  modified_base (267)..(267): a, c, t, g, unknown or other
  misc_feature (267)..(267): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcaccatcacttgccggcaagtcagagcattagcagtcttaatttaaattggtatcagcaagaaaccagggaaacncccctaaatctgatctatgctgcatcctagttgactaaagtgacgtcccatccgtaggttcagtgctaggtggatcgtggactaagtactttcactctcacctatcgtagtacgtctagacctaacgtgtaaagttattttacgacttaaacttactactacgtacaaacgtacggtacggtttaccggtacctgtccttaccgtaacggtttccggggacggtaacggggtaccgtaaaggggtcggaacgtaacgttaaaccgaaaacggttacgttgggttcggaccttcggacccgttacccttagtttcccttacggttcctttaccgaccgtttcccctttaacccgcccttaag

SEQ ID NO: 319615 - DNA, 590 bp, Homo sapiens
  misc_feature: GZ8MTXP01D44Z5.51.41.D08.1.454.CMB.2.raw
  modified_base (209)..(209): a, c, t, g, unknown or other
  misc_feature (209)..(209): n is a, c, g, or t
  modified_base (267)..(267): a, c, t, g, unknown or other
  misc_feature (267)..(267): n is a, c, g, or t
  modified_base (302)..(302): a, c, t, g, unknown or other
  misc_feature (302)..(302): n is a, c, g, or t
tcagcgatcgtatacacgaccggtgctcgatttagtcacgcgagaaagggaaaggggtgggggcacttctccctctaacactctcccgctcagctcctggggctcctgctactctggctccgaggtgccagatgtgacatccagatgacccagtctccatcctccctgtctgcatctgtaggagacagagtcaccatcacttgccgggnaagtcagagcattagcagtcttaatttaaattggtatcagacaagaaaccaggaaacncccctaaatcctagatctatgctgcatccagtttnacaaagtgacggtcccatccgagttcagtgcaggtggatcgtgggacaagtatttcactctacaccatcagtactctagacctaactgtaagttattttacgactaaactttactactacgtacaaacgtagtacgggttaccggtaccctgtaccttacgtacgtttcgggacgggtaacggaccgtaagggtaggacgtaacgtaaaccgaaacggacgttcggttagggcctaggaccgttaccttagttccttgttccttactctttcccttccccgcttaacg

SEQ ID NO: 319616 - DNA, 555 bp, Homo sapiens
  misc_feature: GZ8MTXP01A6NGF.51.41.D08.1.454.CMB.2.raw
  modified_base (263)..(263): a, c, t, g, unknown or other
  misc_feature (263)..(263): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcaccatcacttgccgggcaagtcagagcattagcagactatttaaatggtatcagcagaaaccaggaaacncccctaaactcctgatctatgctgcatccagtttgactaaagtgacggtcccatccgaggttcagtggcaggtggatcgtgggactaagtactttcactctacaccatcgagtgtctgacaacctagaagtattttacgactaacttactactgtacaaacgagtacggtaccgtactgctactacgttcggacggaacgggactaagggtgagactaacgaaacggttactaggttcggctcgaccgttccattctcgttccttctaccgttccctttccccgccttaacg

SEQ ID NO: 319617 - DNA, 602 bp, Homo sapiens
  misc_feature: GZ8MTXP01AT0DS.51.41.D08.1.454.CMB.2.raw
  modified_base (265)..(265): a, c, t, g, unknown or other
  misc_feature (265)..(265): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcaccatcacttgccgggcaagtcagagcattagcagcttatttaaattggtatcagcaagaaaccagggaacncccctaaatcctagatctatgctgcatcctagtttgacaaagtgacgtcccatccgagttcagtgcagtggatcgtggactaagtatttcactctacacatcaagtactctgactaaactgaacgttattttacgacttaaacttacagttacgtacaaacgtgttaacggggttaccggtaaccctggtacccttacgttaccggtttcgggacgggtaaacggggaccgtaaaggggttgaacgaacgttaacaaaacggttacgtggttcggtacctgaccttacccgttattccgttcgttccttactacttccccgtttcccgaaccttaag

SEQ ID NO: 319618 - DNA, 619 bp, Homo sapiens
  misc_feature: GZ8MTXP01C52BB.51.41.D08.1.454.CMB.2.raw
  modified_base (262)..(262): a, c, t, g, unknown or other
  misc_feature (262)..(262): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcaccatcacttgcgggcaagtcagagcattagcagtctaatttaaatggtatcagcagaaacaggaaacnccctaaactctagatctatgctgacatccagtttgacaaagtgacgtccatccgtaggttcagtgctaggtggatcgtaggacaagtatttcactctacacctatcgagtacgtctagacaaactggaaattattttacgacttaaacgttacctatcgttaaccaaacgtagttacgggtttaacccggtaccctgaccttacgtaccggtttcggggacggtaaacggggtaaccgaaaggggttacggaaacgtaaacgtaaaccgtaaaacggttacgtggttacggtacctacgaccttaacttacgttccttacgttccttacctaccgtttccccttaacccgaactaag

SEQ ID NO: 319619 - DNA, 597 bp, Homo sapiens
  misc_feature: GZ8MTXP01AF8I5.51.41.D08.1.454.CMB.2.raw
  modified_base (241)..(241): a, c, t, g, unknown or other
  misc_feature (241)..(241): n is a, c, g, or t
tcagcgatcgtatacacgaccggtgctcgatttagtcacgcgagaaagggaaaggggtggggcacttctccctctaacactctcccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaatggtancagcagaaaccaggaaagcccctaaatcctgatctatgctgcatccagtttgcaaagtgagtcccaatccaggttcagtgcagtggatctgggacaagatttcactctcacatcagtagtctgcaacctagaagtaatttagtactaaacttaacttacctagttactaaacctaacgaaggttaacgggttaaccccgtacgtaccttctaaccgtttacggtccgggtaaggggaacccggtaaagggtaagggtaaggtaaagtaaacgtaaaacgttaaacgtaggttaggtacgtcgacgaccttacttaacttcgttccttccttaccttacccttcccgttcccgtaac

SEQ ID NO: 319620 - DNA, 603 bp, Homo sapiens
  misc_feature: GZ8MTXP01A8SGB.51.41.D08.1.454.CMB.2.raw
  modified_base (267)..(267): a, c, t, g, unknown or other
  misc_feature (267)..(267): n is a, c, g, or t
  modified_base (276)..(276): a, c, t, g, unknown or other
  misc_feature (276)..(276): n is a, c, g, or t
  modified_base (288)..(288): a, c, t, g, unknown or other
  misc_feature (288)..(288): n is a, c, g, or t
  modified_base (406)..(406): a, c, t, g, unknown or other
  misc_feature (406)..(406): n is a, c, g, or t
  modified_base (597)..(597): a, c, t, g, unknown or other
  misc_feature (597)..(597): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcaccatcacttgccgggcaagtcagagcattagcagtacttaatttaaatgtatcagcaagaaaccagggaaacncccctaaancctagaatctangctgctatcctagttgactaaagtgacgtcccatccgaggttcagtggactagtggatcgtagggactaagtactttcacttcacacctatcagtacgtctgactaactgtaaagttnttttacgaccttaaactttactacgttacgtaacaaacgttaggtacgggttaaccgtaccctgtaccttacgtaccggttcgggacggtaacgggaccgtaagggtacggaactaacgtaactaaacggttacgttggacggtactcgaccttcttacgtcttcgttaacttcctacttccgttccccgngttaac

SEQ ID NO: 319621 - DNA, 559 bp, Homo sapiens
  misc_feature: GZ8MTXP01BU1KS.51.41.D08.1.454.CMB.2.raw
  modified_base (267)..(267): a, c, t, g, unknown or other
  misc_feature (267)..(267): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcaccatcacttgccgggcaagtcagagcattagcagcttaatttaaattggtatcagcaagaaaccagggaaacncccctaaatcctgatctatgctgcatcctagtttgacaaagtgacgtcccatccaggttcagtggcagtggatcgtggactaagtactttcactctacactatcagtatctgacaactgaagtattttacgactaacttactactagtacaacgtagtaacgggttaccggtacctgtccttacgtacgtttcgggacgggtaacgggaccgtaaggggtgaacgataaccgaaacgttacgtggttcggctgccacttattctcgttcttctacttcccttcccgctaacg

SEQ ID NO: 319622 - DNA, 565 bp, Homo sapiens
  misc_feature: GZ8MTXP01CLQPT.51.41.D08.1.454.CMB.2.raw
  modified_base (265)..(265): a, c, t, g, unknown or other
  misc_feature (265)..(265): n is a, c, g, or t
  modified_base (394)..(394): a, c, t, g, unknown or other
  misc_feature (394)..(394): n is a, c, g, or t
  modified_base (522)..(522): a, c, t, g, unknown or other
  misc_feature (522)..(522): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcaccatcacttgccgggcaagtcagagcattagcagcttaatttaaatggtatcagcaagaaaccaggaaacncccctaaatcctgatctatgctgcatccagtttgacaaagtgacgtcccatccgaggttcaggtggacagtggatcgtgggacaagtatttcactctcacatcagtacgtctagactaactgtaagttnttttacgactaacttactactgtacaacgagtacggttacggtaccctgtaccttcgtacgtttcgggacgggtaacgggacctaaggggtgagactaacgaaacggttacgtggttcggactcgacnccttagttccgttgttccttctacttcccgttccccgctaacg

SEQ ID NO: 319623 - DNA, 537 bp, Homo sapiens
  misc_feature: GZ8MTXP01DE3DF.51.41.D08.1.454.CMB.2.raw
  modified_base (257)..(257): a, c, t, g, unknown or other
  misc_feature (257)..(257): n is a, c, g, or t
tcagcgatcgtatacacgaccggtgctcgatttagtcacgcgagaaagggaagggtggggcacttctccctctaacactctcccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaatggtatcagcagaaccagggaaancccctaaatcctgatctatgctgcatccagtttgcaaagtgaggtcccatccaggttcagtggcagtggatcgtgggacagatttcactctcaccatcagtagtctgacaactgaaagtattttagactaacttactactgtacaaactaggtacggtttaaccggtaacccttgaccttactaccgttttcgggacggtaacggggaccgaaaggggtgaaggattaacgaaacgactggttgcgtgcaccttatctgtcttcacttccttccgcctaa

SEQ ID NO: 319624 - DNA, 582 bp, Homo sapiens
  misc_feature: GZ8MTXP01AFAXR.51.41.D08.1.454.CMB.2.raw
  modified_base (209)..(209): a, c, t, g, unknown or other
  misc_feature (209)..(209): n is a, c, g, or t
  modified_base (348)..(348): a, c, t, g, unknown or other
  misc_feature (348)..(348): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcaccatcacttgccggnaagtcagagcattagcagtcttaatttaaattggtatcagacaagaaaccgaggaaacacccctaaactcctagatctatgctgcatccagtttgacaaggtgacgtcccatccgaggttcaggtggctaggtgatcgngggacaagttattcactctacactatcagtagtctgacctaacgtagtaattatttacgactaaactttactacgtagtacaaacgtacggtaaccgggtttaaccggtaccctgtacccttcgtaccggttcgggacgggtaacgggaccgtaagggtagaagtactaacgaaaacgttcgtggttcggctacgcgttaccttagtcttgtccttcacttccctccgctaacg

SEQ ID NO: 319625 - DNA, 632 bp, Homo sapiens
  misc_feature: GZ8MTXP01D75VA.51.41.D08.1.454.CMB.2.raw
  modified_base (211)..(211): a, c, t, g, unknown or other
  misc_feature (211)..(211): n is a, c, g, or t
  modified_base (273)..(273): a, c, t, g, unknown or other
  misc_feature (273)..(273): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcaccatcacttgccggganaagtcagagctattagcagtacttaattttaaatggtatcagacaagaaaccgaaggaaacncccctaaactcctagatctatgctgactatcctaggtttacaacgtaaaaggtcgtacggtacccctagtccgtaggtttacaggtcggactaggtggtatcggtagggacctaaagttactttccacttctaccacctattaccgtagttacgtcttacgaacctaacgtagtaagttattttacgacttaaacttactactacgtaactaaacgtagtaacgggttacgtacctgtacctcgtacgttcgggacggtaacgggtaccgtaagggtagaacgacgtaaccgaaacgttacgtggttcggctacgaccttacgttcttcgttacttcttacacttccccttccgctaag

SEQ ID NO: 319626 - DNA, 565 bp, Homo sapiens
  misc_feature: GZ8MTXP01CYF61.51.41.D08.1.454.CMB.2.raw
  modified_base (522)..(522): a, c, t, g, unknown or other
  misc_feature (522)..(522): n is a, c, g, or t
  modified_base (532)..(532): a, c, t, g, unknown or other
  misc_feature (532)..(532): n is a, c, g, or t
  modified_base (559)..(559): a, c, t, g, unknown or other
  misc_feature (559)..(559): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcacatcacttgcggcaagtcagagcattagcagtcttaatttaaattggtatacagacaagaaaccgagggaaacacccctaaactcctagatctatgctgacatcctagttgactaaagtgacgtcccatcgagttcagtgcagtggatcgtaggacaagtattcactctacacctatcagtgtctgacaacgtgaagttatttacgacttaacttactatacgtacaaacgtaggtacggttacccggtacctgaccgttacgtaccggttcgggacggtaacgggaaccgtaagggtggaacgtaacgtaacgtaaacgacgttggnggtctgaccncttatcgtattctcacttccttcccgnttaacg

SEQ ID NO: 319627 - DNA, 589 bp, Homo sapiens
  misc_feature: GZ8MTXP01DU8TQ.51.41.D08.1.454.CMB.2.raw
  modified_base (264)..(264): a, c, t, g, unknown or other
  misc_feature (264)..(264): n is a, c, g, or t
tcagcgatcgtatacacgaccggtgctcgatttagtcacgcgagaaagggaaaggggtgggggcacttctccctctaacactctcccgctcagctcctggggctcctgctactctggctccgaggtgccagatgtgacatccagatgacccagtctccatcctccctgtctgcatctgtaggagacagagtcaccatcacttgccgggcaagtcagagcattagcagcttaatttaaatggtatcagcaagaaaccaggaaacncccctaaactcctgatctatgctgcatcctagtttgacaaagtgagtccccatccaggtttcagtgcagtgatcgtggacaagtatttcactctacaccatcagtatctgacaactgaagttattttacgacttaacttactactagtacaaacgtagtacggtttaccggtaccttgtaccttacgtaccgtttcgggacgggtaaacggggacccgtaaagggttacggaagtaacgtaaacgtaaaacggttaacgtggttcggtacttcggaccgttaccttacttccgtgttccttctacttccttaaccccgcgttaac

SEQ ID NO: 319628 - DNA, 564 bp, Homo sapiens
  misc_feature: GZ8MTXP01CPL9A.51.41.D08.1.454.CMB.2.raw
  modified_base (263)..(263): a, c, t, g, unknown or other
  misc_feature (263)..(263): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaatggtatcagcaagaaaccgaggaaacncccctaaactcctagatctatgctgcatcctagtttgacaaagtgacggtcccatccgaggttcagtgcagtggatcgtgggacaagtactttcactctcaccatcagtagtctagacaacgtgtaaagtattttagactaaacttactactgtacaagtagtacggttacggtacctgtactctacgttcgggacggtacggacgtaagggtgaacgtataacgaaaacgttacgttggacggtcgtcgcttaacccttattcgtacgttccttacacttcccttccccggaacttaacg

SEQ ID NO: 319629 - DNA, 542 bp, Homo sapiens
  misc_feature: GZ8MTXP01B5A6W.51.41.D08.1.454.CMB.2.raw
  modified_base (262)..(262): a, c, t, g, unknown or other
  misc_feature (262)..(262): n is a, c, g, or t
  modified_base (362)..(362): a, c, t, g, unknown or other
  misc_feature (362)..(362): n is a, c, g, or t
  modified_base (368)..(368): a, c, t, g, unknown or other
  misc_feature (368)..(368): n is a, c, g, or t
  modified_base (398)..(398): a, c, t, g, unknown or other
  misc_feature (398)..(398): n is a, c, g, or t
  modified_base (536)..(536): a, c, t, g, unknown or other
  misc_feature (536)..(536): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaatggtatcagcagaaaccagggaaacncccctaaatcctgatctatgctgctaatcctagtttgacaaagtgacggtcccaatccagttcagtcggctagtggatcgtagggacagatttcacttcncaaccntcagtagtctagacaactgaatagttttanactaacttactactagtacaaacgtagtacggttacggtaccgtgtctacgtacgttcgggacggtacgggacgtaaggtgggaatagtaacaaacgttaagtgttgctgcacttatctgtcttcacttccgttcccncgtaac

SEQ ID NO: 319630 - DNA, 605 bp, Homo sapiens
  misc_feature: GZ8MTXP01DA6DO.51.41.D08.1.454.CMB.2.raw
  modified_base (210)..(210): a, c, t, g, unknown or other
  misc_feature (210)..(210): n is a, c, g, or t
  modified_base (266)..(266): a, c, t, g, unknown or other
  misc_feature (266)..(266): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcaccatcacttgccgggnaagtcagagcattagcagcttaatttaaattggtatcagcaagaaaccaggaaacncccctaaatcctagatctatgctgcatccagtttgacaaagtgacgtcccatccagttcagtgcagtggatcgtggacaagtatttcactctacaccatcagtagtctgacctaacgtagtaagttattttacgacttaacttactactagtacaaacgtagtaacgggttaccggttaccctgtaccttacgtaacgtttcgggacgggtaacgggaaccgtaaaggggttaggaacgtaacgttaaccggaaaacgttaacggttggttacgggacttcggaccgttaaccgttatttccgtagttcctttacgacttcccgtttccccgccttaag

SEQ ID NO: 319631 - DNA, 616 bp, Homo sapiens
  misc_feature: GZ8MTXP01DOTBT.51.41.D08.1.454.CMB.2.raw
  modified_base (186)..(186): a, c, t, g, unknown or other
  misc_feature (186)..(186): n is a, c, g, or t
  modified_base (213)..(213): a, c, t, g, unknown or other
  misc_feature (213)..(213): n is a, c, g, or t
  modified_base (587)..(587): a, c, t, g, unknown or other
  misc_feature (587)..(587): n is a, c, g, or t
  modified_base (603)..(603): a, c, t, g, unknown or other
  misc_feature (603)..(603): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatcgacccagtctccatcctccctgtctgcatctgtagganacagagtcacatcacttcggccggganaagtcagagctaattagcagtcttaatttaaattggtatcagcaagaaaccgagggaaacacccctaaatctagactctatcgctgactacttccgtagtttacgaactaaaggtcggtaacggtcccctaagtccgtaggttcaggtggactaggtggatcgtaggactaagttatttcacttcacacatcgagtatctgacctacgtagtaagttatttagaaccttaacttacctagtacgtactaaacgtacggttaacgggtttacccggtaccttcgtaccttaccgtaccggtttcgggaacgggtaacggggtaaccgaaggggtacgaggtaactaaacaaacggttagtcgggttagctcgacncgttatcgttatctancttcctccgcttc

SEQ ID NO: 319632 - DNA, 588 bp, Homo sapiens
  misc_feature: GZ8MTXP01DFP62.51.41.D08.1.454.CMB.2.raw
  modified_base (210)..(210): a, c, t, g, unknown or other
  misc_feature (210)..(210): n is a, c, g, or t
  modified_base (266)..(266): a, c, t, g, unknown or other
  misc_feature (266)..(266): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcaccatcacttgccgggnaagtcagagcattagcagtcttaatttaaatggtatcagcaagaaaccaggaaacncccctaaatcctagatctatgctgcatccagtttgactaaagtgacgtccatccgagttcagtgctaggtgatcgtggactagtatttcactctacactatcagtacgtctagactaacgtgtaagttattttacgacttaaacttactactagaactaacgtagtacgggttaccgtacctgcttacgtaccgttcgggacgggtaacgggtaccgtaagggtggaactaacgtaacgtaaaacggttacgttggcggtactcgacccttacttacgttccgtacgtttcctttactacctttcccgttccccgccttaag

SEQ ID NO: 319633 - DNA, 625 bp, Homo sapiens
  misc_feature: GZ8MTXP01EHKYA.51.41.D08.1.454.CMB.2.raw
  modified_base (276)..(276): a, c, t, g, unknown or other
  misc_feature (276)..(276): n is a, c, g, or t
  modified_base (592)..(592): a, c, t, g, unknown or other
  misc_feature (592)..(592): n is a, c, g, or t
tcagcgatcgtatacacgaccggtgctcgatttagtcacgcgagaaagggaaaggggtgggggcacttctccctctaacactctcccgctcagctcctggggctcctgctactctggctccgaggtgccagatgtgacatccagatgacccagtctccatcctccctgtctgcatctgtaggagacagagtcaccatcacttgccgggacaagtcagagctaattagcaagtacttaatttaaagttggtatcagacaagaaaccgaagggaaacncccctaaatcctagatctatgctgctatcctagttgactaaagtgacgtcccatccgaggttcagtgctagtgatcgtaggacaagtactttcactcctacacctattacaggttctacttacgaactaacgtagtaaacttattttacgacttaaacttactactacgtaacaaacgtacgttaacggggtttaaccggtaccttcgtaccttacgtacgtttacgggacggggtaaacgggaccgtaaagggtggaaagtaacaaacgtaaacggttagttggttacgacttcgaccttaccgttattaacgtnttccgttactacgttccctttaacccgcttaag

SEQ ID NO: 319634 - DNA, 527 bp, Homo sapiens
  misc_feature: GZ8MTXP01AVQ9S.51.41.D08.1.454.CMB.2.raw
  modified_base (210)..(210): a, c, t, g, unknown or other
  misc_feature (210)..(210): n is a, c, g, or t
  modified_base (266)..(266): a, c, t, g, unknown or other
  misc_feature (266)..(266): n is a, c, g, or t
  modified_base (302)..(302): a, c, t, g, unknown or other
  misc_feature (302)..(302): n is a, c, g, or t
  modified_base (413)..(413): a, c, t, g, unknown or other
  misc_feature (413)..(413): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcaccatcacttgccgggnaagtcagagcattagcagtacttaatttaaatggtatcagcagaaacagggaaacncccctaaactctagatctatgctgctatccagtttnacaaagtgacgtcccatccgagttcagtggcagtggatcgtgggactagtactttcacttcacacgatcgagtagtctgacaactgaatattttcgacttaactactactntaaccaagtacgtagggttaccgtacctgcctcgtacgttgggacggtaagggactaggtaggatataacgaacgttagtgacgtcgcgcgcactctctctctcttctccgctc

SEQ ID NO: 319635 - DNA, 600 bp, Homo sapiens
  misc_feature: GZ8MTXP01D9K55.51.41.D08.1.454.CMB.2.raw
  modified_base (348)..(348): a, c, t, g, unknown or other
  misc_feature (348)..(348): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcaccatcacttgccgggcaagtcagagcattagcagtcttaatttaaattggtatcagacaagaaaccgagggaaacacccctaaatcctgatctatgctgacatcctagtttgacaaagtgacgtcccatcctaggttcaggtgcagtggatcgnggactaagtactttcactctacaccgtatcgtaagttacgtctgactaacgtagtaaagttattttacgaccttaaactttactactacgtactaaacgtagttacggggtttaaccgtaccctgtacctacgtacggtttcgggacgggaacggtaccgtaagggtgaagaacgtaacgaaaacgttacgtggttacggctacgaccttaccttacgttctgttccttcacttcccgttaaccccgctaag

SEQ ID NO: 319636 - DNA, 585 bp, Homo sapiens
  misc_feature: GZ8MTXP01DR4EL.51.41.D08.1.454.CMB.2.raw
  modified_base (332)..(332): a, c, t, g, unknown or other
  misc_feature (332)..(332): n is a, c, g, or t
  modified_base (342)..(342): a, c, t, g, unknown or other
  misc_feature (342)..(342): n is a, c, g, or t
  modified_base (352)..(352): a, c, t, g, unknown or other
  misc_feature (352)..(352): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcaccatcacttgccgggcaagtcagagcattagcagtcttaatttaaatggtatcagacaagaaaccgagggaaacacccctaaatcctagatctatgctgcatcctagttgacaaagtcgacgtcccatccagttcagngcagtgatgnggactaagtntttcactctacacgtatctagtatctgactaacgtgtaagttattttacgaacttaaacttacgtactacgtaacaaacgtacggtaacgggtttaacccggtaccttcgtaccttacgtaccggtttcgggaacggggtaacgggaaccgtaaggggtagacaagtaacaaacgttcgtaggcggtctcgaccgttacttattcgtatccttctacttcctcccgttctaag

SEQ ID NO: 319637 - DNA, 538 bp, Homo sapiens
  misc_feature: GZ8MTXP01AOTKW.51.41.D08.1.454.CMB.2.raw
  modified_base (210)..(210): a, c, t, g, unknown or other
  misc_feature (210)..(210): n is a, c, g, or t
  modified_base (264)..(264): a, c, t, g, unknown or other
  misc_feature (264)..(264): n is a, c, g, or t
  modified_base (484)..(484): a, c, t, g, unknown or other
  misc_feature (484)..(484): n is a, c, g, or t
  modified_base (501)..(501): a, c, t, g, unknown or other
  misc_feature (501)..(501): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcaccatcacttgccgggnaagtcagagcattagcagctaatttaaatggtatcagcagaaaccagggaaacncccctaaactcctagatctatgctgcatccagtttgacaaagtgacggtcccatccaggttcagtgcagtggatcgtgggacaagtatttcactctacaccatacagtagtctgacaacgtgaacgtatttacgactaactttacactcgtacaaacgtagtacgggtttaccggtacctgtacctctacgttcgggacggacggacctaagggtgaagntaacgaaacgagtacgnggctgcacatctagtctacacgttccttcccgcgtaa

SEQ ID NO: 319638 - DNA, 610 bp, Homo sapiens
  misc_feature: GZ8MTXP01AVZH4.51.41.D08.1.454.CMB.2.raw
  modified_base (270)..(270): a, c, t, g, unknown or other
  misc_feature (270)..(270): n is a, c, g, or t
  modified_base (390)..(390): a, c, t, g, unknown or other
  misc_feature (390)..(390): n is a, c, g, or t
  modified_base (552)..(552): a, c, t, g, unknown or other
  misc_feature (552)..(552): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacatagtcaccatcacttggccgggacaagtcagagctattagcagtacttaatttaaatggtatcagcaagaaacagggaaacncccctaaatcctagactctatgctgctatctagtttgactaaagtgacgtcccagtccgaggttcagtgctaggtgatcgaggactaagtacttcactcacacctatcgagttacgtctnacaacgtagtaacgttatttacgacttaacttactactgttaacaaacgtacggttaacgggttaccggtacccttagtaccttacgtacggtttccgggacgggtacggtaaccgtagggtacgtacgaactaaccgaaacggttagtcggaggtccgtanaccgttaccgttcttccgttcgttccttaccgtacgttccccgtaacccgttctaacg

SEQ ID NO: 319639 - DNA, 609 bp, Homo sapiens
  misc_feature: GZ8MTXP01BX1WC.51.41.D08.1.454.CMB.2.raw
  modified_base (267)..(267): a, c, t, g, unknown or other
  misc_feature (267)..(267): n is a, c, g, or t
  modified_base (372)..(372): a, c, t, g, unknown or other
  misc_feature (372)..(372): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcacatcacttgccgggcaagtcagagcattagcagtcttaatttaaattggtatcagcaagaaaccagggaaacncccctaaatcctagatctatgctgctatccgtagtttcgactaaagtcgacggtcccatccgaggttcagtggcagtggatcgtggactaagtactttcgactcncactatcagtacgtctagacctaactgtaacgttattttacgactaactttactactagtaccaaagtacggtacggtttaaccgtaccgtgtaccgttcgtacccggtttcgggacgggttaacggggacctaaggggtacgaagacgttaaacgaaacgttacgtggttccggtactcggttaccaccttatttcctaggttcctttccgacctttccttccccggctttaacgg

SEQ ID NO: 319640 - DNA, 737 bp, Homo sapiens
  misc_feature: GZ8MTXP01EODJ3.51.41.D08.1.454.CMB.2.raw
  modified_base (475)..(475): a, c, t, g, unknown or other
  misc_feature (475)..(475): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcaccatcacgttggccgggacaagtcaagagctattagcagtacttaatttaaagttggtatcgagacaaggaaaccgaagggaaaccacccctaaactccgtagaactctaatgactgactacttccgtaggtttacgaactaaaggtcgtacggtaccccaagttccgtaggtttcgaaggtcggacgtaggtacggagtcggaggtactaaagttactttcacttcctactaccgtagtacgtagttacgtcgacgtaacctaacgttagtaaacgtttnttttaacgacctttaaacttaccttacgttacgtaacccgtaaaacgttccgggtttaaaccgggtttacccggtttaaccccgttggttaccccgtttaaccggttaacccggggtttaccggggaaccggggttaaaccggggtaaccgtaaaggggttacgaacgtaacgtaaaccgtaaacggttagtcggttacggtactcgaaccgccttagtttcctacgttccttacgtaccgttcccttccccgttaataacg

SEQ ID NO: 319641 - DNA, 637 bp, Homo sapiens
  misc_feature: GZ8MTXP01DO36M.51.41.D08.1.454.CMB.2.raw
  modified_base (212)..(212): a, c, t, g, unknown or other
  misc_feature (212)..(212): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatccctccctgtctgcatctgtaggagacagagtcaccatcacttgccggganaagtcagagcaattagcagtacttaatttaaatggtatcagacaagaaaccgaggaaacacccctaaactcctagatctatgctgcatcctagttagacaaagtcgacgtcccatccgtaggttcgagtggctaggtggatcgtagggactaagtactttcactctacactatacgtagtacgtctacgactaaacgtgtaaagttactttagacttaaactttactacttagtaacctaaacgtacggttacgggttaaccggtacccgtcgtaccttaccgtaccgtttacggggacggggtaaacgggtaccgtaagggtacggaacgtaacgtaaacgaaacggttacgttggttacggacctacgaccgttaccttacttctacgttccttacctacttccccgttaacccgcgttaacg

SEQ ID NO: 319642 - DNA, 669 bp, Homo sapiens
  misc_feature: GZ8MTXP01ER094.51.41.D08.1.454.CMB.2.raw
  modified_base (209)..(209): a, c, t, g, unknown or other
  misc_feature (209)..(209): n is a, c, g, or t
  modified_base (305)..(305): a, c, t, g, unknown or other
  misc_feature (305)..(305): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcacatcacttgccgggnaagtcagagcattagcagtacttaatttaaattggtatcagacaagaaaccgagggaaacacccctaaactctagatctatgctgcatccagtttnacaaagtcgacgtcccatccgaggttcaggtcgcgagtggatggagggactaagtactttcactactaccactatcgagttacgtactacgactaacgtagtaagttattttacgacttaaacttactacttagtaactaaacgtacgttaacgggtttaacccgttacccgtagtacccgtttaccgtacggtttaccggggacgggtaaacggggtaaccggtaaaggggtacggtaaacggtaacgttaaaccggtaaaaccgttaaggttcgggttacgggtctaaccggttaccgttaacccttagtttccgtttccttaaccgtttacctaccctttacccgtccccgttcttaacgg

SEQ ID NO: 319643 - DNA, 573 bp, Homo sapiens
  misc_feature: GZ8MTXP01EK62K.51.41.D08.1.454.CMB.2.raw
  modified_base (219)..(219): a, c, t, g, unknown or other
  misc_feature (219)..(219): n is a, c, g, or t
  modified_base (267)..(267): a, c, t, g, unknown or other
  misc_feature (267)..(267): n is a, c, g, or t
  modified_base (343)..(343): a, c, t, g, unknown or other
  misc_feature (343)..(343): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcaccatcacttgccgggcaagtcagancattagcagcttaatttaaattggtatcagcaagaaaccagggaaacncccctaaatcctgatctatgctgcatcctagtttcgacaaagtgacgtcccatccaggttcagtgcagtggatcgnggacaagtactttcactcgtccacctagtcagtacgtctagactaacgtgtaagttatttttacgacttaaacttactactacgtacaaacgtagtacgggttaacggtccctgtaccttcgtacgttcgggacggtaacgggaccgtaagggtaggagtaagtaacgaaacgacgttggcgggctaacgccttacttacgttctacttcttcacttcctcccgcctaag

SEQ ID NO: 319644 - DNA, 567 bp, Homo sapiens
  misc_feature: GZ8MTXP01D2X2V.51.41.D08.1.454.CMB.2.raw
  modified_base (260)..(260): a, c, t, g, unknown or other
  misc_feature (260)..(260): n is a, c, g, or t
tcagcgatcgtatacacgaccggtgctcgatttagtcacgcgagaaagggaaaggggtgggggcacttctccctctaacactctcccgctcagctcctggggctcctgctactctggctccgaggtgccagatgtgacatccagatgacccagtctccatcctccctgtctgcatctgtaggagacagagtcaccatcacttgccgggcaagtcagagcattagcagcttatttaaatggtatcagcagaaacaggaaancccctaaactctgatctatgctgcatccagtttgacaaagtgacgtcccatccgaggttcagtgcagtggatcgtgggacaagtatttcgacttctaccaccatcagttacgtctagacaactgtaagtattttacgactaaacttactactagtacaaactagtacggttaaccggtaccctgactactacgttcggcggtaacgggaccgtaagggtcggagaacgtaacgaaaacgttacgtggttacgggtctacgaccgccttagttctagttcctttcactttcccgtttcccgcttaacg

SEQ ID NO: 319645 - DNA, 629 bp, Homo sapiens
  misc_feature: GZ8MTXP01AREUF.51.41.D08.1.454.CMB.2.raw
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcaccatcacttggccgggcaagtcagagcattagcagtcttaatttaaatggtatcagcaagaaaccgaggaaacgacccctaaatcctagatctatgctgctatcctagtttagactaaagtcgtacgtcccatccgaggttcagtggacagtggatcgtaggactaagtactttcactctacactatctagtacgtctagacctaactagtaacgttattttacgacttaacttactacttacgtaacaacgtaggtaaccggtttaccggtaccttcgaccgttaccgttacggttccggggaacgggtaacgggtaaccgtaaaggggtcgaagtaacgtaaaccgaaaggttacgtcggttcggtactcggacccttacgttacttccggttacttccttacgtaccttccccgttaaccccgttctaaccg

SEQ ID NO: 319646 - DNA, 583 bp, Homo sapiens
  misc_feature: GZ8MTXP01BTFVJ.51.41.D08.1.454.CMB.2.raw
  modified_base (541)..(541): a, c, t, g, unknown or other
  misc_feature (541)..(541): n is a, c, g, or t
  modified_base (560)..(560): a, c, t, g, unknown or other
  misc_feature (560)..(560): n is a, c, g, or t
tcagcgatcgtatacacgaccggtgctcgatttagtcacgcgagaaagggaaaggggtgggggcacttctccctctaacactctcccgctcagctcctggggctcctgctactctggctccgaggtgccagatgtgacatccagatgacccagtctccatcctccctgtctgcatctgtaggagacagagtcaccatcacttgccgggcaagtcagagctaattagcagtacttaatttaaattggtatcagacaagaaaccgagggaaacacccctaaactcctagatctatgctgctatcctagtttcgacaaagtcgacggtcccagtccgagttcagtgactagtggatcgtggactaagtactttcactctacactatcgagtacgtctcgactaactgtaagttattttacgacttaacttactacgttacgtacaaacgtacgtaacgggttaccgttacctcgtacctacgtaccggttcgggacggtaagggtaccgtaaagggtcggaacacgtaacgaaacgttgtacgnggactcgacgcttatcgtntcttctacgttcctccgctaacg

SEQ ID NO: 319647 - DNA, 597 bp, Homo sapiens
  misc_feature: GZ8MTXP01DBNNO.51.41.D08.1.454.CMB.2.raw
  modified_base (580)..(580): a, c, t, g, unknown or other
  misc_feature (580)..(580): n is a, c, g, or t
  modified_base (593)..(593): a, c, t, g, unknown or other
  misc_feature (593)..(593): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcacatcacttgccgggcaagtcagagcattagcagtacttaatttaaattggtatcagcaagaaaccgaggaaacgcccctaaatcctagatctatgctgctatcctagttgactaaagtgacgtaccctatccgtaggttcaggtggctaggtgatcgtaggactaagtatttcactccacacatcgtagttagtctagactaacgtagtaacgtttatttacgacttaaactttacgaactgtaacaaacgtagttaacgggtttacccgtaccttgaccttacgttacgttcggggaggtaaacgggaacctaagggtaggaactataaacgaaacggttacgtggacggtactcgaaccttcttattccgtgtaacctttaccnccttccctcccgngtcg

SEQ ID NO: 319648 - DNA, 584 bp, Homo sapiens
  misc_feature: GZ8MTXP01A0251.51.41.D08.1.454.CMB.2.raw
  modified_base (267)..(267): a, c, t, g, unknown or other
  misc_feature (267)..(267): n is a, c, g, or t
  modified_base (302)..(302): a, c, t, g, unknown or other
  misc_feature (302)..(302): n is a, c, g, or t
  modified_base (341)..(341): a, c, t, g, unknown or other
  misc_feature (341)..(341): n is a, c, g, or t
  modified_base (351)..(351): a, c, t, g, unknown or other
  misc_feature (351)..(351): n is a, c, g, or t
  modified_base (543)..(543): a, c, t, g, unknown or other
  misc_feature (543)..(543): n is a, c, g, or t
  modified_base (551)..(551): a, c, t, g, unknown or other
  misc_feature (551)..(551): n is a, c, g, or t
tcagcgatcgtatacacgaccggtgctcgatttagtcacgcgagaaagggaaaggggtgggggcacttctccctctaacactctcccgctcagctcctggggctcctgctactctggctccgaggtgccagatgtgacatccagatgacccagtctccatcctccctgtctgcatctgtaggagacagagtcaccatcacttggccgggcaagtcagagcattagcagtcttaatttaaattggtatcagcaagaaaccaggaaacncccctaaatcctgatctatgctgcatcctagtttnacaagtgacgtcccatccaggttcaggtgcagtgatcgnggactaagtnttcactctcacctatcagtcgtctagactaacgtgtaaagttagttttacacttaaacttacgtacttagtaacctaacgtaacggtaacggggttaccggtacccttggtaccttcgtaacgttccgggagggtaacggacgtaagggtcgaacgacgttaacgaaaacgttcgtagttcggactcgaccncgttactnttcgtccttcgtacttcccttcccggcttaacg

SEQ ID NO: 319649 - DNA, 605 bp, Homo sapiens
  misc_feature: GZ8MTXP01CGP8J.51.41.D08.1.454.CMB.2.raw
  modified_base (209)..(209): a, c, t, g, unknown or other
  misc_feature (209)..(209): n is a, c, g, or t
  modified_base (268)..(268): a, c, t, g, unknown or other
  misc_feature (268)..(268): n is a, c, g, or t
  modified_base (422)..(422): a, c, t, g, unknown or other
  misc_feature (422)..(422): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagatcacatcacttgccggganaagtcagagcattagcagtcttaatttaaattggtatcagacaagaaaccgaggaaacncccctaaactcctagatctatgctgacacttcctagtttgaacgtaaagtcgacggtcccatccgtaggtttcaggtggctaggtggtatcgtagggactaaagtactttcaccttctacacctatcgagtctctgactaacgtagtaaagttnttttacgacttaacttacgtactacgtaacaacgtacgttacggttaaccggtcctgtaccttacgtacggttcgggacggtaacggaccgtaaggggtacgaacgtacgtaaacgaaacgttcgtaggcggtactcggaccacttacttcgtcttcttacctacttcccttcccgcttaacg

SEQ ID NO: 319650 - DNA, 593 bp, Homo sapiens
  misc_feature: GZ8MTXP01D0ZU5.51.41.D08.1.454.CMB.2.raw
  modified_base (210)..(210): a, c, t, g, unknown or other
  misc_feature (210)..(210): n is a, c, g, or t
  modified_base (265)..(265): a, c, t, g, unknown or other
  misc_feature (265)..(265): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcaccatcacttgccgggnaagtcagagcattagcagtcttaatttaaatggtatcagcaagaaacaggaaacncccctaaactcctagatctatgctgcatccagtttgacaaagtgacgtcccatccaggttcagtgctagtgatcgtggactaagtatttcactctacacctatcagtacgtctagactaactagtaacgttattttacgacttaacttactactacgtacaaacgtacggtacggttaccggtaccctcgtacctcgtaccgtttcgggacgggtaacgggaccgtaagggtacgagtaacgtaaccgaaacggttacgtggttcggacgtacgttaccgaccttagttccttacgttccttactaccgttccgttcccgcgttaacg

SEQ ID NO: 319651 - DNA, 558 bp, Homo sapiens
  misc_feature: GZ8MTXP01ASL5K.51.41.D08.1.454.CMB.2.raw
  modified_base (266)..(266): a, c, t, g, unknown or other
  misc_feature (266)..(266): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcaccatcacttgccgggcaagtcagagcattagcagcttaatttaaatggtatcagcaagaaaccagggaaacncccctaaactcctagatctatgctgcatccagtttgacaaagtgacggtcccatccagttcagtgcaggtgatcgtagggacaagtatttcactctacaccatacagtacgtctgacaactagaatattttagactaacttactactagtacaaagtagtaacggttaccggtaaccctgaccttacgtaccgttcggacgggtaaggaccgtaaggtacgagaactaacgaaacgttactggcggactacgcacttacttcgtcgtcctttacacttccgttcccgctaag

SEQ ID NO: 319652 - DNA, 625 bp, Homo sapiens
  misc_feature: GZ8MTXP01BDWRR.51.41.D08.1.454.CMB.2.raw
  modified_base (249)..(249): a, c, t, g, unknown or other
  misc_feature (249)..(249): n is a, c, g, or t
  modified_base (270)..(270): a, c, t, g, unknown or other
  misc_feature (270)..(270): n is a, c, g, or t
tcagcgatcgtatacacgaccggtgctcgatttagtcacgcgagaaagggaaaggggtgggggcacttctccctctaacactctcccgctcagctcctggggctcctgctactctggctccgaggtgccagatgtgacatccagatgacccagtctccatcctccctgtctgcatctgtaggagacagagtcaccatcacttggccgggacaagtcagagctattagcagtacttaatttaaatggtancagacaagaaacagggaaacncccctaaactctagatctatgctgctatccgtagtttgacaaagtcgacgcccctagtccgtaggttcagtggactaggtgatcgaggacaagtacttcactctacacctatacagtactctagacctaacgtagtaacttatttacgacttaacttacgtatcgtaacaacgtaggtaacgggttaaccgtaccgtgtaccttacgtaccggtttcgggacggtaacgggtacgtaaggggtacgaacgttaacgaacgtaaacggttacgtacggttcggtactacgaccttacgttactttccgttacggttaacctttaccgtccgttacccgttccccgttccgttaacg

SEQ ID NO: 319653 - DNA, 588 bp, Homo sapiens
  misc_feature: GZ8MTXP01EYBXO.51.41.D08.1.454.CMB.2.raw
  modified_base (210)..(210): a, c, t, g, unknown or other
  misc_feature (210)..(210): n is a, c, g, or t
  modified_base (270)..(270): a, c, t, g, unknown or other
  misc_feature (270)..(270): n is a, c, g, or t
  modified_base (306)..(306): a, c, t, g, unknown or other
  misc_feature (306)..(306): n is a, c, g, or t
  modified_base (463)..(463): a, c, t, g, unknown or other
  misc_feature (463)..(463): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcaccatcacttgccgggnaagtcagagcattagcagtacttaatttaaattggtatcagacaagaaaccagggaaacncccctaaactcctgatctatgctgcatcctagtttnactaaagtgacgtcccatccgaggttcagtgctagtggatcgtagggactaagtactttcactctaccactatacgagttacgtctcgactaacgtagtaagttattttacgacttaaacttactactagtacaacgtagtacggttacgtaccgtnctactacgttcgggacggaaggaccgtaaagggtggaacgtaacgtaacaaacggttaacgtggttcgtacgtacgaccgttacttacgttctcgttccttactacttcccttcccgcgttaacg

SEQ ID NO: 319654 - DNA, 706 bp, Homo sapiens
  misc_feature: GZ8MTXP01BWB2B.51.41.D08.1.454.CMB.2.raw
  modified_base (185)..(185): a, c, t, g, unknown or other
  misc_feature (185)..(185): n is a, c, g, or t
  modified_base (213)..(213): a, c, t, g, unknown or other
  misc_feature (213)..(213): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctcctgtctgcatctggtagganacagagtcaccatcacgttggccggganaagtcaagagactattagactagtacttaatttaaagtggtaatacgagacaacgaaaccgagggaaaccacccctaaagtcctagacttctatcgctgacctagttacctaggtttacgaactaaaggtcggtaccggtccctagttaccgtaggtttacgaggttcggacgtaggtcggtaatcggtaggactaagttacttcgactctacacctatacgagttctacgtcgaacctaagtagttaaacttagtttacaaccttaactttacctacgtacgtaacctaaacgttacggttaaccggggtttaacccggtccctttacgacccgtttacgtaaccgggtttcggggaacgggttaacgggaccgtaaggggtacgaaacgtccgtaaaacggtaaaccgttggtttcggacgttaccgacgttacccgttactttcggttcttccgttaacttcgtacctttccccggtccccttaagttcg

SEQ ID NO: 319655 - DNA, 622 bp, Homo sapiens
  misc_feature: GZ8MTXP01ELMSU.51.41.D08.1.454.CMB.2.raw
  modified_base (264)..(264): a, c, t, g, unknown or other
  misc_feature (264)..(264): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcaccatcacttgccgggcaagtcagagcattagcagtctaatttaaatggtatcagcaagaaacaggaaacncccctaaatcctgatctatgctgcatcagtttgacaaagtgagtcccatccaggttcagtgcagtggatcgtgggacaagtactttcactctacacatcagtagtctgacaactgaaagtattttagactaaacttaactactacgtactaaacgtaggtaaccgggtttaacggttaacccctgtaccttacgtaccggtttaccggggacggggtaaacgggaaccgtaaaggggtacggtaaggaacttaaacgaaaacggttaaacgttcgggttaaggcgttacgaccgttaacccttaagttccgttacgttccttcctaaacgtttcccttccccggttaacctttaaccg

SEQ ID NO: 319656 - DNA, 588 bp, Homo sapiens
  misc_feature: GZ8MTXP01CIN63.51.41.D08.1.454.CMB.2.raw
  modified_base (209)..(209): a, c, t, g, unknown or other
  misc_feature (209)..(209): n is a, c, g, or t
  modified_base (268)..(268): a, c, t, g, unknown or other
  misc_feature (268)..(268): n is a, c, g, or t
  modified_base (345)..(345): a, c, t, g, unknown or other
  misc_feature (345)..(345): n is a, c, g, or t
  modified_base (370)..(370): a, c, t, g, unknown or other
  misc_feature (370)..(370): n is a, c, g, or t
  modified_base (374)..(374): a, c, t, g, unknown or other
  misc_feature (374)..(374): n is a, c, g, or t
  modified_base (527)..(527): a, c, t, g, unknown or other
  misc_feature (527)..(527): n is a, c, g, or t
  modified_base (583)..(583): a, c, t, g, unknown or other
  misc_feature (583)..(583): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcaccatcacttgccggnaagtcagagcattagcagtcttaatttaaatggtatcagacaagaaaccgagggaaacncccctaaatcctagatctatcgctgctattccagtttcgacgtaaagtgacgtcccatccgtaggttcagtgctagnggatcgaggacaagtacttcactcncacntcagtacgtctagacctaacgtgtaaagttcttttacgaacctaaactttactactagtaacaaagtacggtacggtttaccggtaccctgtaccgtactacggttcgggacggtacgggacctaaggggtagacgacgtaacgaaacggttntggttcggacctgaccgttaccttagttctacgtccttacgcttcccttaacccgntaacg

SEQ ID NO: 319657 - DNA, 602 bp, Homo sapiens
  misc_feature: GZ8MTXP01EDODC.51.41.D08.1.454.CMB.2.raw
  modified_base (266)..(266): a, c, t, g, unknown or other
  misc_feature (266)..(266): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcacatcacttgccgggcaagtcagagcattagcagtcttaatttaaatggtatcagacaagaaaccagggaacncccctaaatcctgatctatgctgacatcctagtttcgataaagtgtacgtccctatccgagttcaggtcgcgtagtggatgtgggactaagtactttcactctacacgtatcagttacgtctagacctaacgtagtaaagttattttacgacttaacttactactacgtaacaaacgttagtaacggggtttaccgttcccgtacgtcttaccgtacgtttcggggacgggaagggtaccgtaagggtcgaacgtaacgtaacgtaaacggttacgtggttcggtctacgaccgacttacttcgtacttccttactcttacccttcccgcttaacg

SEQ ID NO: 319658 - DNA, 642 bp, Homo sapiens
  misc_feature: GZ8MTXP01ERJUF.51.41.D08.1.454.CMB.2.raw
  modified_base (186)..(186): a, c, t, g, unknown or other
  misc_feature (186)..(186): n is a, c, g, or t
  modified_base (270)..(270): a, c, t, g, unknown or other
  misc_feature (270)..(270): n is a, c, g, or t
  modified_base (439)..(439): a, c, t, g, unknown or other
  misc_feature (439)..(439): n is a, c, g, or t
tcagcgatcgtatacacgaccggtgctcgatttagtcacgcgagaaagggaaggggtgggggcacttctccctctaacactctccccgctcagctcctggggctcctgctactctggctccgaggtgccagatgtgacatccagatgacccagtctccatcctccctgtctgcatctgtagagacngagtcaccatcacttggccggcaagtcagagcattagcagtacttaatttaaattggtatcaagcaagaaaaccgagggaaacncccctaaatcctgatctatgtctgctatctagttgacaagtaggtcgacctacgtccgtaggttcagtcggtactaaggtggaagttcggaggggtaactaagttaacttttccaactctaccacccgtatccggtaattcgtacttggaacctaacgttagtaaagtnttttacacttacttaacgttacttacgtaacaactggtaacgtcccgttaccgtcgtcgtacgtaacgggtttccgggaagggtaacgggaccgtaaagggcgtaaaggaacttaaccgaaaaacggttccgggtcggttagaccgtcaaccgttaccttcgtttcctcttccttacgttccgttacccgttccgccgtaacg

SEQ ID NO: 319659 - DNA, 712 bp, Homo sapiens
  misc_feature: GZ8MTXP01A4PIQ.51.41.D08.1.454.CMB.2.raw
  modified_base (212)..(212): a, c, t, g, unknown or other
  misc_feature (212)..(212): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagatcaccatcacgttcgccggganaagtcagagctaattagcagtacttaatttaaagttggtatacgagacaaaggaaaccgaagggaaaccacccctaaagtcctagacttctatcgctgactacttccgtaggtttcaacgtaaaggtcggaaccgttccccagttacccggtaggttccgaaggtcggacgtagggtcggtacgttacggtaggggtaacctaaaggtttacctttcccgacctttaccctaccaaacccgttagtaccggtaagtttacccgggtacctaagaacccttaacgttagtaaacgtttagttttaacccgaaacctttaaactttaaccgtacgttaacggtaactaaacgttacggtttaccgggggttaaccgttacccgttgtacccgttacgttacgggttacgggaacgggttacggaaccgtagggtacgaagtacgtaaacgaaacgttgtgcgatcgaacttcttattcgctaactcacttccgtcgaacttg

SEQ ID NO: 319660 - DNA, 659 bp, Homo sapiens
  misc_feature: GZ8MTXP01ATQVS.51.41.D08.1.454.CMB.2.raw
  modified_base (213)..(213): a, c, t, g, unknown or other
  misc_feature (213)..(213): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcaccatcacgttggccggganaagtcagagcattagcagtcttaatttaaattggtatcagacaagaaacgagggaaacacccctaaatcctgatctatgctgacctatccgtagtttcgacgtaaaggtcggtacggtacccagtaccgtaggtttcgaggtggcgtaaggttggattccgtaggggacctaagttactttccactcctaccactatactagtacgtactagacctaacgtagtaaacgttagtttacgaacttaaacttactacgtacgtaactaaacgtacggttaaggggttaccccggtaaccgttgtaccgttacgtaccggttacggggaccggaaaggggtaccgtaaggggtaggaacgtacgtaaacgtaaacggagtcggttaggtccgtacgaccgaccttggtaacttcgttcctacgtaccgttcccgtcccgttaactaacg

SEQ ID NO: 319661 - DNA, 597 bp, Homo sapiens
  misc_feature: GZ8MTXP01CDZ9X.51.41.D08.1.454.CMB.2.raw
  modified_base (269)..(269): a, c, t, g, unknown or other
  misc_feature (269)..(269): n is a, c, g, or t
  modified_base (430)..(430): a, c, t, g, unknown or other
  misc_feature (430)..(430): n is a, c, g, or t
  modified_base (540)..(540): a, c, t, g, unknown or other
  misc_feature (540)..(540): n is a, c, g, or t
  modified_base (546)..(546): a, c, t, g, unknown or other
  misc_feature (546)..(546): n is a, c, g, or t
  modified_base (593)..(593): a, c, t, g, unknown or other
  misc_feature (593)..(593): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcaccatcacttgccgggcaagtcagagcattagcagtcttaatttaaatggtatcagacaagaaaccgagggaaacncccctaaatcctagtatctatgactgactattcctagtttagacgtaaaggtcgacggtcccagtccgtaggttcgaggtggcgtacggtggactcgtagggactaagtactttcactcctacactatactagtacgtctagaacctacgtaggtaacttntttacgacttaacttactactagtaacaagtacgtacggttaccggtacctgtaccttcgtacgttcggggaggtaacgggacgtaagggtgaactacgtaactaaacgngttggngtactcgaccgttacttacgttcttgtccttcacctttcctccccgnttcg

SEQ ID NO: 319662 - DNA, 661 bp, Homo sapiens
  misc_feature: GZ8MTXP01BJ92J.51.41.D08.1.454.CMB.2.raw
  modified_base (209)..(209): a, c, t, g, unknown or other
  misc_feature (209)..(209): n is a, c, g, or t
  modified_base (272)..(272): a, c, t, g, unknown or other
  misc_feature (272)..(272): n is a, c, g, or t
  modified_base (343)..(343): a, c, t, g, unknown or other
  misc_feature (343)..(343): n is a, c, g, or t
tcagcgatcgtatacacgaccggtgctcgatttagtcacgcgagaaagggaaaggggtgggggcacttctccctctaacactctcccgctcagctcctggggctcctgctactctggctccgaggtgccagatgtgacatccagatgacccagtctccatcctccctgtctgcatctgtaggagacagagtcacatcacttggccgggnaagtcagagctattagctagtcttaatttaaagttggtatcagacaacgaaacgagggaaacncccctaaatcctagatctatgctgcatcctagttcgactaaagtcgtacgtccatcgtagttcaggtcgcngtggatcgtggacaagtcttcgacttcacactatactaggtactacgtcgacctaacgttagtaacgttacgttttacggaaccttaaaccgtttaactaccgttaacgtaaccctaaaggtacggttaaccggggttacccggttaacccgtgttacccgtaccgttacggtttaccggggacggtaaacggggtaaccctaggggttacggacgtaaccgtaaacgtaaacggttacgttcggttacgggacttcggaacccttcgttacgtttccgtacgttcttccgtactttcccggttaaccttccgttaag

SEQ ID NO: 319663 - DNA, 678 bp, Homo sapiens
  misc_feature: GZ8MTXP01CD7HU.51.41.D08.1.454.CMB.2.raw
  modified_base (216)..(216): a, c, t, g, unknown or other
  misc_feature (216)..(216): n is a, c, g, or t
  modified_base (607)..(607): a, c, t, g, unknown or other
  misc_feature (607)..(607): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctggtaggagacagacgtcaccatcacgttcggccggganaagtcagagctaattagctagtacttaatttaaagttggtatcagacaaaggaaaccgagggaaaccacccctaaatcctagactctagcgctgacctgtccgtaagttcgaacgtaaaggttgaaccggtccctaagttcccgtaggtttaccgaaggtcggagtacggttggacttcgggtagggaaccttaagttactttcgaccctttcacacctagtacgtagtacgtctacgactacgtagtaagttacttacgtacctaactacgtagtactaacaacgtacggttacgttaaccgtccgtagttccgtacgttaccgggtacgggacggttaaccgggacgtaagggacgtaacggtaactaacgaaacgggtttcgtacggnggtaaccctgacccgttaaccttggttccccttgttcccgtattacccggtttcctaacccggttctaacg

SEQ ID NO: 319664 - DNA, 631 bp, Homo sapiens
  misc_feature: GZ8MTXP01E2WU9.51.41.D08.1.454.CMB.2.raw
  modified_base (185)..(185): a, c, t, g, unknown or other
  misc_feature (185)..(185): n is a, c, g, or t
  modified_base (209)..(209): a, c, t, g, unknown or other
  misc_feature (209)..(209): n is a, c, g, or t
  modified_base (264)..(264): a, c, t, g, unknown or other
  misc_feature (264)..(264): n is a, c, g, or t
  modified_base (283)..(283): a, c, t, g, unknown or other
  misc_feature (283)..(283): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtggcagatgtgacatccagatgacccagtctccatcctccctgtctgcatctgtagganacagagtcacatcacttggccggnaagtcagagcattagcagtcttaatttaaatggtatcagcaagaaacagggaacncccctaaatctagatctanggctgcatccgtagttgactaaagtcgaacgtcccaatccgaggttcagtcggactaggtggatcggaggactagtacttcactcacacgtatcaaagtcgtctagacaacgtggtaatagttttacacttaaacttactactcgtaacaaagtaacggttaacgggttaccggttaccctgtacccgtttacgtacccggtttcggggaaccggaacggggtaaaccgaggggttacgaaacgtaacaacgaaacggttaacgtggttacgggtactcggaccttaacgttacgtttccctggttaaccctttaacgtacttccccgtttaaccccgttcgttaacg

SEQ ID NO: 319665 - DNA, 670 bp, Homo sapiens
  misc_feature: GZ8MTXP01BMDCB.51.41.D08.1.454.CMB.2.raw
  modified_base (210)..(210): a, c, t, g, unknown or other
  misc_feature (210)..(210): n is a, c, g, or t
  modified_base (593)..(593): a, c, t, g, unknown or other
  misc_feature (593)..(593): n is a, c, g, or t
  modified_base (638)..(638): a, c, t, g, unknown or other
  misc_feature (638)..(638): n is a, c, g, or t
  modified_base (649)..(649): a, c, t, g, unknown or other
  misc_feature (649)..(649): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcacatcacttcgccgggnaagtcagagctattagcagtcttaatttaatggtatcagacaagaaacgaggaaacacccctaaactcctagatctatcgtctgacctataccgtagtttacgaactaaaggtcggtaccggtaccctaagtacccggtaaggtttccgagggttcgggacgttacgggtaggtagttaccggtaggggtaacctaaaggttacttttccaaccttacctacctaacccaacgttcgtaaacggttacgttctaacggtaccctaaacggttagtaaacgttattttaaccgaacttaactttactacgtacgtaaccaaagtacgttacgggttacggtcctgtactacgtacggttcgggacggtaacggacgtaagggtnaacgtaactaaacgtaacgttacgtggttgccctagacccttacnttcgttatccnctacgttccctaaccgttctg

SEQ ID NO: 319666 - DNA, 584 bp, Homo sapiens
  misc_feature: GZ8MTXP01ALBX5.51.41.D08.1.454.CMB.2.raw
  modified_base (271)..(271): a, c, t, g, unknown or other
  misc_feature (271)..(271): n is a, c, g, or t
  modified_base (379)..(379): a, c, t, g, unknown or other
  misc_feature (379)..(379): n is a, c, g, or t
  modified_base (557)..(557): a, c, t, g, unknown or other
  misc_feature (557)..(557): n is a, c, g, or t
  modified_base (564)..(564): a, c, t, g, unknown or other
  misc_feature (564)..(564): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagatcaccatcacttggccgggacaagtcagagctattagcagtcttaatttaaatggtatcagacaagaaaccgagggaaacncccctaaatcctagatctatgctagctatcctagttcagaaagtcgacgtccagtccgagttcagtggctacggtgatcgtaggactaagtctttcactctacacctntcagtacgtctagacctaaacgtgtaacttatttacgacttaaacttactactagtaacaacgtacgtacgggtttaacccgccttgtaccgtactcgggttacgggacggtaacgggacgtaagggtgaacacgtaaacgaaacgttcgtggttacgtctacgacttacttgttctntccttanaccttccgtaacccgctaag

SEQ ID NO: 319667 - DNA, 679 bp, Homo sapiens
  misc_feature: GZ8MTXP01BNPD7.51.41.D08.1.454.CMB.2.raw
  modified_base (210)..(210): a, c, t, g, unknown or other
  misc_feature (210)..(210): n is a, c, g, or t
  modified_base (227)..(227): a, c, t, g, unknown or other
  misc_feature (227)..(227): n is a, c, g, or t
  modified_base (269)..(269): a, c, t, g, unknown or other
  misc_feature (269)..(269): n is a, c, g, or t
  modified_base (346)..(346): a, c, t, g, unknown or other
  misc_feature (346)..(346): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtcctccatccctccctgtctgcatctgtaggagacagagtcacatcacttgccggnaagtcagagctattagnagtcttaatttaaattggtatcagcaagaaaccgaggaaacncccctaaatcctagactctatgctgctactccgtagtttcgaactaaaggtcgacggtacccctagtccgtaggttnaggtggtcaggttgatcggtagggtactaagttactttccacctcctacctacagtaccgagttacgtcttacgactaacgtagtaagttatttacgacttaacttacgtatactaacgaagtacggttacggttaaccggtcctcgtaccgttaccgttacggttaccgggacgggtaaaccgggtacggtaacgggtacggtaacgtaacgtaaccgtaaacggttaccggttaggttaccgtacgttaccgttaccgttaccttacgttaacccgttagtttaacccgtttacttaccccgttacccgtttaaccccgaacgtttaaccg

SEQ ID NO: 319668 - DNA, 570 bp, Homo sapiens
  misc_feature: GZ8MTXP01DQ8XN.51.41.D08.1.454.CMB.2.raw
  modified_base (391)..(391): a, c, t, g, unknown or other
  misc_feature (391)..(391): n is a, c, g, or t
  modified_base (499)..(499): a, c, t, g, unknown or other
  misc_feature (499)..(499): n is a, c, g, or t
  modified_base (526)..(526): a, c, t, g, unknown or other
  misc_feature (526)..(526): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcaccatcacttgccgggcaagtcagagcattagcagcttaattaaatggtatcagcagaaaccaggaaacgcccctaaactcctagatctatgctgcatctagtttgacaaagtgagtcccatcctagttcagtgctagtggatcgtggactaagatttcgatcctacacatcgatacgtctagcaacctgtaaagttnttttagactaacttactactgtacaactaggacggttacggtacctcgtactcgtacgttcggacggtaacgggtaccaagggtggaacgaagtaacaaaaccggttntccgggttagaccgtacaccgttaacncgttccttcgtaactttccgtaattccctttaacccgcttaacg

SEQ ID NO: 319669 - DNA, 594 bp, Homo sapiens
  misc_feature: GZ8MTXP01BIMRL.51.41.D08.1.454.CMB.2.raw
  modified_base (401)..(401): a, c, t, g, unknown or other
  misc_feature (401)..(401): n is a, c, g, or t
  modified_base (434)..(434): a, c, t, g, unknown or other
  misc_feature (434)..(434): n is a, c, g, or t
  modified_base (561)..(561): a, c, t, g, unknown or other
  misc_feature (561)..(561): n is a, c, g, or t
tcagcgatcgtatacacgaccggtgctcgatttagtcacgcgagaaagggaaaggggtgggggcacttctccctctaacactctccccgctcagctcccggggctcctgctactctggctccgaggtgccagatgtgacatccagatgacccagtctccatcctccctgtctgcatctgtaggagacagagtcacatcacgttcggccggacaagtcagagctattagctagtacttaatttaagttggtatacgaagacaaacggaaaaccgaggggaaacctacccctaaatcctagatacctatcggactgactatccgtagtttgactaaagtgacgtccagttaccgtaggttcaggtcgataggtcgatcgaggatagtaacttcaactcacacntacaggtactctacactaactaggtattagttnaacttaacttatactacgaactaactagttaccgtaccgtctcgtacgtacggttacggacggtacgacgtaaggtcgaacgtactacgaaacgtcgtggttacggcttgacctaacttcgttcttnttcctactccttccgtccttctaacttcgtaag

SEQ ID NO: 319670 - DNA, 726 bp, Homo sapiens
  misc_feature: GZ8MTXP01CAYWL.51.41.D08.1.454.CMB.2.raw
  modified_base (265)..(265): a, c, t, g, unknown or other
  misc_feature (265)..(265): n is a, c, g, or t
  modified_base (306)..(306): a, c, t, g, unknown or other
  misc_feature (306)..(306): n is a, c, g, or t
tcagcgatcgtatacacgaccggtgctcgatttagtcacgcgagaaagggaaaggggtgggggcacttctccctctaacactctcccgctcagctcctggggctcctgctactctggctccgaggtgccagatgtgacatccagatgacccagtctccatcctccctgtctgcatctgtaggagacagagtcaccatcacttgccgggacaagtcagagcattagcagtctaatttaaatggtatcagcaagaaacagggaaacncccctaaatcctagatctatcgctgactacgtcctagtttnacgtaaagttcggacggttccccaagttccgtaggttcgaggttcgggacgtacggtgggtattcggtacggggtaactaagttacttttcccgaacttccgttaaccgaacctagttacgtaaaggttacgttcgttacgaccgtaaaccgttaggtaaacgttgtttttaacgaccttaaacgttttaactacgttacgtaacctaaacggttaacgttaaccggggttttaacccggttaacccgttcgtaccgtttacgttaccggtttcgggggaacggtacggggtaaaccgtaggggttacgaacggtaacttaaccggaaacggttagttcgggacgggtaccttaggacccttaccgttacgttccgtacggtttaaccctttcgtacttcccgtttaaccccgcttaacg

SEQ ID NO: 319671 - DNA, 529 bp, Homo sapiens
  misc_feature: GZ8MTXP02H3BFG.51.41.D08.1.454.CMB.2.raw
  modified_base (356)..(356): a, c, t, g, unknown or other
  misc_feature (356)..(356): n is a, c, g, or t
tcagcgatcgtatacacgaccggtgctcgatttagtcacgcgagaaagggaaaggggtggggcacttctccctctaacactctcccgctcagctcctggggctcctgctactctggctccgaggtgccagatgtgacatccagatgacccagtctccatcctccctgtctgcatctgtaggagacagagtcaccatcacttgccgggcaagtcagagcattagcagctaatttaaattggtatcagcaagaaaccagggaaacgcccctaaactcctgatctatgctgcatccagttgacaaagtgacgtccatccaggttcagtggcagtggatcgtgggacagatttcacttcncaccatcatagtctgcaacctgaagtattttgactaactttactaactgtacaaacagtaacgttacggtaccctgcctctacgtttcgggacggtacgggaccaaagggtgaagactacgaaaacgtatgtcggctcgacactatcgtcgtactctacttcctaccgactac

SEQ ID NO: 319672 - DNA, 509 bp, Homo sapiens
  misc_feature: GZ8MTXP02G078A.51.41.D08.1.454.CMB.2.raw
tcagcgatcgtatacacgaccggtgctcgatttagtcacgcgagaaagggaaaggggtgggggcacttctccctctaacactctcccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaaactcctgatctatgctgcatccagtttgacaaagtgagtcccatccaggttcagtggcagtggatctgggacagatttcactctcaccatcagtagtctgcaacctgaaagtattttagactaaacttactactgtacaaacagtagttacggtacctgctcactttcggacggtagggaccaaggtggaagatacaaaacgaactgtggctgacacatctgtcttcatcttcccgctac

SEQ ID NO: 319673 - DNA, 513 bp, Homo sapiens
  misc_feature: GZ8MTXP02GX55C.51.41.D08.1.454.CMB.2.raw
  modified_base (509)..(509): a, c, t, g, unknown or other
  misc_feature (509)..(509): n is a, c, g, or t
tcagcgatcgtatacacgaccggtgctcgatttagtcacgcgagaaagggaaaggggtgggggcacttctccctctaacactctcccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaatggtatcagcagaaaccaggaaacgcccctaaactcctgatctatgctgcatccagtttgacaaagtgagtcccatccagttcagtggcagtggatcgtgggacagtatttcactctcaccatcagtagtctgcaacctgaagtattttgactaacttactactgtacaaacagtaacgttacggtaacctgtctacgtacgtttcgggacggagggaccaagggtcgagatacgaaacgactcgtggactgcacatcgtgtcttcactctccnctac

SEQ ID NO: 319674 - DNA, 499 bp, Homo sapiens
  misc_feature: GZ8MTXP02IIJ6D.51.41.D08.1.454.CMB.2.raw
  modified_base (260)..(260): a, c, t, g, unknown or other
  misc_feature (260)..(260): n is a, c, g, or t
tcagcgatcgtatacacgaccggtgctcgatttagtcacgcgagaaagggaaaggggtggggcacttctccctctaacactctccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaatggtatcagcagaaaccaggaaancccctaaatcctgatctatgctgcatccagtttgacaaagtgaggtcccatccaggttcagtggcagtgatctgggacagatttcactctcaccatcagtagtctgcaactgaagtattttgactaacttactactagtacaaacagtagttacggtaccctgctactacgtttcggcggtaggacaaggtgagatacaaagactgtggctgcacatctgtcttcactccttccgctac

SEQ ID NO: 319675 - DNA, 545 bp, Homo sapiens
  misc_feature: GZ8MTXP02JBDOM.51.41.D08.1.454.CMB.2.raw
  modified_base (262)..(262): a, c, t, g, unknown or other
  misc_feature (262)..(262): n is a, c, g, or t
tcagcgatcgtatacacgaccggtgctcgatttagtcacgcgagaaagggaaaggggtgggggcacttctccctctaacactctcccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaatggtatcagcagaaaccagggaaacncccctaaatcctgatctatgctgcatccagttgacaaagtgagtcccatccagttcagtggcagtgatcgtagggacagtatttcactctcaccatcagtagtctgacaacctgaagtattttgactaaacttactactagtactaaacagtacgttaccggtaccctgacctactacgtttcgggacgggtagggacctaagggtggaagacgtacgaaaacggtacgtggtacggactgaccaacctattctacgttcttacacttccgttcccgactacg

SEQ ID NO: 319676 - DNA, 556 bp, Homo sapiens
  misc_feature: GZ8MTXP02HDMJH.51.41.D08.1.454.CMB.2.raw
  modified_base (265)..(265): a, c, t, g, unknown or other
  misc_feature (265)..(265): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcaccatcacttgccgggcaagtcagagcattagcagcttatttaaattggtatcagcagaaaccagggaaacncccctaaactcctgatctatgctgcatccagtttgacaaagtgacgtcccatccaggttcagtgcagtgatcgtgggacagtatttcacttctacaccatcagttacgtctgacctaactgaagtattttgacctaaactttactactagtaccaaacgtaggttacgttaccggtaccctgtccttacgtacgttcgggacgggtacggacgaagggtggaagacgtacgaaaacgtacgtggtcggactcgacactatcgtcgttaccttctacgttcctcccgactac

SEQ ID NO: 319677 - DNA, 650 bp, Homo sapiens
  misc_feature: GZ8MTXP02JDR6Z.51.41.D08.1.454.CMB.2.raw
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcaccatcacttgccgggcaagtcagagctattagcagtacttaatttaagttggtatcagacaagaaaccgaagggaaaccacccctaaactcctagacttctatcgctgactactcctagtttcgaactaaaggtgacggtacccatccgtagttcagtggcaggtgatcgtagggactagtacttcactctaccactatcgagtacgtctagacctaacgtagaattatttacgaaccttaaacttactacgtacgtacaaacgtaggtacgtttaacccggtacctgtaccttaccttacgggtttaccgggacgggtaacgggaacgtaaggggtacggtaaacgtacgttaaaccggaaaacgtaccgttcgggtacggacgttacgaacccgtacctacgttccgttcgtttacctttaccctaactttccccctttcccggaacctttacg

SEQ ID NO: 319678 - DNA, 611 bp, Homo sapiens
  misc_feature: GZ8MTXP02HW7E0.51.41.D08.1.454.CMB.2.raw
  modified_base (275)..(275): a, c, t, g, unknown or other
  misc_feature (275)..(275): n is a, c, g, or t
  modified_base (375)..(375): a, c, t, g, unknown or other
  misc_feature (375)..(375): n is a, c, g, or t
  modified_base (400)..(400): a, c, t, g, unknown or other
  misc_feature (400)..(400): n is a, c, g, or t
  modified_base (411)..(411): a, c, t, g, unknown or other
  misc_feature (411)..(411): n is a, c, g, or t
  modified_base (460)..(460): a, c, t, g, unknown or other
  misc_feature (460)..(460): n is a, c, g, or t
  modified_base (563)..(563): a, c, t, g, unknown or other
  misc_feature (563)..(563): n is a, c, g, or t
tcagcgatcgtatacacgaccggtgctcgatttagtcacgcgagaaagggaaagggtggggcacttctccctctaacactctcccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaatggtatcagcagaaaccagggaaaacctaacctaactcganactactagctgtcatacctacgtttagttacgaaacgtagtaggtaccgtactactacgttacgtacgtaggtcgacgtaggtagtacgtgggaacgganagtttactacctactctaccactanacgtagtttcngtacgaaaccctagaggtaattttgttacaaccttaacttactacgtanaacaacgtaggttaacggttaccccgttagcttacacctttacggcggacggggtaccgaagttaggggagacgtactaaaacgaaacgtgttggcgttaacncgaacctacgtacgtcgttcgttctacttccttacccgtcctaacgtc

SEQ ID NO: 319679 - DNA, 570 bp, Homo sapiens
  misc_feature: GZ8MTXP02IKB9R.51.41.D08.1.454.CMB.2.raw
  modified_base (340)..(340): a, c, t, g, unknown or other
  misc_feature (340)..(340): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcaccatcacttgccgggcaagtcagagcattagcagctaatttaaattggtatcagcaagaaaccgagggaaacacccctaaactcctagatctatgctgcatccagttgacaaagtgacgtcccatccagttcagtgcagtgatcgnggacagtatttcactctcaccatcagtatctgacaactagaagttatttacgactaaactttactacttcgtacaaacgtagtacgtttaccggtacctgtaccttacgtaacggtttcgggacgggtaacgggtaaccgaagggtagaagaacgttaacgaaaacgtacgtgacggtctcgacctacctattcccgtagttaccttctacgttcccttacccgactacg

SEQ ID NO: 319680 - DNA, 605 bp, Homo sapiens
  misc_feature: GZ8MTXP02FVGE6.51.41.D08.1.454.CMB.2.raw
  modified_base (269)..(269): a, c, t, g, unknown or other
  misc_feature (269)..(269): n is a, c, g, or t
  modified_base (305)..(305): a, c, t, g, unknown or other
  misc_feature (305)..(305): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcaccatcacttggccgggcaagtcagagcattagcagtcttaatttaaattggtatcagcaagaaaccagggaaacncccctaaactcctgatctatgctgcatcctagtttnacaaagtgacggtcccatcgtaggttcagtggcaggtgatcgtaggacagtatttcactctacacctatacagtacgtctgaccaacgtagaacgttatttcgaaccttaaactttactactacgtacaaacgtacggttaacgtttacccggtacctgtaccgttacgttaaccggtttcggggacgggaacgggtaaccgaaggggtaggaacgtaacgtaaaccgaaaacgtacgttcggtacggctacgacctacctagttccgttagttcctactacttcccgttcccacttacg

SEQ ID NO: 319681 - DNA, 551 bp, Homo sapiens
  misc_feature: GZ8MTXP02JGTVO.51.41.D08.1.454.CMB.2.raw
  modified_base (263)..(263): a, c, t, g, unknown or other
  misc_feature (263)..(263): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaatggtatcagcagaaaccagggaaacncccctaaatcctagatctatgctgcatccagttgacaaagtgacgtcccatccaggttcagtggcaggtgatcgtagggacagtatttcactctacaccatacagtacgtctgacaacctgtaaattattttgacctaaactttactactacgtactaaacgagttaacgttaaccggtaccctggtcctacgtacgtttcgggacggtaagggaccgtaagggtggaatacgtacgaaaacgtactggtcggactcgacacatcgtgtactcactcctaccgctacg

SEQ ID NO: 319682 - DNA, 569 bp, Homo sapiens
  misc_feature: GZ8MTXP02HHEF0.51.41.D08.1.454.CMB.2.raw
  modified_base (263)..(263): a, c, t, g, unknown or other
  misc_feature (263)..(263): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaatggtatcagcaagaaaccaggaaacncccctaaatcctgatctatgctgcactagttgtcaagtagacgtccactacgtacgttacgagtggcgagtggtagtcgtggagtagtattctctcttcaccactacacgtagtactcgactaaacctagtaagtatttgactaacttactactgtacaacgtagtacgtttaccggtacctcgtactacgtacgttacggtacgggaggtaaccgaggtaggaggaaactacgtaaaacgacggttgtacggacgttcgactacctagtcgttcgtacttcgtactccttaccccgactactccg

SEQ ID NO: 319683 - DNA, 596 bp, Homo sapiens
  misc_feature: GZ8MTXP02I7GC6.51.41.D08.1.454.CMB.2.raw
  modified_base (260)..(260): a, c, t, g, unknown or other
  misc_feature (260)..(260): n is a, c, g, or t
  modified_base (269)..(269): a, c, t, g, unknown or other
  misc_feature (269)..(269): n is a, c, g, or t
  modified_base (383)..(383): a, c, t, g, unknown or other
  misc_feature (383)..(383): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaatggtatcagcagaaacaggaaancccctaaancctgatctatgctgcatccagtttgacaaagtgaggtcccatccaggttcagtggcagtggatcgtgggacagatttcactctcaccatcagtagtctgacaaacctgaaagtnttttgacctaaactttctaactgtacaaactagtaacgttaccggttaccctgacctacgtaacctttcggggacggaacggggacctaaagggttaggaacgtaattaaccgaaaaacggaaaccgttggttaacggggaccttggaaccctaacccgtattaaccttacggttcctttacgtaactttcccctttaccccggctaaaccgg

SEQ ID NO: 319684 - DNA, 516 bp, Homo sapiens
  misc_feature: GZ8MTXP02JLIYH.51.41.D08.1.454.CMB.2.raw
  modified_base (371)..(371): a, c, t, g, unknown or other
  misc_feature (371)..(371): n is a, c, g, or t
  modified_base (499)..(499): a, c, t, g, unknown or other
  misc_feature (499)..(499): n is a, c, g, or t
tcagcgatcgtatacacgaccggtgctcgatttagtcacgcgagaaagggaaagggtggggcacttctccctctaacactctcccgctcagctcctgggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaaactcctgatctatgctgcatccagtttgcaaagtgaggtcccatccaggttcagtggcagtgatctggggacagatttcactctcacatcagtgtctgctaaccngtaagattttgctaactttactactgtacaacagaggtttacgtaccctgtctcacgttcggcggacgggacaaggtggaagatacaaaggacctgacggctacgtcacgtaactcttggtaccttcncttacctccccgtcacg

SEQ ID NO: 319685 - DNA, 591 bp, Homo sapiens
  misc_feature: GZ8MTXP02F77CH.51.41.D08.1.454.CMB.2.raw
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaacgcccctaaatcctgatctatgctgcatccagtttgacaaagtgaggtcccatccgagttcagtggcagtgatcgtgggacagtatttcactctcacatcagtgtctgacaacctgaagtatttgactaacttactactagtacaaacgagtacgttacgtacctgtacttacgtacgtttcgggacggtacgggaaccgtaagggttggaacgtaacgttaaccgaaaaccggtaaccgttggttacgggaccttacggacctaaccctaacgttccgttacggttacctttaccgtacctttccccgtttacccccggactttaccg

SEQ ID NO: 319686 - DNA, 605 bp, Homo sapiens
  misc_feature: GZ8MTXP02HNZES.51.41.D08.1.454.CMB.2.raw
  modified_base (358)..(358): a, c, t, g, unknown or other
  misc_feature (358)..(358): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcaccatcacttgccgggcaagtcagagcattagcagcttaatttaaattggtatcagcaagaaaccaggaaacacccctaaatcctgatctatgctgcatccagttgacaaagtgagtcccatccaggttcagtgcagtggatcgtgggactagtatttcacttcncacctatacagttagtctgacctaacgtagtaagtatttttagaccttaacttacttactagtactaaacgtagtaacgtttacccggttacccttgtaccttacgttaaccggtttccggggacgggtaacggggtaaccgaaggggttagggaagtaacgtaaccgaaaacggtaacgtggtacggacttacggacctacctaattcgttcgttacctttacacgtttcccttcccggtcttacg

SEQ ID NO: 319687 - DNA, 558 bp, Homo sapiens
  misc_feature: GZ8MTXP02IIS0N.51.41.D08.1.454.CMB.2.raw
  modified_base (262)..(262): a, c, t, g, unknown or other
  misc_feature (262)..(262): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcaccatcacttgccgggcaagtcagagcattagcagcttatttaaatggtatcagcagaaacaggaaacncccctaaatctgatctatgctgcatccagtttgacaaagtgacggtcccatccaggttcagtggcagtgatcgtgggacagtatttcactctaccacctatcagtatctgactaactgaaagttattttagaccttaaacttactactgtacaaacgtagtaacgtttaccggtaccctgtccttacgtaccgtttcgggacgggtacgggaaccgtaagggtacggaagaactaacgaaacgtaacgtggtagcgtcgacctacattcgtacgtcttacacttccttcccgctac

SEQ ID NO: 319688 - DNA, 510 bp, Homo sapiens
  misc_feature: GZ8MTXP02G715P.51.41.D08.1.454.CMB.2.raw
  modified_base (480)..(480): a, c, t, g, unknown or other
  misc_feature (480)..(480): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcaccatcacttgccgggcaagtcagagcattagcagcttaatttaaattggtatcagcaagaaaccaggaaacgcccctaaactcctagatctatgctgcatccagttgacaaagtgagtcccatccaggttcagtgcagtggatcgtgggacagtatttcactctacaccatcagtagtctgactaacctgaagtatttgactaacttactactgtacaaacgtagtacgttaccggtacctgctacacgtttcggacggaggacaaggtgagatacaaacgactgngctgaccacatctgtctacatcctccacta

SEQ ID NO: 319689 - DNA, 522 bp, Homo sapiens
  misc_feature: GZ8MTXP02H8W2D.51.41.D08.1.454.CMB.2.raw
  modified_base (261)..(261): a, c, t, g, unknown or other
  misc_feature (261)..(261): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaatggtatcagcagaaaccaggaaancccctaaatcctgatctatgctgcatccagtttgacaaagtgaggtcccatccaggttcagtgcagtgatcgtgggacagatttcactctacaccatcagtagtctgcaactgaagtattttgactaactttactactgtacaaactagtaagttacggtaccctgtccttactacgtttcgggcgggtagggaccgaagggtggagatacaaaacgactggtacggctcgacaccatctgtcttcactccttcccgctac

SEQ ID NO: 319690 - DNA, 577 bp, Homo sapiens
  misc_feature: GZ8MTXP02H5ARL.51.41.D08.1.454.CMB.2.raw
  modified_base (211)..(211): a, c, t, g, unknown or other
  misc_feature (211)..(211): n is a, c, g, or t
  modified_base (362)..(362): a, c, t, g, unknown or other
  misc_feature (362)..(362): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcaccatcacttggccgggnaagtcagagcattagcagctatttaaatggtatcagcaagaaaccaggaaacacccctaaactcctagatctatgctgcatcctagtttgacaaagtgacggtcccatccaggttcagtggcagtgatcgtagggacagtatttcacttcncacatcatagtctgactaacgtagaacgtattttagactaactttacaacttgtacaaacgtagtacgttacggtacctagcttacgtacgttcgggacggtaacgggaaccgtaaagggtgaaagtaacgtaacgaaaacggtaacgtggtacgggactacggacctaacctacttcgttcgttacttctaaccgttcccttacccgacctacg

SEQ ID NO: 319691 - DNA, 567 bp, Homo sapiens
  misc_feature: GZ8MTXP02GHEB4.51.41.D08.1.454.CMB.2.raw
  modified_base (266)..(266): a, c, t, g, unknown or other
  misc_feature (266)..(266): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcaccatcacttgccgggcaagtcagagcattagcagcttaatttaaattggtatcagcagaaaccagggaaacncccctaaactcctgatctatgctgcatccagtttgactaaaagtgacggtcccatccaggttcagtggcagtggatcgtgggacagtatttcactctacaccatcagttatctgacctaactagaacgtattttagaccttaacttaactactacgtacaaacgtagtaacgttacggtaccctgtaccttacgtaccgtttcgggacggtacgggaaccgtaagggtacggagtaactaacgaaacgtaacgtgtacggctacgaccacctatctacgtcttacacttccttcccactac

SEQ ID NO: 319692 - DNA, 645 bp, Homo sapiens
  misc_feature: GZ8MTXP02H72WW.51.41.D08.1.454.CMB.2.raw
  modified_base (185)..(185): a, c, t, g, unknown or other
  misc_feature (185)..(185): n is a, c, g, or t
  modified_base (346)..(346): a, c, t, g, unknown or other
  misc_feature (346)..(346): n is a, c, g, or t
  modified_base (348)..(348): a, c, t, g, unknown or other
  misc_feature (348)..(348): n is a, c, g, or t
tcagcgatcgtatacacgaccggtgctcgatttagtcacgcgagaaagggaaaggggtgggggcacttctccctctaacactcctccccgctcagctcctggggctcctgctactctggctccgaggtgccagatgtgacatccagatgacccagtctccatcctcctgtctgcatctgtagganacagagtcaccatcacttggccgggacaagtcagagcaattagcagtacttaattttaaagttggtaatcgaagacaaagaaaccgagggaaaaccgacccctaaaactcctgaatctatgctgcatctagttgacaagtgacgtccatcgagtcagtgcngngatcgaggactagtatttcacttcaccacctatacgaagtactctgacctaactgtaaagtatttttacgaacttaaactttaactacgttacgtaacaaacgtaaggttaaccgtttaaccggttacccctgtaccttaccgtaccggtttacgggacggggtaacgggtaaccgtaaaggggttacgaaacggtaacgttaaaccgaaaaacggttcgtagggtacgtaccgttaccgactaccccgtaattccgttacgttaaccgttctaccctttcccgtaaccctctaacg

SEQ ID NO: 319693 - DNA, 620 bp, Homo sapiens
  misc_feature: GZ8MTXP02JGT8B.51.41.D08.1.454.CMB.2.raw
  modified_base (261)..(261): a, c, t, g, unknown or other
  misc_feature (261)..(261): n is a, c, g, or t
tcagcgatcgtatacacgaccggtgctcgatttagtcacgcgagaaagggaaaggggtggggcacttctccctctaacactctccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaatggtatcagcagaaaccagggaaancccctaaatcctgatctatgctgcatccagtttgacaaagtgaggtcccatccaggttcagtggcagtgatctggggacagatttcactctcaccatcagtagtctagccaaacctgaacgtatttttcgactaaactttactactagtaccaaacgtaggtaacgttaaccggtaccctggtccttacctaacgtttcgggacgggtaaggggaacccgtaaggggttaggaacgaacgttaaccgaaaaacggtaacgttcgggtacgggtacgttacgggtaacccaaccgtaacttaaccgttacggtttccctttaccgtaactttcccccgtttaccccggaccctttaaacg

SEQ ID NO: 319694 - DNA, 586 bp, Homo sapiens
  misc_feature: GZ8MTXP02H32XJ.51.41.D08.1.454.CMB.2.raw
  modified_base (210)..(210): a, c, t, g, unknown or other
  misc_feature (210)..(210): n is a, c, g, or t
  modified_base (266)..(266): a, c, t, g, unknown or other
  misc_feature (266)..(266): n is a, c, g, or t
  modified_base (301)..(301): a, c, t, g, unknown or other
  misc_feature (301)..(301): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccatatgacccagtctccatcctccctgtctgcatctgtaggagacagagtcaccatcacttgccgggnaagtcagagcattagcagctaattttaaatggtatcagcaagaaaccagggaaacncccctaaactcctgatctatgctgcatcctagttnacaaagtggacgtcccatccgaggttcaggtggcaggtggatcgtaggggactaggtatttcacttctacacctatcaagttacgtctacgacaacctagaagtattttagactaacttactactagtacaaacgtagtacgttacgtacctgctcgtacgttcgggacggtacgggacgtaagggtagagtaactaacgaaaacgtacgtggtacggtactacggacctaaccgtacgttaacgtcgtttaccttcctaccgtttcccgtttacccgtactacg

SEQ ID NO: 319695 - DNA, 576 bp, Homo sapiens
  misc_feature: GZ8MTXP02G9HOU.51.41.D08.1.454.CMB.2.raw
  modified_base (271)..(271): a, c, t, g, unknown or other
  misc_feature (271)..(271): n is a, c, g, or t
  modified_base (538)..(538): a, c, t, g, unknown or other
  misc_feature (538)..(538): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcaccatcacttggccgggacaagtcagagcattagcagtcttaatttaaattggtatcagacaagaaaccagggaaacncccctaaatcctagatctatcgctgcatcctagtttgacaaagtgacgtcccatccaggttcagtggcagtgatcgtaggactagtatttcactctccactatcagtagtctagactaacgtgaagttattttacgacctaacttactactacgtactaaactaggtacgttacccgtacctgtacctacgtacgttcgggacggtagggaaccgagggtacgaagtactaacgaaacggtacgtggtacgactacgtacaaccgtnttcgttcttaccttcacgtttccctacccgtacttacg

SEQ ID NO: 319696 - DNA, 596 bp, Homo sapiens
  misc_feature: GZ8MTXP02GZON5.51.41.D08.1.454.CMB.2.raw
  modified_base (269)..(269): a, c, t, g, unknown or other
  misc_feature (269)..(269): n is a, c, g, or t
  modified_base (374)..(374): a, c, t, g, unknown or other
  misc_feature (374)..(374): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcaccatcacttgccgggcaagtcagagcattagcagtcttaatttaaattggtatcagcaagaaaccgagggaaacncccctaaactcctagatctatgctgcatcctagtttcgactaaagtcgacggtacccatccgaggttcagtggacagtggatcgtagggacagtatttcacttcncaccatcagtagtctgacaactagaagtatttagactaacttactactgtacaaacgtacgtaagttaccggtacctcgtactacgtacgtttacgggacggggtaaggaaccggtaagggtaggtaagaactaaaccgtaaaacggtaaacgttcggtacggtacgtcgacctaccgtaacttcgttcgttcctttacacctttccctttaccccgctaac

SEQ ID NO: 319697 - DNA, 608 bp, Homo sapiens
  misc_feature: GZ8MTXP02G19CB.51.41.D08.1.454.CMB.2.raw
  modified_base (271)..(271): a, c, t, g, unknown or other
  misc_feature (271)..(271): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctcctgtctgcatctgtaggagacagagtcaccatcacttggccgggcaagtcagagcattagcagcttaatttaaattggtatcagacaagaaaaccaaggggaaacncccctaaactcctgatctatgactgacatcctagtttgacaaaagtcgaacggtcccataccgaggttcagtcggcaggtggatcggtaggacagttacttcactctactaaccatacgtagttacgtctacgaacctaacgtagtaaagtttattttacaaccttaaacttacctatacgtacaaacgtagttaacgtttaacccgtactcgtactacgttaccggtcgggacgggaaacggtaaccgaggggagacgtaacgtaaccgtaaaactacgttcggcggactacggacctacctatcgttacgttcctactacttcccaccgtctacg

SEQ ID NO: 319698 - DNA, 625 bp, Homo sapiens
  misc_feature: GZ8MTXP02JHKKA.51.41.D08.1.454.CMB.2.raw
  modified_base (270)..(270): a, c, t, g, unknown or other
  misc_feature (270)..(270): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcaccatcacttgccgggcaagtcagagcattagcagacttaatttaaagttggtatcagacaagaaaccgagggaacncccctaaatcctagatctatgctgcatccgtagttgactaaagtggacgtccctatccgtaggttcaggtcggcgaggtggatcggtagggactagtactttcactctacacctatctagttactctagacctaacgtagtaagttagtttcgaccttaaactttctatcgtaactaaacgtaggttaccggttacccggtaccctagtccgttacgttacgggtttccggggacgggtaacgggtaacgaggggttacgacgtaacgttaaccgaaaacgtccgtaggtacgacgttacgacccttacgttagtttccgtacttaccactttcccgtacccgtactacgtttcg

SEQ ID NO: 319699 - DNA, 660 bp, Homo sapiens
  misc_feature: GZ8MTXP02HKKIU.51.41.D08.1.454.CMB.2.raw
  modified_base (185)..(185): a, c, t, g, unknown or other
  misc_feature (185)..(185): n is a, c, g, or t
  modified_base (210)..(210): a, c, t, g, unknown or other
  misc_feature (210)..(210): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtagganacagatcaccatcacttggccgggnaagtcagagctattagcagtacttaatttaaagttggtaatcaagacaaaggaaaccgaagggaaacctacccctaaacgtcctagacttctaagtcgcctgacctattaccgtagtttacgaactaaaggtcggaacgttcccagtccgtagttcgaggtggctaggtagatcggtaggactagttactttccacttcaccactatcgaagttctactgaccctaacgtagtaatttctttacgaccttaacttactactacgtaactaaacgtacgttaacggtttacccgtacctgtaccttaccggttaaccgttcgggggacgggtaacggaacggtaagggtacgaactaacgtaacgaaaaccggtgtacgggtcggtaactcgaccttaaccgttcgttaacgtctttaccttaccgtccctttacccgtacccgtactacg

SEQ ID NO: 319700 - DNA, 591 bp, Homo sapiens
  misc_feature: GZ8MTXP02F7BHU.51.41.D08.1.454.CMB.2.raw
  modified_base (370)..(370): a, c, t, g, unknown or other
  misc_feature (370)..(370): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcaccatcacttgccgggcaagtcagagcattagcagcttaatttaaatggtatcagcaagaaaccaggaaacacccctaaactcctagatctatgctgcatccagtttgactaaagtgacggtcccatccgaggttcagtggcaggtggatcgtgggacagtatttcactctacaccntacagtagtctgacctaacgtagaagttattttacgaccttaaacttactactagtacaaacgtagtacggttaccggtacctgaccttacgtaccgtttcgggacgggtaacggtaccgtaagggtacggaagtaacgtaacgaaaacgtacgttaggtcggactacgacctacgtagttccgttacgttccttcgtactttcccgttacccgaccttac

SEQ ID NO: 319701 - DNA, 589 bp, Homo sapiens
  misc_feature: GZ8MTXP02IB9VY.51.41.D08.1.454.CMB.2.raw
  modified_base (185)..(185): a, c, t, g, unknown or other
  misc_feature (185)..(185): n is a, c, g, or t
  modified_base (214)..(214): a, c, t, g, unknown or other
  misc_feature (214)..(214): n is a, c, g, or t
  modified_base (421)..(421): a, c, t, g, unknown or other
  misc_feature (421)..(421): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtagganacagagtccacatctacttcggccggganaagtcagagctattagcagtacttaattttaaattggtatcagacaaacggaaaccgagggaaaccacccctaaatcctagactctatgctgctatctagttgactaaggtcgacgtccctatccgaggttcagtgctagtgatcggtaggatagttcttcacttcaccacgtatcgattacgtctacgaactacgtagtaacgttntttacgaacttaacttactacgtgtaaacaacgtagttacgttacgtacctgtacctacgtacggttcgggaggtacggtaacgagggtagaacgtaataacgaaaacgtgtcgtacggtctacgacctactgtaacgttcttactactaccgttcccgtcctactcg

SEQ ID NO: 319702 - DNA, 595 bp, Homo sapiens
  misc_feature: GZ8MTXP02GNFHT.51.41.D08.1.454.CMB.2.raw
  modified_base (386)..(386): a, c, t, g, unknown or other
  misc_feature (386)..(386): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctcctgtctgcatctgtaggagacagagtcaccatcacttgccggcaagtcagagcattagcagcttaatttaaatggtatcagcagaaacaggaaacgcccctaaatcctagatctatgctgcatccagtttgacaaagtgacgtcccatcagttcagtgcagtgatcgtaggacagtatttcactctcaccatcagttagtctgacaactgaagtattttanactaaacttactactagtactaaacgtagtaacgttaccggtaacctgtaccttacgtaaccgtttcgggacgggtaacggggaaccctaagggttacggaagaacgtaaccgaaaaaccggtaaacttcgggttaggaccttacggacccaacgtaacgtcgttacgttacctttaccacgtttacccgtttcccccgactttaaccg

SEQ ID NO: 319703 - DNA, 578 bp, Homo sapiens
  misc_feature: GZ8MTXP02JPFHR.51.41.D08.1.454.CMB.2.raw
  modified_base (378)..(378): a, c, t, g, unknown or other
  misc_feature (378)..(378): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcaccatcacttgccgggcaagtcagagcattagcagcttatttaaattggtatcagcaagaaaccagggaaacgacccctaaactcctgatctatgctgcatcctagtttagtaaaagtgagtcccatccaggttcagtgcagtggatcgtaggacagtatttcactctacacctatcagtagtcngacaactagaagtattttgactaacttactactgtacaagagtagttaccggtacctgactcgtacgtttcgggacggtagggaacgaagggtggaaagactaacgaaaacgtaacgtggtacggtacgtacgaccgtaaccctagtacttcggttcctttaacctaacgttacccgtttccccgaccttaacgtttccg

SEQ ID NO: 319704 - DNA, 575 bp, Homo sapiens
  misc_feature: GZ8MTXP02JMMFY.51.41.D08.1.454.CMB.2.raw
  modified_base (268)..(268): a, c, t, g, unknown or other
  misc_feature (268)..(268): n is a, c, g, or t
  modified_base (538)..(538): a, c, t, g, unknown or other
  misc_feature (538)..(538): n is a, c, g, or t
tcagcgatcgtatacacgaccggtgctcgatttagtcacgcgagaaagggaaaggggtgggggcacttctccctctaacactctcccgctcagctcctggggctcctgctactctggctccgaggtgccagatgtgacatccagatgacccagtctccatcctccctgtctgcatctgtaggagacagagtcaccatcacttggccgggcaagtcagagcaattagcagcttaatttaaattggtatcagacagaaaccagggaaacncccctaaactcctgatctatgctgcatccagttgacaagtgagtcccatccgaggttcagtggctagtggatcgtgggacagtattcactctcactagtcagtgtctgacaaacgtgaaagttattttcgactaaactttactacgtgtaacaaacgtaggttaacgttaccggtacctagtccgttaccgttacggtttccggggacgggtaacgggaaccgtaaggggtagaacgtaacgtaacgaaaacgtacggtgtacgggtacncgacactatcgtacgtcttacgacttcctccgactcg

SEQ ID NO: 319705 - DNA, 617 bp, Homo sapiens
  misc_feature: GZ8MTXP02G0GGI.51.41.D08.1.454.CMB.2.raw
  modified_base (345)..(345): a, c, t, g, unknown or other
  misc_feature (345)..(345): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcaccatcacttgccgggcaagtcagagcattagcagcttaatttaaattggtatcagcaagaaaccagggaaacgcccctaaaactcctagatctatgctgcatccagtttgacaaagtgacggtcccatccagttcagtggcagtggatcgngggacagtatttcactctacaccatcagtagtctgacaactagaattattttgtaaacctttactactagtaccaaactaggtacgtttaaccgtacccgttgccttacgtacgtttcggggacggtaacgggtaccgaagggttacggaagtacgtaacgtaaaacgtacgttcggtacgggtaccttacggacctaaacccgttactttaccgttccgtttacccttaccgttaccgtttccccgttacccccgtaccgttacgttaccg

SEQ ID NO: 319706 - DNA, 566 bp, Homo sapiens
  misc_feature: GZ8MTXP02I1LE6.51.41.D08.1.454.CMB.2.raw
  modified_base (185)..(185): a, c, t, g, unknown or other
  misc_feature (185)..(185): n is a, c, g, or t
  modified_base (210)..(210): a, c, t, g, unknown or other
  misc_feature (210)..(210): n is a, c, g, or t
  modified_base (263)..(263): a, c, t, g, unknown or other
  misc_feature (263)..(263): n is a, c, g, or t
  modified_base (357)..(357): a, c, t, g, unknown or other
  misc_feature (357)..(357): n is a, c, g, or t
  modified_base (520)..(520): a, c, t, g, unknown or other
  misc_feature (520)..(520): n is a, c, g, or t
  modified_base (549)..(549): a, c, t, g, unknown or other
  misc_feature (549)..(549): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtagganacagagtcaccatcacttgccgggnaagtcagagcattagcagtctatttaatggtatcagcagaaaccagggaaacncccctaaactcctagatctatgctgcatcagttgcaagtgagtcccatccaggttcagtgcagtgatcgtggacagtattcactctacaccgtntcgagttagtctgacctaacgtagaaagttattttggacctaaactttaactacttagtacaaacgtaggttaacggttacccggttaccctggtcccttacgtaccgtttcgggacgggtaacgggaccgtagggtggaatacgtaacgaaacgtaatcggngactacgccaactgtcgttacgtcttacncgttccctcctacctac

SEQ ID NO: 319707 - DNA, 614 bp, Homo sapiens
  misc_feature: GZ8MTXP02FXQHR.51.41.D08.1.454.CMB.2.raw
  modified_base (268)..(268): a, c, t, g, unknown or other
  misc_feature (268)..(268): n is a, c, g, or t
  modified_base (277)..(277): a, c, t, g, unknown or other
  misc_feature (277)..(277): n is a, c, g, or t
  modified_base (303)..(303): a, c, t, g, unknown or other
  misc_feature (303)..(303): n is a, c, g, or t
  modified_base (336)..(336): a, c, t, g, unknown or other
  misc_feature (336)..(336): n is a, c, g, or t
  modified_base (338)..(338): a, c, t, g, unknown or other
  misc_feature (338)..(338): n is a, c, g, or t
  modified_base (360)..(360): a, c, t, g, unknown or other
  misc_feature (360)..(360): n is a, c, g, or t
  modified_base (368)..(368): a, c, t, g, unknown or other
  misc_feature (368)..(368): n is a, c, g, or t
  modified_base (373)..(373): a, c, t, g, unknown or other
  misc_feature (373)..(373): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatccctccctgtctgcatctgtaggagacagagtcaccatcacttgccgggcaagtcagagcattagcagcttatttaaattggtaatcagacagaaaccagggaaacncccctaaanctagatactatgctgacatctagttnacaaagtgacgtccatcgtagtcagtgcagtgntntggacagtacttcactcacacntacagtancgtanacaactgtaattatttacgaccttaaaactttaccgtactagtacctaaacgttaggtaaaccgtttacgggtacccctagtcccgttaccgttaaacccggtttcggggacgggtaacggggtaaacctaaggggttaggaacgaacgttaaacggaaaaccggtaacgtggttacgggaccgttacgaccacttactaacgtacgttccttacctacgtttccccgtaacccgactacg

SEQ ID NO: 319708 - DNA, 603 bp, Homo sapiens
  misc_feature: GZ8MTXP02JHMFM.51.41.D08.1.454.CMB.2.raw
  modified_base (210)..(210): a, c, t, g, unknown or other
  misc_feature (210)..(210): n is a, c, g, or t
  modified_base (554)..(554): a, c, t, g, unknown or other
  misc_feature (554)..(554): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcaccatcacttgccgggnaagtcagagcattagcagtcttaatttaaattggtatcagacaagaaaccgaagggaaacacccctaaatcctagactctatgctgcatcctagttgacaaagtgacgtcccatccgaggttcagtgcagtgactcgaggactagtattcactctacactatcagtagtctagactaactagtaaagttacttttacacttaaaactttacttacgtacgtaactaaacgtaggttaacggttaacccggttacctcggtaccttaccgtaacgtttcggggacgggtaagggtaaccgagggttacggaataacgtaacgaaaacggtactgggtacggtacncgaacctacctattcgttcgtaccttactacgttcccttccgacttacg

SEQ ID NO: 319709 - DNA, 868 bp, Homo sapiens
  misc_feature: GZ8MTXP02IO9J3.51.41.D08.1.454.CMB.2.raw
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcaccatcacttgccgggacaagtcaagagcattagcagtacttaattttaaagtggtatcagacaaggaaaccgaagggaaacacccctaaactcctagacttactaatgactgacctacttaccgtaggttttacgaacctaaaaggtcggtaaaccggttacccctaagttacccgtaaagggtttaccgtaaagggtcgggtacgtaaggggttacggggtaactttaccgggtagggggtaaaaccctaaggtttaactttttaccctaaccctttaccttaacccgaaaccccttaagttaccgtaaagtttaacgggttcctttacggaaacccttaaaacccgttaagggtaaaaggtttaacttttttacgaaaccctttaaaacctttaaccttaaaccttacgttacccaaaaagttaacgggttaaccggttttaaaacccggttcccgttaacgtcccttaaccgtttaaaccgggttttccgggggaaacgggtaaacgggggaacccgtaaaagggggttacgggtaaaacgtaaaccgttaaaaccgaaaaacgggtaccgtttaggaaacggggtcttaaccggaccttaaaacccgttacgtttaaccgttacggttaccctttaccgtacccgtttccccgttaccccggtaactaac

SEQ ID NO: 319710 - DNA, 653 bp, Homo sapiens
  misc_feature: GZ8MTXP02GNF6G.51.41.D08.1.454.CMB.2.raw
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcaagaaaccagggaaacacccctaaactcctagatctatgctgcatcctagttgacaaaagtgacggtcccatccgtaggttcagtggcagtgactgtagggactagtatttcactctacaccatcagttacgtctgactaaccgtagtaacgtattttagacctaaactttactaactacgtaccaaacgtaagtacgtttaaccggttaaccctcgtaccttaccgtaaccgttttacggggaccgggtaaacggggaaccgtaaaggggttaggaaacgtaacgtaacgtaaaaaccggtaaaccgttacggtacgggtaccgttacggacccgtaaaccctagttaaccgttacggttactttacccttaaccgttcccctttaccccggtaccttaaaccg

SEQ ID NO: 319711 - DNA, 601 bp, Homo sapiens
  misc_feature: GZ8MTXP02H0JZA.51.41.D08.1.454.CMB.2.raw
  modified_base (209)..(209): a, c, t, g, unknown or other
  misc_feature (209)..(209): n is a, c, g, or t
  modified_base (264)..(264): a, c, t, g, unknown or other
  misc_feature (264)..(264): n is a, c, g, or t
  modified_base (273)..(273): a, c, t, g, unknown or other
  misc_feature (273)..(273): n is a, c, g, or t
  modified_base (334)..(334): a, c, t, g, unknown or other
  misc_feature (334)..(334): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcacatcacttgccgggnaagtcagagcattagcagtcttaatttaaatggtatcagcaagaaacaggaaacncccctaaanctgatctatgctgcatcagttgacaaagtgacgtcccatccgagtcagtgctagtgatcgnggactagtacttcactctaccactatcgagttacgtctacgactaaaccgtagaagttacgtttttacgaaccttaactttaactacgtacgtaacaaacgtacgttaacgtttaccgtacctgacttacgtacgttcgggacggtaacggaccgtaagggtagaacgtaacgtaacgaaaacgtaacgtggtacggaccttacggaaccctactacgttccgttacgttacctttacgtacctttcccggttacccctacgttacg

SEQ ID NO: 319712 - DNA, 526 bp, Homo sapiens
  misc_feature: GZ8MTXP02GD0K1.51.41.D08.1.454.CMB.2.raw
  modified_base (265)..(265): a, c, t, g, unknown or other
  misc_feature (265)..(265): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcaccatcacttgccgggcaagtcagagcattagcagctaatttaaattggtatcagcagaaaccagggaaacncccctaaatcctgatctatgctgcatccagtttgcaaagtgagtcccatccaggttcagtggcagtgatcgtgggacagtatttcactctcaccatcagtgtctgcaactgaagtatttgactaaactttactactagtacaaacgtaggtaacgttaccggtaccctggtccttactaccgtttcgggcggaagggaccaagggtggagactacaaaacgactgtaggctgccaccatctgtcttcactcctcccgctac

SEQ ID NO: 319713 - DNA, 534 bp, Homo sapiens
  misc_feature: GZ8MTXP02HUCLP.51.41.D08.1.454.CMB.2.raw
  modified_base (210)..(210): a, c, t, g, unknown or other
  misc_feature (210)..(210): n is a, c, g, or t
  modified_base (460)..(460): a, c, t, g, unknown or other
  misc_feature (460)..(460): n is a, c, g, or t
  modified_base (506)..(506): a, c, t, g, unknown or other
  misc_feature (506)..(506): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcaccatcacttgccgggnaagtcagagcattagcagctatttaaattggtatcagcaagaaaccagggaaacgcccctaaaactcctgatctatgctgcatccagtttgacaaagtgaggtcccatccaggttcagtggcagtggatcgtggggacagttatttccgacttctaccaccgtatcagttagtctgcaaccgtgaagtatttttagacctaacttactactgtacaactagtacgttacgtacctgtctctacgttcggnggacggacgaaggtgacgatacgaaacgagtcgtagctcgcaacgntcgtgtactcgtactccttcccgctacg

SEQ ID NO: 319714 - DNA, 636 bp, Homo sapiens
  misc_feature: GZ8MTXP02HFVIR.51.41.D08.1.454.CMB.2.raw
  modified_base (186)..(186): a, c, t, g, unknown or other
  misc_feature (186)..(186): n is a, c, g, or t
  modified_base (495)..(495): a, c, t, g, unknown or other
  misc_feature (495)..(495): n is a, c, g, or t
  modified_base (601)..(601): a, c, t, g, unknown or other
  misc_feature (601)..(601): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatccctccctgtctgcatctgtagganacagagtcaccatcacttggccgggacaagtcagagactagttagcaagtacttaaattttaaagttggtaatcgaagacaaacggaaaacccgaaggggaaaacctaccccctaaaactcctagacttactatcgctgactacttcctagtttcgaacgtaaaaggtcggacggttaccccagttaccgtaagggtttacaggttggacgtaggtggacttcgagggactagttactttccacttctaccaactatcgagttacgtctacgactaactagtaagttactttagacttaacttacactntaacaatagtacgttacgtctagtcctacgtacgttcgggacggtacggacgtaaggtaggaacgtaactaacgaaaacgtacgttaggcgtactcgacctaactntcgttcttacttacctacttccctacccgacttcg

SEQ ID NO: 319715 - DNA, 624 bp, Homo sapiens
  misc_feature: GZ8MTXP02FUDSK.51.41.D08.1.454.CMB.2.raw
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcaccatcacttgccgggcaagtcagagcattagcagcttatttaaatggtatcagcagaaaccaggaaacgcccctaaactcctgatctatgctgcatccagtttgactaaaagtgacggtcccatccgtaggttcagtggcagtgatcgtgggacagtatttcactctaccaccatcagttactctacgactaaacctagtaaagttatttttagaccttaaactttaactacgttacgtactaaacgtaggttaacgttaccggttaccctgtaccttacgttaccgtttcgggacgggtaacggggtaaccgaaggggtacggaacgtaacgtaacgaaaacggtacgtacgggtacggtacgtacgaccgaacccgttaatcgttacggttaccttacctacgtttcccttaccccggtaccttaacg

SEQ ID NO: 319716 - DNA, 524 bp, Homo sapiens
  misc_feature: GZ8MTXP02HSUVB.51.41.D08.1.454.CMB.2.raw
  modified_base (210)..(210): a, c, t, g, unknown or other
  misc_feature (210)..(210): n is a, c, g, or t
  modified_base (265)..(265): a, c, t, g, unknown or other
  misc_feature (265)..(265): n is a, c, g, or t
  modified_base (468)..(468): a, c, t, g, unknown or other
  misc_feature (468)..(468): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcaccatcacttgccgggnaagtcagagcattagcagctatttaaattggtatcagcaagaaaccagggaaacncccctaaactcctagatctatgctgcatccagtttgacaaagtgaggtcccatccaggttcagtggcagtggatcgtgggacagtatttccacttctcacctatcagttacgtctgcaacctgaagtattttgactaacttactactgtacaactagtagttacgtacctgtcctctacgttcggacggtacgggacgagggngagatacgaaaacgatggtcggctcgccacatcgtcgtcttcacttcctccgctac

SEQ ID NO: 319717 - DNA, 599 bp, Homo sapiens
  misc_feature: GZ8MTXP02F8PP9.51.41.D08.1.454.CMB.2.raw
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcaccatcacttgccgggcaagtcagagcaattagcagcttaatttaaattggtaatcagacaagaaaccgaagggaaacaccccctaaatcctagactctatcgctgcatcctagtttgactaaagtgacggtcccatccgtagtcagtggcagtgatcgtggactagtacttcacctctacacctatacgtagttagtctagaccaaaccgtgtaaagttattttacgactaaccttacttacgtatacaaactaggtacgtttaccgtaccctgtacctacgtacgttcgggacgggtacgggtaaccgaagggtagaagtactaacgaaaacggtagtcggtacggctacgtacctaccgtattaaccgtcttaccgttactacgttcccgttacccgctaacg

SEQ ID NO: 319718 - DNA, 568 bp, Homo sapiens
  misc_feature: GZ8MTXP02F9G4R.51.41.D08.1.454.CMB.2.raw
  modified_base (184)..(184): a, c, t, g, unknown or other
  misc_feature (184)..(184): n is a, c, g, or t
  modified_base (263)..(263): a, c, t, g, unknown or other
  misc_feature (263)..(263): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctcctgtctgcatctgtagganacagagtcaccatcacttgccgggcaagtcagagcattagcagcttattaaatggtatcagcaagaaaccgaggaaacncccctaaatcctgatctatgctgcatcctagttgacaaagtgagtcccatccaggttcagtgcagtgatcgtggacagtacttcactctacaccatcagtcgtctgacaactagtaacgttattttacacttaaacttactatacgtacaaacgtaggtaacgttacggtaccctcgtaccttactaccggttacgggacggaacgggtaaccgtaagggtaggaaagtaactaacgaaaacgtacgtaggtcggactacgaccacctatccgttcgtaccttactaccttccgtccctactacg

SEQ ID NO: 319719 - DNA, 595 bp, Homo sapiens
  misc_feature: GZ8MTXP02FZXO9.51.41.D08.1.454.CMB.2.raw
  modified_base (186)..(186): a, c, t, g, unknown or other
  misc_feature (186)..(186): n is a, c, g, or t
  modified_base (534)..(534): a, c, t, g, unknown or other
  misc_feature (534)..(534): n is a, c, g, or t
  modified_base (548)..(548): a, c, t, g, unknown or other
  misc_feature (548)..(548): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctggtagganacagagtcaccatcacttggccgggcaagtcagagcattagcagtacttaatttaaagttggtatcagacaagaaaccgagggaaacacccctaaatcctagactctatgctgacatccgtagtttagacgtaaaggtgacggtccctagtccgtaggtttcgaggtcggctagggttgacgtcgtacggggaactagttacttttccaacttcctacaaccctattactagggttacttcgtacgaccctaaacgttaggtaaactttagtttacaaccttaaactttcgtaactatacaaacgtagtacgtttaccgtcctgacttgcgttcggacgaggacaggngagataacgaaagngttagcgctcgaccactattccgtgttcctctacgttcctacctcta

SEQ ID NO: 319720 - DNA, 598 bp, Homo sapiens
  misc_feature: GZ8MTXP02GHT1X.51.41.D08.1.454.CMB.2.raw
  modified_base (376)..(376): a, c, t, g, unknown or other
  misc_feature (376)..(376): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcaccatcacttgccgggcaagtcagagcattagcagcttatttaaattggtatcagcaagaaaccaggaaacacccctaaatcctagatctatgctgcactctagtttgacaaagtgacggtcccatccgtaggttcaggtcggacagtggatcgtggggactagtactttcactctacacctntcagtctactgacctaaacgtagtaagttattttcgaaccttaaactttactacgtagtacaaacgtagtacgttaacgtacctgtacctcgtaccgttcgggacgggtaacggaaccgagggtacggaataacgtaacgtaaaacgtacgttcggaacggtcgtacgacctaaccttacttcgttacgttacttacctaccgttcccgttaccgtactacg

SEQ ID NO: 319721 - DNA, 579 bp, Homo sapiens
  misc_feature: GZ8MTXP02F23GE.51.41.D08.1.454.CMB.2.raw
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctccctgtctgcatctgtaggagacagagtcaccatcacttgccgggcaagtcagagcattagcagcttatttaaatggtatcagcagaaaccagggaaacacccctaaactcctagatctatgctgcatcctagtttgacaaagtgacggtcccatccgtaggttcagtggcagtggatgtaggacagtatttcactctacaccatcagttactctgacaactagtaattagttttagaccttaaactttactactacgtacaaacgtagtaacgtttaccggtaccctgtaccttacgtacgtttacgggacgggtacgggaacgaagggtacgaagtaacgtaaccgaaaacgtagtcggtaggctacgacctacctacgtcttacgtcttactactttcctacccgacttacg

SEQ ID NO: 319722 - DNA, 683 bp, Homo sapiens
  misc_feature: GZ8MTXP02FRA8K.51.41.D08.1.454.CMB.2.raw
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatccctcctgtctgcatctgtaggagacagagtccaccatcacgttcggccgggacaagtcagagctattagcagtacttaatttaaagtggtatcagacaagaaaccgaggaaacacccctaaatcctagatctatgctgactatcctagttgactaaaggtcgacgtacccagttaccgaggttcgaggtcgcgtaggtgagtcgtagggatagttactttcactctacactatacgagttagtccagtacctaactaggtaaatttagtttacgaactttaaactttacgtacgttaacgaaccgtaaagtaacgttaaccggttacccgttaccctaggttacccgttacgttaaccggtttcgggggaaaccggggttaaacgggaaaccggtaaagggtacgggaaaacgtaacgtaaaaccgtaaacgggttaacgttcgggacggtccctacgaaccctaccgttactttcggttccttacctttacgtaccctttacccgtacccgtcttaaccg

SEQ ID NO: 319723 - DNA, 567 bp, Homo sapiens
  misc_feature: GZ8MTXP02F3U8Y.51.41.D08.1.454.CMB.2.raw
  modified_base (267)..(267): a, c, t, g, unknown or other
  misc_feature (267)..(267): n is a, c, g, or t
  modified_base (374)..(374): a, c, t, g, unknown or other
  misc_feature (374)..(374): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatcctcctgtctgcatctgtaggagacagagtcaccatcacttgccgggcaagtcagagcattagcagcttaatttaaattggtatcagacaagaaaccagggaaacncccctaaatcctgatctatgctgcactccagtttgactaaagtcgacgtcccatccgtaggttcagtcggcagtgatcgtagggactagtctttcactctacacctntacagtactctacgactaactaggtaattagttttacacttaaacttactactacgtacaaacgtacgtacgttacccgtactagtcttacgtaccgttacgggacggacggtaacgtagggtacgagtaactaacgaaacgtacgtggtacggctacgctactatcgtgttaccttcactcctaccgtctac

SEQ ID NO: 319724 - DNA, 669 bp, Homo sapiens
  misc_feature: GZ8MTXP02FGAFK.51.41.D08.1.454.CMB.2.raw
  modified_base (429)..(429): a, c, t, g, unknown or other
  misc_feature (429)..(429): n is a, c, g, or t
tcagcgatcgtatacacgaccggtgctcgatttagtcacgcgagaaagggaaggggtgggggcacttctccctctaacactctcccgctcagctcctggggctcctgctactctggctccgaggtgccagatgtgacatccagatgacccagtctccatcctccctgtctgcatctgtagagacagagtcaccatcacttgccgggacaagtcagagcattacgcagtacttaatttaaagttggtatcaagacaagaaaccgagggaaaccacccctaaactcctagacttactatcgcttgactataccgtaagtttcgaacgtaaacggtcgtaacggtcccctaagtccggtaagggtttccaagggttcggactaggtggactcggtacgggactagtactttccactctacacctatctagtntactacgacctaaactagtaacgtattttacgaccttaaacttactactacgtacgtaaacgtacggtaacgtttacccggtaccctcgtaccgttacgttaccggttacgggggacgggtaaccgggaaccgtaaaggggtacggtaaacgaacgttaaacgaaaacggtacgtcggtacggcttacgacctaaccgtatccgttcgttaccttacctacttcccggtacccgactacg

SEQ ID NO: 319725 - DNA, 613 bp, Homo sapiens
  misc_feature: GZ8MTXP02GERCK.51.41.D08.1.454.CMB.2.raw
  modified_base (400)..(400): a, c, t, g, unknown or other
  misc_feature (400)..(400): n is a, c, g, or t
  modified_base (403)..(403): a, c, t, g, unknown or other
  misc_feature (403)..(403): n is a, c, g, or t
tcagcgatcgtatacacgaccggtgctcgatttagtcacgcgagaaagggaaaggggtgggggcacttctccctctaacactctccccgctcagctcctggggctcctgctactctggctccgaggtgccagatgtgacatccagatgacccagtctccatccctccctgtctgcatctgtaggagacagagtcaccatcacttgccgggacaagtcagagcattagcagtacttaatttaaattggtatcagacaagaaaccgaggaaacacccctaaactcctagactctatgactgaccatcctaggtttagacgtaaaggtcggacggtacccagtccgtaggttcaggtggacaggtaggatcgtaggactagtatttcactcacacatcgagtntcngacctaactagtaattatttacgaaccttaactttacctactacgaactaaacgtacggtaaccgttaccggtacctcgtacttaccgtacgttcggggacggaacgggtaacgaagggtagaagtaacgaaccgtaaaacgtagttcggtacggacttacgaccctaactacgttcgtcttactcctacttcccttacccgacttaacg

SEQ ID NO: 319726 - DNA, 622 bp, Homo sapiens
  misc_feature: GZ8MTXP02J0XDD.51.41.D08.1.454.CMB.2.raw
  modified_base (220)..(220): a, c, t, g, unknown or other
  misc_feature (220)..(220): n is a, c, g, or t
  modified_base (254)..(254): a, c, t, g, unknown or other
  misc_feature (254)..(254): n is a, c, g, or t
  modified_base (268)..(268): a, c, t, g, unknown or other
  misc_feature (268)..(268): n is a, c, g, or t
  modified_base (356)..(356): a, c, t, g, unknown or other
  misc_feature (356)..(356): n is a, c, g, or t
  modified_base (366)..(366): a, c, t, g, unknown or other
  misc_feature (366)..(366): n is a, c, g, or t
  modified_base (528)..(528): a, c, t, g, unknown or other
  misc_feature (528)..(528): n is a, c, g, or t
tcagcgatcgtatacacgaccggtgctcgatttagtcacgcgagaaagggaaagggggtgggggcacttctccctctaacactctccccgctcagctcctggggctcctgctactctggctccgaggtgccagatgtgacatccagatgacccagtctccatcctccctgtctgcatcctgtaggagacagagtcaccatcacttgccgggcaagtcagngcattagcagtcttaatttaaattggtatcagcnaaaccaggggaaanacccctaaatccctgatctatgctgcatcctagttgacaagtgacggtcccattccgaggttcaggtggcagtggatcgagggacagntttcacttcncaccatcagtagtctgcaacctgaagtactttttagaccttaaactttaacgttactagttaccaaacgtaaggttaaaccggtttaccggttaccccgttacggaccttccgtaccgttttccgggaccgggggtacggaaacccgaaagggttagggtanaaacgttaacaaaacgtaaacgttcggtcggtcttacgacccacctattcctcgtttacctttactacctttcccctttaccccgaccttaacg

SEQ ID NO: 319727 - DNA, 653 bp, Homo sapiens
  misc_feature: GZ8MTXP02FO88N.51.41.D08.1.454.CMB.2.raw
  modified_base (214)..(214): a, c, t, g, unknown or other
  misc_feature (214)..(214): n is a, c, g, or t
  modified_base (284)..(284): a, c, t, g, unknown or other
  misc_feature (284)..(284): n is a, c, g, or t
  modified_base (649)..(649): a, c, t, g, unknown or other
  misc_feature (649)..(649): n is a, c, g, or t
tcagcgatcgtatacacgaccggtgctcgatttagtcacgcgagaaagggaaagggggtgggggcacttctccctctaacactctccccgctcagctcctgggggctcctgctactctggctccgaggtgccagatgtgacatccagatgacccagtctccatcctccctgtctgcatctgtaggagacagagtcaccatcacttggccggganaagtcagagacattagcagtacttaatttaagttggtatcagacaagaaacagggaacaccctaaactcngtatactagcgctgactactaccgttagtttacgacgtaaaggtgaccggtaccctagtacccggtaggtactaggtcggactaggtgtacgtcgtaggtaacagttactttccaacttctacacctatacggtagtacgtctacgacctaaacgtagtaagtttatttacgaacttaaacctttatactactacaaacgtacggttacgttaccggtacctacgtccgttacgtacggttaccgggacgggaacgggtaacggaaggttacggaaacgtaacgtaacggtaaaacgtcgtacggttacgaccgtacgactaccgttaagttcgtacgttactaccttaccgtctttaaccccgntacg

SEQ ID NO: 319728 - DNA, 814 bp, Homo sapiens
  misc_feature: GZ8MTXP02HWV7Z.51.41.D08.1.454.CMB.2.raw
  modified_base (185)..(185): a, c, t, g, unknown or other
  misc_feature (185)..(185): n is a, c, g, or t
tcagcgatcgtatacacgaccggtgctcgatttagtcacgcgagaaagggaaaggggtgggggcacttctccctctaacactctcccgctcagctcctggggctcctgctactctggctccgaggtgccagatgtgacatccagatgacccagtctccatcctccctgtctgcatctggtagganacagagtcaccatctacgttcggccggacaagtcaagagtctaattagctagtacttaattttaaagttggtatcgagacgaacgaaaaccgaggaaaccgacccctaaactcctagatctatgctgactactcgtagtttcgaacgaaaggttcgaccggtttacccctattaccggaggtttacgaagggtcgggtcgaggttgggaccgtttcgggtacgggaccttacgttacttttcccgaaccttaccacctacccgtataccgttaaagggtaccgtcgttacgaacccgttaaccgtaagttaaacgtttacgtttttacgtaaccttaaactttacgttaaaccgttacgtaaccgtaaacggttaaaccggtttaaccgggtttaaacccgtttacccgtacgtttccgttaaccggtttacccgggtttaccgggggaacgggggttaaccggggtaaaccggtaaacggggtacggtaaacggtaaaccttaaaccggtaaaaccggttaggttcgggggtaaccgggtccttacccggaccgtaacccttacgtttaaccgttcggttaccttttaccttacccgtttaccccctttaccgtaccccgtttaaccg

SEQ ID NO: 319729 - DNA, 538 bp, Homo sapiens
  misc_feature: GZ8MTXP01A43QZ.19.67.G01.1.454.CMB.2.raw
  modified_base (381)..(381): a, c, t, g, unknown or other
  misc_feature (381)..(381): n is a, c, g, or t
tcagtactctcgtgcacgaccggtgctcgatttagagtatacatattgggtttgggggagaggagcccagcactgggattccgaggtgtttccattcggtgctcagcactgaacacagaggactcaccatggagttttggctgacctgggttttccttgctgcaatttcaggaggtgtccagtgtgaggtgcaactgggtggagactgggcggaggcttgggtccagccctggggcggtctctgagactgtcctgtgaaccctctgggggtctccgtcagcagcgactgtatgcctgggtccgccaggctccaggggaagaggccggagtgggtcgcaggtatttttatagggtgggaccgacattctacggagaactccntgggagggccgattcacatctccagagtactttctcagaacacactgtctcttacaaatgaacagcctgagggccgaggcacggccgtctattatgtgtgagttgtttattggcgattgggcttggtggacaaggatcgacgtggggccgaacgggg

SEQ ID NO: 319730 - DNA, 577 bp, Homo sapiens
  misc_feature: GZ8MTXP01CTX32.19.67.G01.1.454.CMB.2.raw
  modified_base (243)..(243): a, c, t, g, unknown or other
  misc_feature (243)..(243): n is a, c, g, or t
  modified_base (276)..(276): a, c, t, g, unknown or other
  misc_feature (276)..(276): n is a, c, g, or t
  modified_base (297)..(297): a, c, t, g, unknown or other
  misc_feature (297)..(297): n is a, c, g, or t
  modified_base (306)..(306): a, c, t, g, unknown or other
  misc_feature (306)..(306): n is a, c, g, or t
  modified_base (320)..(320): a, c, t, g, unknown or other
  misc_feature (320)..(320): n is a, c, g, or t
  modified_base (322)..(322): a, c, t, g, unknown or other
  misc_feature (322)..(322): n is a, c, g, or t
  modified_base (324)..(324): a, c, t, g, unknown or other
  misc_feature (324)..(324): n is a, c, g, or t
  modified_base (328)..(328): a, c, t, g, unknown or other
  misc_feature (328)..(328): n is a, c, g, or t
  modified_base (335)..(335): a, c, t, g, unknown or other
  misc_feature (335)..(335): n is a, c, g, or t
  modified_base (339)..(339): a, c, t, g, unknown or other
  misc_feature (339)..(339): n is a, c, g, or t
  modified_base (572)..(572): a, c, t, g, unknown or other
  misc_feature (572)..(572): n is a, c, g, or t
  modified_base (574)..(574): a, c, t, g, unknown or other
  misc_feature (574)..(574): n is a, c, g, or t
  modified_base (576)..(576): a, c, t, g, unknown or other
  misc_feature (576)..(576): n is a, c, g, or t
tcagtactctcgtgcacgaccggtgctcgatttagagtatacatattgggcttggtccagcctgggcggtctctgagactgtcctgtgaaccctctgggtctccgtcagcagcgactgtattgcctgggtccgccaggctccagggaagaggccggagtgggtcgcaggtatttttagaggtgggacgacattctacggagactccatggagggccgattcaccatctccagagactttttcncagaacacactgtctcttacaaatgaacagccngagggccaggacacggccgtntattattgngtgagtagtttagngngngtgngtgtganagancgacgcgggcgacggaccgtcgtacgaccgtcctcctcacgccaccgaccgacgacccgaccgtccgttcccgttccccgtccggccgcccgtccgccgtaccgacggacgaccgacccgtaccgacgacggacgacgaccgccggcccgtcggcgtcgccgtcgtacgaacgaccgtacctcccgacgacgacgttacgtacgcggcggcggcggaacgacggcgcgagagngngng

SEQ ID NO: 319731 - DNA, 548 bp, Homo sapiens
  misc_feature: GZ8MTXP01B0RJS.19.67.G01.1.454.CMB.2.raw
tcagtactctcgtgcacgaccggtgctcgatttagagtatacatattgggtttgggggagaggagcccagcactgggattccgaggtgtttccattcggtgctcagcactgaacacagaggactcaccatggagttttggctgacctgggttttccttgctgcaattttcaggaggtgtccagtgtgaggtgcaactggtggagactgggcggaggcttgggtccagccctggggcggtctctgagactgtcctgtgaaccctctggggtctccgtcagcagcgactgtattgcctgggtccgccaggctccaggggaagaggccggagtgggtcgcaggttatttttagtaggtgggaccgacattctacggagaactccaatgggagggccgattcaccatctccagagtactttctcagaacacactgtctcttacaaatgaaacagcctgacgggccgaggaccacgggccgtctattattgtgtgagttgtttattggcgagttgggcttggtggacaagatcgacgtggggccgtaacgggg

SEQ ID NO: 319732 - DNA, 545 bp, Homo sapiens
  misc_feature: GZ8MTXP01BMWZ1.19.67.G01.1.454.CMB.2.raw
  modified_base (499)..(499): a, c, t, g, unknown or other
  misc_feature (499)..(499): n is a, c, g, or t
  modified_base (522)..(522): a, c, t, g, unknown or other
  misc_feature (522)..(522): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttgggtccagcctggggcggtctctgagactgtcctgtgaacccctctgggggtctccgtcagcagcgactgtattgcctgggtccgccaggctccaggggagaggccgggagtggggtcgcaggttatttttagtagggtgggaccgacattctacggagaactccaatgggagggccgattcaccatctcccagagactttctctagaacacactgtctcttcaaatgaacagcctgagggccgaggacacggccgtctattattgtgtgagttagtttangggcgagttggcttgggtggacngatcgacgtggggccaaccgggg

SEQ ID NO: 319733 - DNA, 573 bp, Homo sapiens
  misc_feature: GZ8MTXP01CY1GU.19.67.G01.1.454.CMB.2.raw
  modified_base (427)..(427): a, c, t, g, unknown or other
  misc_feature (427)..(427): n is a, c, g, or t
  modified_base (488)..(488): a, c, t, g, unknown or other
  misc_feature (488)..(488): n is a, c, g, or t
  modified_base (528)..(528): a, c, t, g, unknown or other
  misc_feature (528)..(528): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactgggtggagacgtgggcggaggcttggtccagccgtggggcggtctctgagactgtcctgtcgaccctcgtggggtctccgtcagcagcgactgtattgccgtgggtcccgcaggctccgagggggaagagggccggaggtgggtcgcgtaggttattttagtagggtggaccgactattcgaggagaactccgaagtggagggccatcactatctacagacgtactttcncaagaacacactgtactcttacaaatgaacagcctagacgggaccgagacgacggtccgtntattattgtgtaagagttagtttattggacgtagttgggnttgggtaaggactaagacgtcgacggttcggggccgtaaccgggg

SEQ ID NO: 319734 - DNA, 548 bp, Homo sapiens
  misc_feature: GZ8MTXP01D668A.19.67.G01.1.454.CMB.2.raw
  modified_base (236)..(236): a, c, t, g, unknown or other
  misc_feature (236)..(236): n is a, c, g, or t
  modified_base (261)..(261): a, c, t, g, unknown or other
  misc_feature (261)..(261): n is a, c, g, or t
  modified_base (269)..(269): a, c, t, g, unknown or other
  misc_feature (269)..(269): n is a, c, g, or t
tcagtactctcgtgcacgaccggtgctcgatttagagtatacatattgggtttggggagctacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacatttcnccactccaagaacaaaactctagcngtaccaanagagaccaggacagcctctaagttgctcatttactgggcttctacgcgacgaattcggggtccctgaccccgagttccggggcaggccggtctgggaacagatttcactctcacatcagcagcctgcaggctagaagatgtggactagtttattaactgtcagtcctaaattacttttttctaattccctccggttggtaaccgtttcggaacccgaaaggggcccaaggggttaggaaaatccgaagacgaacgttgtggctgcacctaagttcttcg

SEQ ID NO: 319735 - DNA, 542 bp, Homo sapiens
  misc_feature: GZ8MTXP01EARSK.19.67.G01.1.454.CMB.2.raw
  modified_base (379)..(379): a, c, t, g, unknown or other
  misc_feature (379)..(379): n is a, c, g, or t
  modified_base (483)..(483): a, c, t, g, unknown or other
  misc_feature (483)..(483): n is a, c, g, or t
  modified_base (523)..(523): a, c, t, g, unknown or other
  misc_feature (523)..(523): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctggggcggtctctgagactgtcctgtgaaccctctggggtctccgtcagcagcgactgtattgcctgggtccgccaggctccgagggagaggccgggagtgggtcgcgaggtatttttagtaggtgggacgactattcgaacgggancgtccagtgggagggccgattcaccatctccagagtactttctactagaacacactagtctcttacaaatgaacagcctagaggcgaggacacggtcgtctatntgtgttgagttagttagtggcgttgttggcgtgggtgganaggactcgaacgtcggggg

SEQ ID NO: 319736 - DNA, 553 bp, Homo sapiens
  misc_feature: GZ8MTXP01B8JN4.19.67.G01.1.454.CMB.2.raw
  modified_base (504)..(504): a, c, t, g, unknown or other
  misc_feature (504)..(504): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctggggcggtctctgagactgtcctgtgaaccctctgggggtctccgtcagcagcgactgtattgcctgggtccgccaggctccgaggggaagaggccggagtggggtcgcgtaggttatttttagtagggtgggaccgacattctacggagaactccaagtgggaagggccgattcaccatctccagagtactttcacagaacacactgtctcttacaaatgaacgagccgtgacgggccgaggacacggccgtctattattgtgtgtagagtttanggacgattgggcttgggtggacaagatcgacgtcggggccgtaacgggg

SEQ ID NO: 319737 - DNA, 572 bp, Homo sapiens
  misc_feature: GZ8MTXP01D9D5D.19.67.G01.1.454.CMB.2.raw
  modified_base (379)..(379): a, c, t, g, unknown or other
  misc_feature (379)..(379): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccgagggaagaggccggagtgggtcgctaggtatttttagtaggtgggaccgacattctacggagaactccngtgggagggccgattcaccatctccagagactttctcagaacacactgtctcttacaaattgaaacagtctggacgggccgaggacacggccgtctattattgtgtgagttagtttagttgggacgtagttgggcgttggggttgggacctaaggacttccggaccggttcggggggcccgtaaaccgggggg

SEQ ID NO: 319738 - DNA, 560 bp, Homo sapiens
  misc_feature: GZ8MTXP01BNJG7.19.67.G01.1.454.CMB.2.raw
  modified_base (428)..(428): a, c, t, g, unknown or other
  misc_feature (428)..(428): n is a, c, g, or t
  modified_base (488)..(488): a, c, t, g, unknown or other
  misc_feature (488)..(488): n is a, c, g, or t
  modified_base (510)..(510): a, c, t, g, unknown or other
  misc_feature (510)..(510): n is a, c, g, or t
  modified_base (523)..(523): a, c, t, g, unknown or other
  misc_feature (523)..(523): n is a, c, g, or t
  modified_base (529)..(529): a, c, t, g, unknown or other
  misc_feature (529)..(529): n is a, c, g, or t
  modified_base (539)..(539): a, c, t, g, unknown or other
  misc_feature (539)..(539): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctggggcggtctctgagactgtcctgtgaaccctcgtgggggtctccgtcagcagcgactgtatgcctgggtccgccaggctccgaggggaagaggccggagtgggtcgcgtaggttattttagtagggtgggaccgactagttctacggagaacctccaagtgggagggcccgattccgacatctccagagtacttttcncagtaacacactcgtctactacaaatcgaacagcctagacgggccgaggaccacggcctntattatgtgtgtagttgtttanggcgtattcgggnttgggngtagaagtancgacgtcggggccgaacgggg

SEQ ID NO: 319739 - DNA, 550 bp, Homo sapiens
  misc_feature: GZ8MTXP01ATI3B.19.67.G01.1.454.CMB.2.raw
  modified_base (384)..(384): a, c, t, g, unknown or other
  misc_feature (384)..(384): n is a, c, g, or t
  modified_base (502)..(502): a, c, t, g, unknown or other
  misc_feature (502)..(502): n is a, c, g, or t
  modified_base (526)..(526): a, c, t, g, unknown or other
  misc_feature (526)..(526): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttgggtccagcctggggcggtctctgagactgtcctgtgaaccctctggggtctccgtcagcagcgactgtattgcctgggtccgccaggctccaggggaagagggccgggagtggggtcgcgaggtatttttagtaggtgggaccgacattctacggagaactccntgggagggccgattcaccatcctccagagtacttttcacagaaacacactgtctcttacaaatgaactagcctgagggccgaggcgacggccgtcgtattatgtgtgagttagttagnggtcgattgggcttgggtggacgngatcgacgtggggcccgaacgggg

SEQ ID NO: 319740 - DNA, 560 bp, Homo sapiens
  misc_feature: GZ8MTXP01AQALC.19.67.G01.1.454.CMB.2.raw
  modified_base (510)..(510): a, c, t, g, unknown or other
  misc_feature (510)..(510): n is a, c, g, or t
  modified_base (533)..(533): a, c, t, g, unknown or other
  misc_feature (533)..(533): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctggggcggtctctgagactgtcctgtgaccctctggggtctccgtcagcagcgactgtattgcctgggtccgccaggctccgagggaagaggccggagtggggtcgcgtaggttatttttagtagggtggggaccgacagttctacggagaactccaagtgggagggccgagttccaccagtctcccagacgtacttttctcagaaccacactgtcttcttacaaatgaacgagcctggacgggccgaggacacggcctctattatgtgtgagttgtttagnggcgagttgggcttggtggacgngactcgacgtcggggccgtaaccgggg

SEQ ID NO: 319741 - DNA, 588 bp, Homo sapiens
  misc_feature: GZ8MTXP01C9YYA.19.67.G01.1.454.CMB.2.raw
  modified_base (539)..(539): a, c, t, g, unknown or other
  misc_feature (539)..(539): n is a, c, g, or t
  modified_base (551)..(551): a, c, t, g, unknown or other
  misc_feature (551)..(551): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagccgtggggcggtctctgagactgtcctgtcgaaccctcgtggggtctccgtcagcagcgactgtattgcctgggtccgccaggctccgaggggaagaggccggaggtgggtcgcgaggttattttagtagggtggggaccgactagttcgtaacgggagtaacctccaagtgggaggggcccgattcaccatccgtccagtacgtacttttctcaagaaacacactgtctacttacaaaattgaacaacgcccgtaggacggggccgaaggaccgacggtaccgtcttattatgtgtaagagttagtttagnggtgagttgggnttgggtggacaagatcgacgtgggggccgaaccgggg

SEQ ID NO: 319742 - DNA, 657 bp, Homo sapiens
  misc_feature: GZ8MTXP01BIWPJ.19.67.G01.1.454.CMB.2.raw
  modified_base (239)..(239): a, c, t, g, unknown or other
  misc_feature (239)..(239): n is a, c, g, or t
  modified_base (303)..(303): a, c, t, g, unknown or other
  misc_feature (303)..(303): n is a, c, g, or t
  modified_base (467)..(467): a, c, t, g, unknown or other
  misc_feature (467)..(467): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctggcggggacatcgtgatgacccagtacccagactcactggctgtgtctctgggcgagacggccacaatcaactgcaggtccagccagaactatttcnccacctcaagaacaaaacttctagcctaggtaccaacagagaccaggacagcctacctaagttnctctatttacgtgggtctttcgtacgcgtacgtaacgttccgggggtccctggacccccgtacgttccgggggcacggtccggggtctacggggaacaggtactttccacctcctaccaaccctatccgaagccacggccctaggccgaagggcctaggaaagnttcggtaggacttaggttttatacgttggtaccaagtactaaatttctttttcttacttcccgtccggttggtacccgtttccggaaccgtaaaggggacccgtaagggggttacggtaaaattccgaaggttaccggttaaaccgttgggtcgggtaacctcggaccttaacccgtaagtttccgttcg

SEQ ID NO: 319743 - DNA, 571 bp, Homo sapiens
  misc_feature: GZ8MTXP01A2CWB.19.67.G01.1.454.CMB.2.raw
  modified_base (455)..(455): a, c, t, g, unknown or other
  misc_feature (455)..(455): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccaggcctggggcggtctctgagactgtcctgtgaaccctctggggtctccgtcagcagcgactgtattgcctgggtccgccaggctccaggggaagaggccggagtgggcgcgaggttatttttagagggttggggaccgacattcgtacggagaacttccaagtgggagggccgattcaccatctcccagagtacttttctcagaacacactgtctcttacaaatgaacncgcctgacgggccgaggaccacggccgtctattattggtgtggtagttaggtttagttgggacgtagttgggcgttgggtgggactaaggatcgacggtggggccgtaaccggggg

SEQ ID NO: 319744 - DNA, 575 bp, Homo sapiens
  misc_feature: GZ8MTXP01DF5OF.19.67.G01.1.454.CMB.2.raw
  modified_base (528)..(528): a, c, t, g, unknown or other
  misc_feature (528)..(528): n is a, c, g, or t
  modified_base (531)..(531): a, c, t, g, unknown or other
  misc_feature (531)..(531): n is a, c, g, or t
  modified_base (538)..(538): a, c, t, g, unknown or other
  misc_feature (538)..(538): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagccgtggggcgtctctgagactgtcctgtcgaaccctcgtggggtctccgtcagcagcgactgtatgcctgggtccgccaggctccgaggggaagaggccggagtgggtcgcgtaggttattttagaggtcgggaccgacagtttcgtaacggagaaccttccaagtgggagggcccgaattccacctatcctcccagtacgtaactttttcacaagaaacctacaactgtactcttacaaattgaacagcccgtgacgggccgaaggacaacggccgtctattattgtgtgagagtttagnggngattggnttgggtggacaaggatcgacgtcggggccgaacgggg

SEQ ID NO: 319745 - DNA, 629 bp, Homo sapiens
  misc_feature: GZ8MTXP01EX67J.19.67.G01.1.454.CMB.2.raw
  modified_base (567)..(567): a, c, t, g, unknown or other
  misc_feature (567)..(567): n is a, c, g, or t
  modified_base (583)..(583): a, c, t, g, unknown or other
  misc_feature (583)..(583): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctggggcggtctctgagactgtcctggtcgaacccctcgtgggggtctccgtcagcagcgactgtatgccgtgggtcccgccaggctccgaggggaagaggccgggaggtggggtcgcgaggttattttagagggtgggaccgactattcgtaacggagaactccgaagtcgggaagggtccgattccaccatcctccaagtacgtaacttttctacagaaaccactactgttctacttacaaaatgaaacgagtcccgtaggaacggggcccgaagggaccgaaccgggtcccggttacttaagtttaagttggtggttaaggtaagttaggtttagngggcgtaagttcgggnttggggtgggaagaaggacgtacggacgggtcggggccgtaacggg

SEQ ID NO: 319746 - DNA, 572 bp, Homo sapiens
  misc_feature: GZ8MTXP01DQFH6.19.67.G01.1.454.CMB.2.raw
  modified_base (529)..(529): a, c, t, g, unknown or other
  misc_feature (529)..(529): n is a, c, g, or t
tcagtactctcgtgcacgaccggtgctcgatttagagtatacatattggggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctggggcggtctctgagactgtcctgtcgaacccctctgggggtctccgtcagcagcgactgtattgcctgggtcccgccaggctccgaggggaagaggccgggagtggggtcgcgaggttatttttagtagggtgggaccgacattctacggagaactccaagtgggagggccgatcaccatctccagagactttctcagaacacactgtctacttacaaaagttgaaacaagccctaggacggggcccgaaggaccaacggcccgtctattaattgtgtgagttaggtttaattgggngattgggcttgggtggactaagatcacgtgggggccaacgggg

SEQ ID NO: 319747 - DNA, 556 bp, Homo sapiens
  misc_feature: GZ8MTXP01C1WP2.19.67.G01.1.454.CMB.2.raw
  modified_base (375)..(375): a, c, t, g, unknown or other
  misc_feature (375)..(375): n is a, c, g, or t
  modified_base (504)..(504): a, c, t, g, unknown or other
  misc_feature (504)..(504): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttgggtccagcctggggcggtctctgagactgtcctgtgaccctctggggtctccgtcagcagcgactgtattgcctgggtccgccaggctccgaggggaagaggccggagtggggtcgcgaggttatttttagtaggtgggaccgacattctacgganaactccaagtgggagggccgatccacatctccagagtactttctacagaacacacttgtctcttcaaattgaaacgagccctgacggggccgaggacacggccgtctattattgtgtgagagttttagnggtcgtagttggttcgttggtgacgaagatcgacggtcggggccgtaacggg

SEQ ID NO: 319748 - DNA, 620 bp, Homo sapiens
  misc_feature: GZ8MTXP01D6F93.19.67.G01.1.454.CMB.2.raw
  modified_base (440)..(440): a, c, t, g, unknown or other
  misc_feature (440)..(440): n is a, c, g, or t
tcagtactctcgtgcacgaccggtgctcgatttagagtatacatattggggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttgggtccagcctgggcggtctctgagactgtcctgtgaaccctctggggtctccgtcagcagcgactgtatgcctgggtccgccaggctccgaggggaagaggccgggagtgggtcgcgtaggttatttttagaggtgggaccgacattcgtacggagaacctccaagtgggagggccgattcaccatctccagagtactttctactacgaacacacgtntcttctacaaatagaacacgtaccgtaggacgggccgaacggaccgacggtaccggttacttatttaagtttggtggtaagtaaggttagtttaaggttggtacggtaacgttcggggttcgttggggtggaacgtaaggtaacgtcgaacgggttcgggggaacccgtaaacccggggg

SEQ ID NO: 319749 - DNA, 609 bp, Homo sapiens
  misc_feature: GZ8MTXP01AMA49.19.67.G01.1.454.CMB.2.raw
  modified_base (180)..(180): a, c, t, g, unknown or other
  misc_feature (180)..(180): n is a, c, g, or t
  modified_base (243)..(243): a, c, t, g, unknown or other
  misc_feature (243)..(243): n is a, c, g, or t
  modified_base (301)..(301): a, c, t, g, unknown or other
  misc_feature (301)..(301): n is a, c, g, or t
  modified_base (328)..(328): a, c, t, g, unknown or other
  misc_feature (328)..(328): n is a, c, g, or t
  modified_base (605)..(605): a, c, t, g, unknown or other
  misc_feature (605)..(605): n is a, c, g, or t
  modified_base (607)..(607): a, c, t, g, unknown or other
  misc_feature (607)..(607): n is a, c, g, or t
  modified_base (609)..(609): a, c, t, g, unknown or other
  misc_feature (609)..(609): n is a, c, g, or t
tcagtactctcgtgcacgaccggtgctcgatttagagtatacatattgggcttggtccagcctgggcggtctctgagactgtcctgtgaaccctctgggtctccgtcagcagcgactgtattgcctgggtccgccaggctccagggaagaggccggagtgggtcgctaggttatttttanaggtgggacgacattctacggagactcagtggaggccattcaccatctccagagtacttttcncagaacacactgtctcttacaaatgaacagcctggacgggccgaggaccacggccgtntaattattggtgtgagtacgttttagnggcgagtggcgtggtagacagactcgaccggtcggggaccacgggtaccctggtacccacccgttcctccctcacgtcccctaccgaacgacgggccctacgttcccggtcccttccccgtcggcccgcccgtcgcctaccgacggaccgcccaccgtccgagacggcgacgcggcccggccgtggcctcggccgtacggtacgaaacggtacctaccgtaacccgaaggacgacgttacgtggacgggcgggcgcgggaacgaggtcgactagagngngn

SEQ ID NO: 319750 - DNA, 565 bp, Homo sapiens
  misc_feature: GZ8MTXP01D0G74.19.67.G01.1.454.CMB.2.raw
  modified_base (265)..(265): a, c, t, g, unknown or other
  misc_feature (265)..(265): n is a, c, g, or t
  modified_base (445)..(445): a, c, t, g, unknown or other
  misc_feature (445)..(445): n is a, c, g, or t
  modified_base (525)..(525): a, c, t, g, unknown or other
  misc_feature (525)..(525): n is a, c, g, or t
  modified_base (530)..(530): a, c, t, g, unknown or other
  misc_feature (530)..(530): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtgggcggaggcttggtccagccctgggcggtcgtctgagacgtgtcctgtgaccctntggggtctccgtcagcagcgactgtattgcctgggtccgcaggctccgagggaagagggccggaggtgggtcgcgtaggttattttttagaggtggggaaccgacattcgtacggagaaaccttccaagtgggagggccgattcaccatctccgagtagacttttctacagaacacactntctcttacaaatagaacacgacgtcgagggaccggacggacgacggaccgtctattattgtgtgtagagttattggtgtnttggngttggtggagaagatcgacgtcgggcgaaccgggg

SEQ ID NO: 319751 - DNA, 572 bp, Homo sapiens
  misc_feature: GZ8MTXP01E4T08.19.67.G01.1.454.CMB.2.raw
  modified_base (502)..(502): a, c, t, g, unknown or other
  misc_feature (502)..(502): n is a, c, g, or t
  modified_base (524)..(524): a, c, t, g, unknown or other
  misc_feature (524)..(524): n is a, c, g, or t
  modified_base (543)..(543): a, c, t, g, unknown or other
  misc_feature (543)..(543): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctgggcggtctctgagactgtcctgtgaaccctctggggtctccgtcagcagcgactgtattgcctgggtccgcaggctccgagggagaggccggagtggggtcgcgtaggttatttttagtagggtgggaccgacagtttctaacgggagaaaccttccgaagtggggaaggggcccgattccaaccatcctacccagagtacttttcacaagaaaccacactgtctcttacaaatgaaacagccctggacgggccgaggaccacggcccgtntattattgtgtgagagtttagnggcgtagttggcgttgggngacaagctcgacggtcggggcgtaacggg

SEQ ID NO: 319752 - DNA, 552 bp, Homo sapiens
  misc_feature: GZ8MTXP01BDBXK.19.67.G01.1.454.CMB.2.raw
  modified_base (504)..(504): a, c, t, g, unknown or other
  misc_feature (504)..(504): n is a, c, g, or t
  modified_base (507)..(507): a, c, t, g, unknown or other
  misc_feature (507)..(507): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctggggcgtctctgagactgtcctgtcgaacccctctggggtctccgtcagcagcgactgtattgcctgggtccgccaggctccgaggggaagaggccggagtgggtcgcaggttatttttagagggtgggaccgacattcgtacggagaactccaagtgggagggccgattcaccatctccagagtactttctcagaacacactgtctcttacaaatcgaacagccgtggagggccgaggacgacggccgtcgtattattgtgtgagttgtttanggngagttggcttgggtgggagaagagtcgacggtcgggccgaacggg

SEQ ID NO: 319753 - DNA, 527 bp, Homo sapiens
  misc_feature: GZ8MTXP01CH5MK.19.67.G01.1.454.CMB.2.raw
tcagtactctcgtgcacgaccggtgctcgatttagagtatacatattgggtttgggggtagctcaggaagcagagcctggagcatctccactatggcctgggctccactacttctcaccctcctcgctcactgcacaggttcttgggccaactttatgctgactcagccccactctgtgtcggagtctccggggaagacggtaaccatcttttgcacccacaacagtggcaacattgccagctaattttgtgcagtggtaccagcagcgcccgggcacgttcccccacattgtgatctatgaggataatcaaaagccgtctgggggtccctgatcggttctctcggctcatcgacaagctcctcaactctcgccctccctcaccatctctggactgaagactggaggacgaggctggactactacgtgtctagtcttatcgatagccgcgtcagttgtggtcttcgggcgggaggccaaggcttagcccgttctaagggcaacggcccagggcctcgccccgttcgg

SEQ ID NO: 319754 - DNA, 585 bp, Homo sapiens
  misc_feature: GZ8MTXP01D8PR5.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctggggcggtctctgagactgtcctgtcgaaccctctggggtctccgtcagcagcgactgtatgcctgggtccgccaggctccgaggggaagagggccgggaggtggggtcgcgaggttatttttagtagggtgggaccgactattcgtacggagaacctccaagtgggagggccgattcgaccatctccagagtactttctcaagaaacacactcgtctacttacaaatgaacagcccgtaggacggggacccgaggaccgacgggtacccgtcgtatttaattggtgtgagttagtttagttgggcgtagttggcgttgggtggacaagatcgacgtcggggccgtaaccggggg

SEQ ID NO: 319755 - DNA, 543 bp, Homo sapiens
  misc_feature: GZ8MTXP01EMS2A.19.67.G01.1.454.CMB.2.raw
  modified_base (511)..(511): a, c, t, g, unknown or other
  misc_feature (511)..(511): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttgggtccagcctggggcggtctctgagactgtcctgtgaaccctctggggtctccgtcagcagcgactgtatgcctgggtccgccaggctccgagggaagaggcccgggagtgggtcgctaggtatttttagtaggtgggacgacattcgtaaacgggagctccatgggagggccgattcaccatctccagagtacttttctactagaacacactgtctacttacaaatgaaacagcctggacggccgaggacacggccgtctattatgtgttgagttagttagtggcgnttgggctgggtggacagatcgaacgtcggggg

SEQ ID NO: 319756 - DNA, 578 bp, Homo sapiens
  misc_feature: GZ8MTXP01DLIPN.19.67.G01.1.454.CMB.2.raw
  modified_base (521)..(521): a, c, t, g, unknown or other
  misc_feature (521)..(521): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtgggcggaggcttggtccagccgtggggcggtctctgagactgtcctgtcgaaccctcgtggggtctccgtcagcagcgactgtatgcctgggtccgccaggctccgaggggaagaggccggagtgggtcgcgtaggttattttagaggtgggaccacattctacggagaactccaagtgggacgggccgattcgaccagtcctccagagtacttttctacaagaacacactcgtactcttacaaatgaaacgagcccgtaggacgggccgaggaccacggtcccgtattattattgtgtgaagttagtttangggcgtagttggcgttgggtaaggacaaggactcgacgtgggggcccgtaacggggg

SEQ ID NO: 319757 - DNA, 542 bp, Homo sapiens
  misc_feature: GZ8MTXP01B6ZIQ.19.67.G01.1.454.CMB.2.raw
  modified_base (378)..(378): a, c, t, g, unknown or other
  misc_feature (378)..(378): n is a, c, g, or t
  modified_base (415)..(415): a, c, t, g, unknown or other
  misc_feature (415)..(415): n is a, c, g, or t
  modified_base (505)..(505): a, c, t, g, unknown or other
  misc_feature (505)..(505): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttgggtccagcctggggcggtctctgagactgtcctgtgaaccctctggggtctccgtcagcagcgactgtattgcctgggtccgccaggctccaggggaagaggccggagtgggtcgcaggtattttagaggtgggacgacattctacggagaactccntgggagggccgattcaccatctccagagtacttttcnctagaaacacactgtctcttacaaatgaacagcctgagggccgaggacacggccgtctatattgtgtgagttagttattggcgagttggnttgggtggacaagatcgacgtcggggccgtaacgggg

SEQ ID NO: 319758 - DNA, 554 bp, Homo sapiens
  misc_feature: GZ8MTXP01ECT7A.19.67.G01.1.454.CMB.2.raw
  modified_base (487)..(487): a, c, t, g, unknown or other
  misc_feature (487)..(487): n is a, c, g, or t
  modified_base (509)..(509): a, c, t, g, unknown or other
  misc_feature (509)..(509): n is a, c, g, or t
  modified_base (533)..(533): a, c, t, g, unknown or other
  misc_feature (533)..(533): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtgggcggaggcttggtccagccgtggggcggtctctgagactgtcctgtcgaaccctctggggtctccgtcagcagcgactgtatgccgtgggtccgccaggctccgaggggaagagggccggaggtgggtcgcgtaggttatttttagagggtgggaccgacattcgtacggagaacctccaagtgggagggccgattcaccgtatcctccagagtactttctcagaacacactgtctctacaaatgaacagcctgacgggccgagacatcggccgtntattatgtgtgagtagtttagnggcgagttgggctgggtaggcagnttcgaacgttggggaacccgg

SEQ ID NO: 319759 - DNA, 554 bp, Homo sapiens
  misc_feature: GZ8MTXP01ALMLC.19.67.G01.1.454.CMB.2.raw
  modified_base (423)..(423): a, c, t, g, unknown or other
  misc_feature (423)..(423): n is a, c, g, or t
  modified_base (500)..(500): a, c, t, g, unknown or other
  misc_feature (500)..(500): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttgggtccagcctggggcggtctctgagactgtcctgtgaaccctctggggtctccgtcagcagcgactgtattgcctgggtccgccaggctccgaggggaagaggccgggagtggggtcgcgaggttatttttagtaggtgggaccgacattcgtacggagaactccgaatgggagggccgattcgacatctccagagactttcncagaacacactgtctcttacaaatgaacagcctgacgggccgaggacacggccgtctattatgtgtgagttagttanggcgtagttggcgttgggtggacgaaggatcgacgtcggggccgtaaccggggg

SEQ ID NO: 319760 - DNA, 574 bp, Homo sapiens
  misc_feature: GZ8MTXP01E1HE1.19.67.G01.1.454.CMB.2.raw
  modified_base (388)..(388): a, c, t, g, unknown or other
  misc_feature (388)..(388): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttgggtccagcctggggcggtctctgagactgtcctgtgaccctctggggtctccgcagcagcgactgtattgcctgggtcccgccaggctccgagggggaagaggcccgggagtggggtcgctagggtatttttagacgggtggggacgacattcgtaaacggganaacctccagtgggagggccgattcaccatctaccagagtactttctacagaaacacactgtactcttacaaaattgaaaccagccctaggaacgggcccgaaggaccaaccggccgttactattattggtgttgagttagtttagtggcgattgggctgggtggacaggacttcgaacgtcggggg

SEQ ID NO: 319761 - DNA, 604 bp, Homo sapiens
  misc_feature: GZ8MTXP01D1ZYF.19.67.G01.1.454.CMB.2.raw
  modified_base (303)..(303): a, c, t, g, unknown or other
  misc_feature (303)..(303): n is a, c, g, or t
tcagtactctcgtgcacgaccggtgctcgatttagagtatacatattgggtttgggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctggggcggtcgtctgagacgtgtcctgtgaccctcgtggggtctccgtcagcagcgactgtattgcctgggtcccnccgaggctccgaggggaagagggccggagtggggtcgcgtaggttatttttagagggtgggaccgactattcgtacggagaacctcaagtgggagggccctattccacctatcctccaagtagtactttctacaagaaaccactacttgtctacttactaaatagaacgacgtcgtacggacgggaccggacggaccgaccggtaccgttacgttaagtttagttgttggtaaggtaggttagtttagttggtcgtgttggttcgttggtggacgaagagtcgacgtcgggcggtaacggg

SEQ ID NO: 319762 - DNA, 582 bp, Homo sapiens
  misc_feature: GZ8MTXP01ALV81.19.67.G01.1.454.CMB.2.raw
  modified_base (242)..(242): a, c, t, g, unknown or other
  misc_feature (242)..(242): n is a, c, g, or t
  modified_base (318)..(318): a, c, t, g, unknown or other
  misc_feature (318)..(318): n is a, c, g, or t
  modified_base (374)..(374): a, c, t, g, unknown or other
  misc_feature (374)..(374): n is a, c, g, or t
  modified_base (422)..(422): a, c, t, g, unknown or other
  misc_feature (422)..(422): n is a, c, g, or t
  modified_base (569)..(569): a, c, t, g, unknown or other
  misc_feature (569)..(569): n is a, c, g, or t
  modified_base (577)..(577): a, c, t, g, unknown or other
  misc_feature (577)..(577): n is a, c, g, or t
  modified_base (579)..(579): a, c, t, g, unknown or other
  misc_feature (579)..(579): n is a, c, g, or t
  modified_base (581)..(581): a, c, t, g, unknown or other
  misc_feature (581)..(581): n is a, c, g, or t
tcagtactctcgtgcacgaccggtgctcgatttagagtatacatattgggcttggtccagcctgggcggtctctgagactgtcctgtgaaccctctgggtctccgtcagcagcgactgtattgcctgggtccgccaggctccagggaagaggccggagtgggtcgcaggtatttttataggtgggacgacattctacggagactccatggagggccgattcaccatctccagagacttttcncagaacacactgtctcttcaaatgaacagcctgagggccgaggacacggccgtctattattgtgtgagtagtttanggcgatgggctggtggacagatcgacgtggggcaggggaccctggtaccaccgtcncctcagccctccaccgaagggccccagtccggtccttccccgtggccnccctgcctccgaggacgccaccctccgacgacggccacgacggccggcccctggggccttcggcccgtgggtccaaacgggtcccttacccgttccccaaggacggacgttaaccgtggacggttcggggcttcgggcaacggggcncgattggngngng

SEQ ID NO: 319763 - DNA, 599 bp, Homo sapiens
  misc_feature: GZ8MTXP01D5F5O.19.67.G01.1.454.CMB.2.raw
  modified_base (532)..(532): a, c, t, g, unknown or other
  misc_feature (532)..(532): n is a, c, g, or t
  modified_base (548)..(548): a, c, t, g, unknown or other
  misc_feature (548)..(548): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggagtgtccagtgtgaggtgcaacgtggtggagacgtggcggaggcttggtccagccgtgggcgtctcgtgagactgtcctgtcgaaccctcgtggggtctccgtcagcagcgactgtatgccgtggtccgcaggctccgagggagaggccggagtgggcgcgtaggttattttagaggtgggaccgactagttcgacggagaactccgaagtgggacgggccgtattccgacatcctaccagtacgtactttctacgaagaaacactactctacttactacaaatagaacgacgccgtaggacgggccgaaggaccgacggtccgtacgttattagttgtggtgtaaggttgtttaagnggacggtagttcgggngttagggtaacggataacggtactacgacggtccggggccgtaacccgggg

SEQ ID NO: 319764 - DNA, 550 bp, Homo sapiens
  misc_feature: GZ8MTXP01B4WI0.19.67.G01.1.454.CMB.2.raw
  modified_base (501)..(501): a, c, t, g, unknown or other
  misc_feature (501)..(501): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtgggcggaggcttgggtccagcctggggcggtctctgagactgtcctgtgaaccctctggggtctccgtcagcagcgactgtattgcctgggtccgccaggctccaggggagagggccggaggtgggggtcgcgaggttatttttagtagggtgggaccgacattctacggagaactccaagtgggagggccgattcacatctccagagtactttctctagaaacacactgtctcttacaaatgaacagcctgacgggccgaggcacggccgtctattatgtgtgagagtttanggcgtattgggcttgggtggactaagatcgacgtcggggccgaacgggg

SEQ ID NO: 319765 - DNA, 582 bp, Homo sapiens
  misc_feature: GZ8MTXP01ELNLP.19.67.G01.1.454.CMB.2.raw
  modified_base (546)..(546): a, c, t, g, unknown or other
  misc_feature (546)..(546): n is a, c, g, or t
  modified_base (557)..(557): a, c, t, g, unknown or other
  misc_feature (557)..(557): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtggcggaggcttggtccagcctgggcggtctctgagactgtcctgtcgaaccctcgtggggtctccgtcagcagcgactgtatgcctgggtccgccaggctccgaggggaagagggccggaggtgggtcgcgtaggttatttttagagggtgggaccgactagttacgtacgggagaactccaagtgggagggccgattcacatcctccagagtacttttcacagaaacactactgtctcttacaaatgaaacagccgtaggacgggaccgaaggaccgacggaccgttactagttaagttggtggtgtaagttagtttagttgggcgagttcgggnttgggtgacgngatcgacgtcggggcgtaaccgggg

SEQ ID NO: 319766 - DNA, 667 bp, Homo sapiens
  misc_feature: GZ8MTXP01DONO4.19.67.G01.1.454.CMB.2.raw
  modified_base (393)..(393): a, c, t, g, unknown or other
  misc_feature (393)..(393): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagtttggctgacctgggttttccttgctgcaatttcaggaggtgtccagtgtgaggtgcaactggtggagactgggcggaggcttggtccagcctggggcggtctctgagactgtcctgtcgaccctcgtggggtctccgcagcagcgactgtattgcctgggtccgccaggcctccgaaggggagagggcccgggaggtgggtcgcgtaggttatttttagtagggtggggaacgactagttccgtaaacggganaaccgttccaagtcggggacggggtcccgtaatttccaaccctattcctacccgaaggtacgttacctttttacactaagaaaccacctacttcgttaccttacctttaccaaaagttacggaaacctaacggtcccgttagggaacggggcccggaagggaacccgaccgggtcccgttacttaatttagttggttggttggtaaggttagttttaagtgggttacgttagttcgggtcgttagggtggacaggttactcgaacggtcggggg

SEQ ID NO: 319767 - DNA, 560 bp, Homo sapiens
  misc_feature: GZ8MTXP01BA3RQ.19.67.G01.1.454.CMB.2.raw
  modified_base (238)..(238): a, c, t, g, unknown or other
  misc_feature (238)..(238): n is a, c, g, or t
  modified_base (277)..(277): a, c, t, g, unknown or other
  misc_feature (277)..(277): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaactatttcnccacctaccaaagaacaaaacttctagcctagtaccaanagagaccaggacagcctcctaagttgctctatttacgtgggtcttctacgcgacgtaacgttccgggggtccctgacccccgtacgttccgggggcacggccggggtactaggggaacagtactttcacttctacaccatcagcagcctgcaggctaggaacgatgtggactagtttatacgtgtacagtactaatttattttctactcctcgtaggtccgttcggaaccgaagggccagggttgaaatcgaaggcgacgtggcggctacgcacctgttcctg

SEQ ID NO: 319768 - DNA, 797 bp, Homo sapiens
  misc_feature: GZ8MTXP01BFH47.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtggcggaggcttggtccagccgtggggcggtctctgagactgtcctgtcgacccgtcgtggggtctccgtcagcagcgactgtattgccgtggtccgccgaggctaccgaggggaaggacggccgggtaggtgggtcgcgtaggtttatttttagagggtcgggaccgactagttcgtaacgggagaacccttaccgaaggttcggggaacggggtaccgtaacgtttccgaacccgtacgttaccctacccgtaaggttaaccggttaccgtttttacctaccgtaaacgggtaaaaccctaacccgttaaaccttcgtttacccttaccgtttaaccaaaagtttacggaaaccgtaacgggtccccggttaagggaaccgggggtacccggaaaccgggaacccggtaaccggggtacccgggtttaccttaaacgttttaaaggtttcgggttagggttaacggtaacgggtttaacgggttttaaaggttggggtaccggtaaggttcggggttccggttacggggttaaggaaccgtaaggtacgtcggaaccggttcggggggaacccgttaaacccggggg

SEQ ID NO: 319769 - DNA, 557 bp, Homo sapiens
  misc_feature: GZ8MTXP01BGAED.19.67.G01.1.454.CMB.2.raw
  modified_base (387)..(387): a, c, t, g, unknown or other
  misc_feature (387)..(387): n is a, c, g, or t
  modified_base (429)..(429): a, c, t, g, unknown or other
  misc_feature (429)..(429): n is a, c, g, or t
  modified_base (511)..(511): a, c, t, g, unknown or other
  misc_feature (511)..(511): n is a, c, g, or t
  modified_base (533)..(533): a, c, t, g, unknown or other
  misc_feature (533)..(533): n is a, c, g, or t
tcagtactctcgtgcacgaccggtgctcgatttagagtatacatattgggtttgggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctggggcggtctctgagactgtcctgtgaaccctctgggggtctccgtcagcagcgactgtattgcctgggtccgccaggctccgaggggaagaggccggagtgggggtcgcgaggttatttttagtagggtgggaccgacattcgacgggagaactcccngtgggaggggcccgattcgaccatcctccagagtacttttcnctagaaacacactgtctcttcaaattcgaacagcctggacgggccgaggaccacggccgtctattattgtgtgagagtttanggcgattgggcttgggtgacgngatcgacgtggggccgtaacgggg

SEQ ID NO: 319770 - DNA, 619 bp, Homo sapiens
  misc_feature: GZ8MTXP01CD3ZL.19.67.G01.1.454.CMB.2.raw
  modified_base (553)..(553): a, c, t, g, unknown or other
  misc_feature (553)..(553): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagccgtggggcggtctctgagactgtcctgtcgaaccctcgtggggtctccgtcagcagcgactgtattgccgtgggtcccgccaggctccgagggggaagagggccggaggtgggtcgcgtaggttattttagaggtgggaccgactagttcgtacggagaaccttccgaagtgggaacggggcctattccacctatcctaccagtacgtacttttcacaagaaccacactgtctacttacaaatacggaaacagtaccgtaggaacggggccgaagggaccaacggggtcctctagtttattggtggtaagtagttagttttaggnggtacgtgttcgggttcgttgggtaacggacgaaggtacgtcggacgggtcggggaaccgaacggg

SEQ ID NO: 319771 - DNA, 652 bp, Homo sapiens
  misc_feature: GZ8MTXP01ER3K9.19.67.G01.1.454.CMB.2.raw
  modified_base (306)..(306): a, c, t, g, unknown or other
  misc_feature (306)..(306): n is a, c, g, or t
  modified_base (539)..(539): a, c, t, g, unknown or other
  misc_feature (539)..(539): n is a, c, g, or t
  modified_base (573)..(573): a, c, t, g, unknown or other
  misc_feature (573)..(573): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagactgggcggaggcttggtccagccgtgggcgtctctgagactgtcctgtcgaaccctcgtggggtctccgtcagcagcgactgtattcgccgtgggtccnccaggctccgaggggaagagggccggagtgggtcgcgtaggttattttagagggtggaacccgactagtttcgaacggagaacctccgaagtggggaacgggtcccgtattccaaccagttccctaccaagaacgttaccttttcaccgaagaaaccactacttgtacctacttacaaattcgaaacgacgtacccgtaggacggggacccgaggaccgacgggtacccgttnttaatttagttggtgtaaggtagttagttttagngggtacgtaagttgggttcgttagggtaacggaactaaggacttaccggaacggttcgggggaacccgaaacccggggg

SEQ ID NO: 319772 - DNA, 654 bp, Homo sapiens
  misc_feature: GZ8MTXP01EPXC7.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctggggcgtctctgagactgtcctgtcgaaccctcgtggggtctccgtcagcagcgactgtatgccgtgggtccgccgaggcctccgaggggaagaggccggaggtgggtcgcgtaggttatttttagagggtggaaccgactattcgtaacggagtaacctccgaagtgggaacgggcccgtaagttccggcctaattccctacccgaagtacgtacttttctacaacgtaaacactacttcgtaccttacttaacaaaattacggaaactacggacccgttaggacggggacccgaacgggaaccaccgggtacccgttcttaagtttagttggttggtggtaagttagttttagttgggtacgtaagttgggcgttggggtggaccgaaggtactcgaacggttcggggccgtaaacccggggg

SEQ ID NO: 319773 - DNA, 587 bp, Homo sapiens
  misc_feature: GZ8MTXP01E08IY.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctgggcggtctctgagactgtcctgtcgaaccctcgtggggtctccgtcagcagcgactgtattgccgtgggtccgccaggctccgaggggaagaggccgggaggtgggtcgcgtaggttattttagtagggtgggaaccgactagttcgtaacggagaaccttccgaagtgggaggggcccgattccaccatcctccagtagtacttttctacaagaaaccactactgtcctcttacaaattgaacagccgtgacgggccgaggacacggccgtctattatgtgtgtagttagtttagttgggcgtagttgggttcttgggtgacgtaagatcgacggtcgggggccgtaaccggggg

SEQ ID NO: 319774 - DNA, 569 bp, Homo sapiens
  misc_feature: GZ8MTXP01B4WY7.19.67.G01.1.454.CMB.2.raw
  modified_base (385)..(385): a, c, t, g, unknown or other
  misc_feature (385)..(385): n is a, c, g, or t
  modified_base (406)..(406): a, c, t, g, unknown or other
  misc_feature (406)..(406): n is a, c, g, or t
  modified_base (520)..(520): a, c, t, g, unknown or other
  misc_feature (520)..(520): n is a, c, g, or t
  modified_base (543)..(543): a, c, t, g, unknown or other
  misc_feature (543)..(543): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaacccctctggggtctccgtcagcagcgactgtattgcctgggtccgccgaggctccgagggagaggccggaggtgggtcgcgaggttattttagtagggtggaccgacagttcgtacggagaaccttccngtgggagggccgattccgacntctccagtacgtactttctacagaaacacacttgtcttacttacaaatcgaaacgtagtcgtggacgggccgacggaccgacggccgtctattagttgtgtgtagttgtttagnggtcgagttggcttgggtggacngtatcgacgtcggggccgtaacgggg

SEQ ID NO: 319775 - DNA, 542 bp, Homo sapiens
  misc_feature: GZ8MTXP01AZO38.19.67.G01.1.454.CMB.2.raw
  modified_base (506)..(506): a, c, t, g, unknown or other
  misc_feature (506)..(506): n is a, c, g, or t
  modified_base (511)..(511): a, c, t, g, unknown or other
  misc_feature (511)..(511): n is a, c, g, or t
  modified_base (526)..(526): a, c, t, g, unknown or other
  misc_feature (526)..(526): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctgggcggtctctgagactgtcctgtgaaccctctggggtctccgcagcagcgactgtattgcctgggtccgccaggctccgaggggaagagggcccgggaggtggggtcgcgtagggttatttttagtagggtgggacgacattctaaacgggagctccaagtgggagggccgattcaccatctccagagactttcacagaacacactgtctcttcaaagtgaacagcctggacggccgaggacacggtcctctattatgtgttgagttgttanggcgngttggctgggtgacngactcgaacgtcgggg

SEQ ID NO: 319776 - DNA, 604 bp, Homo sapiens
  misc_feature: GZ8MTXP01B9812.19.67.G01.1.454.CMB.2.raw
  modified_base (394)..(394): a, c, t, g, unknown or other
  misc_feature (394)..(394): n is a, c, g, or t
  modified_base (440)..(440): a, c, t, g, unknown or other
  misc_feature (440)..(440): n is a, c, g, or t
  modified_base (539)..(539): a, c, t, g, unknown or other
  misc_feature (539)..(539): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttgggtccaggccctggggcggtctctgagactgtcctgtcgaaccctcgtggggtctccgtcagcagcgactgtattgcctgggtccgccaggctccgaggggagaggccgggaggtgggcgcgtaggttatttttagtagggtgggaccgactagttcgtacggacgaactccngtgggaggggccgtagttccaccgatcctcccagtacgtactttcncacgaaacacactgtcctacttacaaatcgtaaacgagcccgtacggacgggaccgaggaccgacggtcccgtctattagttgtgtgtagttagttagnggtcgtagttgggttcgttggggtggacgtaaggactacggacggtcgggggccgtaaccggggg

SEQ ID NO: 319777 - DNA, 580 bp, Homo sapiens
  misc_feature: GZ8MTXP01CO2I2.19.67.G01.1.454.CMB.2.raw
  modified_base (514)..(514): a, c, t, g, unknown or other
  misc_feature (514)..(514): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagccgtggggcggtctctgagactgtcctgtcgaaccctctggggtctccgtcagcagcgactgtattgcctgggtccgccaggctccgaggggaagaggccgggagtgggtcgcgtaggttatttttagagggtgggaccgacagtttcgtacggagaactccaagtgggagggccgattcaccatctccagagtactttctccaagaaacacactgtctacttacaaatgaacagcctggacgggccgaggacacggccgtctatattgtgtgtagttaggttttancgggtagagttgggcgttggggtgggaccaaggaagtcgaacggttcgggggccgtaaaccggggg

SEQ ID NO: 319778 - DNA, 632 bp, Homo sapiens
  misc_feature: GZ8MTXP01AK4D0.19.67.G01.1.454.CMB.2.raw
  modified_base (381)..(381): a, c, t, g, unknown or other
  misc_feature (381)..(381): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctggggcggtctctgagactgtcctgtcgaaccctctggggtctccgtcagcagcgactgtattgcctgggtccgccaggctccgaggggaagagggccgggagtgggtcgcgtaggttattttagtagggtgggaccgactattcgtacgganaactccaagtgggagggccgattcaccatcctccagtacgtacttttctacaagaaaccactacttgtccttacttacaaaattcgaaacgtaggccccgttaggacgggggacccggaacggacccggtaccggttcccgttatttaagttacggtttggtggttaaggtaagtttagttaggcggtaagtggcggttggttggtaacgggataagtcgacgttacggggtcggaaccggtaaacccggg

SEQ ID NO: 319779 - DNA, 537 bp, Homo sapiens
  misc_feature: GZ8MTXP01D9AAU.19.67.G01.1.454.CMB.2.raw
  modified_base (236)..(236): a, c, t, g, unknown or other
  misc_feature (236)..(236): n is a, c, g, or t
  modified_base (447)..(447): a, c, t, g, unknown or other
  misc_feature (447)..(447): n is a, c, g, or t
tcagtactctcgtgcacgaccggtgctcgatttagagtatacatattgggtttggggagctacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacatttcnccacctcaagaacaaaactctagcctggtaccaacagaagaccaggacagcctcctaagtgctctatttactgggcttctacgcgcgtaattcggggtccctgaccccgagttccggggcagccgggtctggggcagtatttcactctcaccatcagcagcctgcaggctagaagatgtggactagtttacttactgtccagtctaaattntttttcaatccctccgtgtaccgttcggccaaggggccaggggttagaaacgtcaagcgttaactggtagcctggccacctaattccgtg

SEQ ID NO: 319780 - DNA, 574 bp, Homo sapiens
  misc_feature: GZ8MTXP01CRUGG.19.67.G01.1.454.CMB.2.raw
  modified_base (394)..(394): a, c, t, g, unknown or other
  misc_feature (394)..(394): n is a, c, g, or t
  modified_base (526)..(526): a, c, t, g, unknown or other
  misc_feature (526)..(526): n is a, c, g, or t
  modified_base (537)..(537): a, c, t, g, unknown or other
  misc_feature (537)..(537): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactgggtggagacgtgggcggaggcttgggtccaggccgtggggcggtctcgtgagactgtcctgtcgaaccctcgtggggtctccgtcagcagcgactgtattcgccgtgggtcccgccgaggcctccgaggggagagggccggaggtgggtcgcgtaggttattttagaggtgggaccgacatcgtaggagaactcngtggaggcgatcacatctccagagtacttttcacaacgaacactaactcgtcttacttacaaattcgaaacgacgcccgtaggacggggaccgaggaaccgacggccgtactattatgtgtgagttgtttanggtgagttggngttggtgacaagctcgacgtcggggccgtaaccgggg

SEQ ID NO: 319781 - DNA, 591 bp, Homo sapiens
  misc_feature: GZ8MTXP01DPXTZ.19.67.G01.1.454.CMB.2.raw
  modified_base (533)..(533): a, c, t, g, unknown or other
  misc_feature (533)..(533): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactgggtggagacgtgggcggaggcttggtccagcctggggcggtctctgagactgtcctgtcgaaccctcgtggggtctccgtcagcagcgactgtattgcctgggtccgccaggctccgagggggaagagggccgggaggtggggtcgcgtaggttatttttagtagggtgggaccgacagttcgtaacggagaaccttccaagtgggaggggccgattccgaccagtcctccagagtacttttctcaagaaacacacttgtctcttacaaattgaaacgagcctggacgggccgaggaccgacggccgtctattatgtgtgtagttaggtttagngggtcgtagttgggcgttgggtaaggacaaggactcgacgtcgggggccgaaccgggg

SEQ ID NO: 319782 - DNA, 583 bp, Homo sapiens
  misc_feature: GZ8MTXP01CQVKS.19.67.G01.1.454.CMB.2.raw
  modified_base (208)..(208): a, c, t, g, unknown or other
  misc_feature (208)..(208): n is a, c, g, or t
  modified_base (240)..(240): a, c, t, g, unknown or other
  misc_feature (240)..(240): n is a, c, g, or t
  modified_base (280)..(280): a, c, t, g, unknown or other
  misc_feature (280)..(280): n is a, c, g, or t
  modified_base (431)..(431): a, c, t, g, unknown or other
  misc_feature (431)..(431): n is a, c, g, or t
  modified_base (540)..(540): a, c, t, g, unknown or other
  misc_feature (540)..(540): n is a, c, g, or t
  modified_base (564)..(564): a, c, t, g, unknown or other
  misc_feature (564)..(564): n is a, c, g, or t
  modified_base (579)..(579): a, c, t, g, unknown or other
  misc_feature (579)..(579): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctcgtgggcgagacggccaanaatcaactgcagccagccagaactattttccnccacctacaaagaaacaaaacttctagccaggtaaccaanagaagaccaaggacagcctactaagtgctacatttactggcttctacgcgcgaagttccgggtcctgacccgacggttaccgggcacgcgggtacgtgggaacatagtttcactctacacatcagcacgcctgaccaggctagaagatagnggactagtttatactgtacagtactaaatttacttttcgttaacgttcccgtccgttagggacgtttccggaacgaacgggttaacggtacggggttagaaaccgttanacggacgttaaacgtggtcggtcncggacaacctcgttnttcg

SEQ ID NO: 319783 - DNA, 634 bp, Homo sapiens
  misc_feature: GZ8MTXP01BS0LZ.19.67.G01.1.454.CMB.2.raw
  modified_base (391)..(391): a, c, t, g, unknown or other
  misc_feature (391)..(391): n is a, c, g, or t
tcagtactctcgtgcacgaccggtgctcgatttagagtatacatattggggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctggggcggtctctgagactgtcctgtcgaaccctctggggtctccgtcagcagcgactgtattgcctgggtccgccaggctccgaggggaaggacggcggaggtgggtcgcgtaggttattttagtagggtggaccgactatcgtacggacgtaacctccngtagggacggggaccgtatccgaccatccctacagacgttacctttctacgaagaacactactacgtcttacttacaaatacgaacgacgtcgtaggacgggaccgaacggacgaccggtaccgtacttagttaagttggtgtaaggtaagttaggtttagttgggtcgtaaggttcggttcggttgggtaacgggtacgaaggtactcggttaacgggtcggggaaccggtaaacccggggg

SEQ ID NO: 319784 - DNA, 531 bp, Homo sapiens
  misc_feature: GZ8MTXP01B0OJQ.19.67.G01.1.454.CMB.2.raw
  modified_base (371)..(371): a, c, t, g, unknown or other
  misc_feature (371)..(371): n is a, c, g, or t
  modified_base (382)..(382): a, c, t, g, unknown or other
  misc_feature (382)..(382): n is a, c, g, or t
  modified_base (396)..(396): a, c, t, g, unknown or other
  misc_feature (396)..(396): n is a, c, g, or t
  modified_base (448)..(448): a, c, t, g, unknown or other
  misc_feature (448)..(448): n is a, c, g, or t
  modified_base (457)..(457): a, c, t, g, unknown or other
  misc_feature (457)..(457): n is a, c, g, or t
  modified_base (461)..(461): a, c, t, g, unknown or other
  misc_feature (461)..(461): n is a, c, g, or t
tcagtactctcgtgcacgaccggtgctcgatttagagtatacatattgggtttgggggtagctcaggaagcagagcctggagcatctccactatggcctgggctccactacttctcaccctcctcgctcactgcacaggttcttgggccaactttatgctgactcagccccactctgtgtcggagtctccggggaagacggtaaccatcttttgcacccacaacagtggcaacattgccagctaatttttgtgcagtggtaccagcagcgcccgggcacgttcccccacattgtgatctatgaggataatcaaaagccgtcgtcgggggtccctgattcggttctcgtcggctcatcgacaacgcctcccnccaactcgtcnccctaccctcaccntctctggactgaagactggaggacgaggctgactactactgtctagtcttangatagccgngtcngttgtggtcgtcgggcgggagggaccaagcttgaccgttctaagtcaacgccaggcctcgccccgtaacg

SEQ ID NO: 319785 - DNA, 566 bp, Homo sapiens
  misc_feature: GZ8MTXP01BOFKG.19.67.G01.1.454.CMB.2.raw
  modified_base (506)..(506): a, c, t, g, unknown or other
  misc_feature (506)..(506): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtcgaaccctctgggggtctccgtcagcagcgactgtattgcctgggtccgccaggctccgaggggaagaggccgggagtgggtcgcgtaggttatttttagtagggtgggaccgacattcgtacggagaactccaagtgggaagggccgattcaccatcctccagagtactttctctagaacacactgtcttctacaaatcgaacagcctgagggccgaggacacggccgtctattattgtgtgagttagtttangggcgtagttgggcttgggtggacgaagacgtcgacggtcgggggttccgtaaccggggg

SEQ ID NO: 319786 - DNA, 677 bp, Homo sapiens
  misc_feature: GZ8MTXP01DQNBQ.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgcaacgtggtggagacgtgggcggaggcttggtccagccgtggggcgtctctgagactgtcctgtcgaaccctcgtggggtctccgtcagcagcgactgtattgcctgggtcccgccaggctccgaggggaagaggccggaggtgggtcgcgtaggttatttttagagggtgggaccgactagttcgtaacggagtaacctccgaagtggggacggggacccgtattccaaccgtacttcctaccctagtacggtaccttttctacgaacgtaaaccactaactcgttaccttcttaaccaaaattacgaaaccgtacgtcccgttagggaacgggggcccggaaagggacccgaaccgggtaccccggttacttaatttaagttggtgttaaggtagttaggttttaagttgggtagtagttgggttcggttagggtggaacgaaggtgtacgaccgggtcggggaacccgtaaacccggggg

SEQ ID NO: 319787 - DNA, 665 bp, Homo sapiens
  misc_feature: GZ8MTXP01DUEU8.19.67.G01.1.454.CMB.2.raw
  modified_base (395)..(395): a, c, t, g, unknown or other
  misc_feature (395)..(395): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtgggtggagacgtgggcggaggcttggtccagccgtggggcggtctctgagactgtcctgtcgaaccctcgtggggtctccgtcagcagcgactgtatgcctgggtcccgcaggctccgaggggaagagggccgggaggtgggtcgcgtaggttatttttagagggtgggaccgactagttcgacggagaacctccngtgggacgggccgagttccacctatcctccaagtacgtacttttcactaacgaaacactactgtccttacttaacaaaattacgaaacgacggcccgtaggaacggggcccggaacgggaccgaacccgggtcccgttacttaagtttaagttggtggttaagggtaaggttaggttttaagttggggtacgtaaggttcggggttcgttgggggtaagggaaccgaaggtacgtcggaacggttcggggggaacccgtaaacccggggg

SEQ ID NO: 319788 - DNA, 569 bp, Homo sapiens
  misc_feature: GZ8MTXP01A6GY2.19.67.G01.1.454.CMB.2.raw
  modified_base (529)..(529): a, c, t, g, unknown or other
  misc_feature (529)..(529): n is a, c, g, or t
  modified_base (537)..(537): a, c, t, g, unknown or other
  misc_feature (537)..(537): n is a, c, g, or t
  modified_base (546)..(546): a, c, t, g, unknown or other
  misc_feature (546)..(546): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctggggcggtcgtctgagactgtcctgtcgaaccctcgtggggtctccgtcagcagcgactgtattgccgtgggtccgccaggcctccgaggggaagaggccgggagtgggtcgcgtaggttattttagtagggtgggaccgacattcgtacggagaaccttccaagtgggaacggggccattcaccatcctccagacgtacttttcacagaacactactgtactcttacaaatcgaaacacgcctaggacgggccgaggaccgacggccgtctattagttgtgtgtagttagtttagcggngagttggnttgggtgangatcgacggtgggccgaacgggg

SEQ ID NO: 319789 - DNA, 530 bp, Homo sapiens
  misc_feature: GZ8MTXP01CN8ZI.19.67.G01.1.454.CMB.2.raw
  modified_base (249)..(249): a, c, t, g, unknown or other
  misc_feature (249)..(249): n is a, c, g, or t
  modified_base (286)..(286): a, c, t, g, unknown or other
  misc_feature (286)..(286): n is a, c, g, or t
  modified_base (356)..(356): a, c, t, g, unknown or other
  misc_feature (356)..(356): n is a, c, g, or t
  modified_base (383)..(383): a, c, t, g, unknown or other
  misc_feature (383)..(383): n is a, c, g, or t
tcagtactctcgtgcacgaccggtgctcgatttagagtatacatattgggtttgggggtagctcaggaagcagagcctggagcatctccactatggcctgggctccactacttctcaccctcctcgctcactgcacaggttcttgggccaactttatgctgactcagccccactctgtgtcggagtctccgggaagacggtaaccatcttttgcacccacaacagtgcaacattgccagctaattttgngcagtgtaccagcagcgcccggcacgtccccacatgnatcatgagataatacaaaagccgtcgtcggggtccctgactcggtctctcggctcatcgacaagcctccncaactctcgcctccctcaccactctcngactgaagacgtggagacgaggctacgactactacgtgtctagtctatgatagccgcggtcagtgtggtcgtcgggcgggacggccaaaggcttacggttccgttaccgttaaggccaacgccccgaggcctccgcccccgttcggg

SEQ ID NO: 319790 - DNA, 578 bp, Homo sapiens
  misc_feature: GZ8MTXP01BQ8BZ.19.67.G01.1.454.CMB.2.raw
  modified_base (503)..(503): a, c, t, g, unknown or other
  misc_feature (503)..(503): n is a, c, g, or t
  modified_base (524)..(524): a, c, t, g, unknown or other
  misc_feature (524)..(524): n is a, c, g, or t
  modified_base (536)..(536): a, c, t, g, unknown or other
  misc_feature (536)..(536): n is a, c, g, or t
tcagtactctcgtgcacgaccggtgctcgatttagagtatacatattggggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaatggtggagactgggcggaggcttggtccagcctggggcggtctctgagactgtcctgtgaacccctcgtgggggtctccgtcagcagcgactgtattgcctgggtcccgccaggctccgaggggaagagggccgggaggtggggtcgcgtaggttatttttagagggttggggaaccgacatttcgtaacggagaaccttccaagtgggaagggcccgattcaccgatcctccagagtactttctacagtaaaccactactgtctactacaaatcgaacagcctgacgggccaggacacggcccgtntattatgtgtgagttagttanggtgagttgggngttggtaagagaagtactcgacggtcggggaaccgtaacggg

SEQ ID NO: 319791 - DNA, 582 bp, Homo sapiens
  misc_feature: GZ8MTXP01D4OYP.19.67.G01.1.454.CMB.2.raw
  modified_base (523)..(523): a, c, t, g, unknown or other
  misc_feature (523)..(523): n is a, c, g, or t
  modified_base (550)..(550): a, c, t, g, unknown or other
  misc_feature (550)..(550): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtgggtggagacgtgggcggaggcttggtccagcctggggcggtctctgagactgtcctgtcgaaccctcgtggggtctcgtcagcagcgactgtattgcctgggtccgccaggctccgaggggaagagggccggagtgggtcgcgtaggttatttttagaggtgggaccgacattcgtacggagaactccaagtgggagggccgattcgaccatctccagacgtactttctcaagaaacacacttgtactcttacaaattcgaaacgacgcccgtggacggggccgaggaccacgggccgtctattattgtgtgagttgtttagngggcgtagttgggcttggggtggacgngtatcgacgtcgggggaacccgtaaccggggg

SEQ ID NO: 319792 - DNA, 561 bp, Homo sapiens
  misc_feature: GZ8MTXP01E3LNR.19.67.G01.1.454.CMB.2.raw
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctgggcggtctctgagactgtcctgtgaaccctctggggtctccgcagcagcgactgtatgcctgggtccgccaggctccaggggaagaggccggagtgggtcgctaggtatttttagtaggtgggacgacattctaaacgggagaactccagtgggagggccgattcaccatctccagagtacttttctacaagaacacaactgttctactttaccaaaattcgaaaacagaccctagggaacggggcccgaagggaaccacgggccgtactattattgtgttgagttagtttatggcgattgggctgggtgacagatcgaagtcgggg

SEQ ID NO: 319793 - DNA, 632 bp, Homo sapiens
  misc_feature: GZ8MTXP01EEAA9.19.67.G01.1.454.CMB.2.raw
  modified_base (393)..(393): a, c, t, g, unknown or other
  misc_feature (393)..(393): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtgggcggaggcttggtccagccgtgggcggtctctgagactgtcctgtcgaaccctcgtggggtctccgtcagcagcgactgtatgccgtgggtccgccaggctccgaggggaagaggccgggaggtcgggtcgcgtaggttatttttagagggtgggaccgactattcgtacggagaacctccngtgggagggcccgattccgaccatctaccagtagtacttttcactaacgaaacactactgtcttacttacaaatcgaaacgacgtaccgtagggacgggacccggaagggaccgtacgggtaccgttaccttaatttaagtttggtggtaaggtaggttaggtttagttgggtacgtagttcgggcgttggggttgggactaaggaacttcgacggttcgggggcccgtaaaccggggg

SEQ ID NO: 319794 - DNA, 584 bp, Homo sapiens
  misc_feature: GZ8MTXP01CB7TP.19.67.G01.1.454.CMB.2.raw
  modified_base (390)..(390): a, c, t, g, unknown or other
  misc_feature (390)..(390): n is a, c, g, or t
  modified_base (430)..(430): a, c, t, g, unknown or other
  misc_feature (430)..(430): n is a, c, g, or t
  modified_base (524)..(524): a, c, t, g, unknown or other
  misc_feature (524)..(524): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtgggcggaggcttgggtccagccgtggggcggtctctgagactgtcctgtcgaaccctcgtggggtctccgtcagcagcgactgtattgcctgggtccgccaggctccgaggggaagaggccggaggtgggtcgcgtaggttattttagtagggtggaccgacattcgtacggagaactccngtcgggagggccgattcgaccatctccagtacgactttcncaacgaacacactgtctcttacaaatgaacagaccgtgacgggccgaggaccgacggtaccgttctagttattggtgtggtaagttgtttaagnggtcgtagttgggttcgttgggttggacgaagagtcgacggtcggggccgtaaccggggg

SEQ ID NO: 319795 - DNA, 599 bp, Homo sapiens
  misc_feature: GZ8MTXP01CXH4T.19.67.G01.1.454.CMB.2.raw
  modified_base (420)..(420): a, c, t, g, unknown or other
  misc_feature (420)..(420): n is a, c, g, or t
  modified_base (548)..(548): a, c, t, g, unknown or other
  misc_feature (548)..(548): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtgggcggaggcttggtccagccgtgggcggtctcgtgagactgtccctgtcgaccctcgtggggtctccgcagcagcgactgtatgcctgggtccgccaggcctccgaagggaaggagggcccgggaggtcgggtcgcgtagggttatttttagaggtggggacgacagttcgtaacgggagcgtccagtgggacggccgattcaccntctccagacgtacttttcacacgtaacactactgtcctacttacaaagtcgaaactagcccgtaggacggggccgaggaaccacgggtccgttactagtttagttgttggttagtagttagttttagnggttacgttgttggtcgtagggtcgacgtaggactcggaacggtccggggg

SEQ ID NO: 319796 - DNA, 627 bp, Homo sapiens
  misc_feature: GZ8MTXP01C4VLG.19.67.G01.1.454.CMB.2.raw
  modified_base (444)..(444): a, c, t, g, unknown or other
  misc_feature (444)..(444): n is a, c, g, or t
  modified_base (569)..(569): a, c, t, g, unknown or other
  misc_feature (569)..(569): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactgggtggagactgggcggaggcttggtccaggccgtggggcggtctctgagactgtcctgtcgaaccctctggggtctccgtcagcagcgactgtattgccgtgggtcccgccaggctccgaggggaagaggccggaggtgggtcgcgtaggttattttagtagggtgggaccgactattcgtacggagaacctccgaagtgggacggggccgtattcgacctatcctcccagtacgtacttttacnctaaacgaaactacacttacgtcttaccttactaaaattcgaaacgacgccgtaggacggggacccgaaggaccgacgggtacccgttactaagtttagtggttgttaaggtagttaggtttagngggtcgtagttgggcttgggtaaggacaagaactcgacggtcggggcgtaacccgggg

SEQ ID NO: 319797 - DNA, 586 bp, Homo sapiens
  misc_feature: GZ8MTXP01EVB6F.19.67.G01.1.454.CMB.2.raw
  modified_base (383)..(383): a, c, t, g, unknown or other
  misc_feature (383)..(383): n is a, c, g, or t
  modified_base (528)..(528): a, c, t, g, unknown or other
  misc_feature (528)..(528): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgcaacgtgggtggagacgtgggcggaggcttggtccagcctggggcgtctctgagactgtcctgtcgaaccctcgtggggtctcgtcagcagcgactgtattgcctgggtccgcaggctccgaggggaagaggccggaggtgggtcgcgtaggttattttagagggtgggaccgactagttcgacggganaactccaagtgggacgggccgtattccgaccagtcctaccaagtacgtactttctacaagaaacactactgtctacttacaaatgaaacagccgtaggacgggccgaggacacggccgtctagttattgtgtgagttagtttagnggcgtagttgggcgttgggtggactaaggactcgacggtcgggggcccgaaccggggg

SEQ ID NO: 319798 - DNA, 583 bp, Homo sapiens
  misc_feature: GZ8MTXP01EERRS.19.67.G01.1.454.CMB.2.raw
  modified_base (499)..(499): a, c, t, g, unknown or other
  misc_feature (499)..(499): n is a, c, g, or t
  modified_base (552)..(552): a, c, t, g, unknown or other
  misc_feature (552)..(552): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactgggtggagacgtgggcggaggcttggtccagcctggggcgtctctgagactgtcctgtcgaaccctcgtggggtctccgtcagcagcgactgtattgcctgggtccgccaggctccgagggaagaggccggaggtgggtcgcgtaggttattttagaggtgggaccgactattcgtacggagaactccaagtgggacgggccgattcaccatctaccagtacgtacttttctcaagtaaaccactactgtctacttacaaatcgaacagccgtagacgggaccgaggacacggtaccgttntattagttgtggtaagtagttagtttagttgggtagagttggcgttggtgganaaggtatcgacggtcggggccgtaaccgggg

SEQ ID NO: 319799 - DNA, 556 bp, Homo sapiens
  misc_feature: GZ8MTXP01BA8AO.19.67.G01.1.454.CMB.2.raw
  modified_base (380)..(380): a, c, t, g, unknown or other
  misc_feature (380)..(380): n is a, c, g, or t
  modified_base (491)..(491): a, c, t, g, unknown or other
  misc_feature (491)..(491): n is a, c, g, or t
  modified_base (536)..(536): a, c, t, g, unknown or other
  misc_feature (536)..(536): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctgggcggtctctgagactgtccctgtgaaccctctggggtctccggcagcagcgactgtattgcctgggtccgccaggctccgagggagaggcccggaggtgggtcgcgtaggtatttttagagggtgggacgacattctaacggganctccgaatgggagggccattcaccatctccagagacttttctacagtaacacactgtactcttacaaagtcgaacagacctggacgggccgagggacacggccgtctattntgtgttgtagttgtttagtggcgagttgggcgtgggtggaaccgngacgtcgaacggtccggggg

SEQ ID NO: 319800 - DNA, 583 bp, Homo sapiens
  misc_feature: GZ8MTXP01CV134.19.67.G01.1.454.CMB.2.raw
  modified_base (371)..(371): a, c, t, g, unknown or other
  misc_feature (371)..(371): n is a, c, g, or t
  modified_base (432)..(432): a, c, t, g, unknown or other
  misc_feature (432)..(432): n is a, c, g, or t
  modified_base (501)..(501): a, c, t, g, unknown or other
  misc_feature (501)..(501): n is a, c, g, or t
  modified_base (528)..(528): a, c, t, g, unknown or other
  misc_feature (528)..(528): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactgggtggagactgggcggaggcttgggtccagccgtggggcggtctctgagacctgtcctgtcgaacccctcgtgggggtctccggtcagcagcgactgtattgcctgggtccgcaggctccgaggggaagaggccggagtgggtcgcgtaggttattttagaggtggaccganagttcgtacggagaactccaagtgggagggccgattcacctatcctccagagtacttttcncaagaaccacactgtactcttacaaattgaacacgtccgtggacgggacccgaggaccgaccggccgtntattagtgtgtgagttagtttagcggngtagttgggcgttgggtgggaactaagcgtacgacggtcggggaaccgtaacggg

SEQ ID NO: 319801 - DNA, 555 bp, Homo sapiens
  misc_feature: GZ8MTXP01BLXUA.19.67.G01.1.454.CMB.2.raw
  modified_base (416)..(416): a, c, t, g, unknown or other
  misc_feature (416)..(416): n is a, c, g, or t
  modified_base (467)..(467): a, c, t, g, unknown or other
  misc_feature (467)..(467): n is a, c, g, or t
  modified_base (498)..(498): a, c, t, g, unknown or other
  misc_feature (498)..(498): n is a, c, g, or t
  modified_base (525)..(525): a, c, t, g, unknown or other
  misc_feature (525)..(525): n is a, c, g, or t
tcagtactctcgtgcacgaccggtgctcgatttagagtatacatattgggtttgggggggagaggagcccagcactgggattccgaggtgtttccattcggtgttcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccgagggagaggccggagtgggtcgcgtaggtatttttagtagggtgggacgacattctacggagactcccatgggagggccgattcaccatctccagagtacttttcncagaacacactagtctcttacaaatgaacaggcctggagggccgaggaccncggccgtctattattgtgtgaagtgtttagngggcgagtgggcgttgggcgaacaggntcgacggttgggggccaaggggtaaccccg

SEQ ID NO: 319802 - DNA, 736 bp, Homo sapiens
  misc_feature: GZ8MTXP01EUDCN.19.67.G01.1.454.CMB.2.raw
  modified_base (275)..(275): a, c, t, g, unknown or other
  misc_feature (275)..(275): n is a, c, g, or t
  modified_base (278)..(278): a, c, t, g, unknown or other
  misc_feature (278)..(278): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacccgggttttccttgctgcaatttcaggaggtgtccagtgtgaggtgcaactggtggagacgtggcggaggcttggtccagccgtgggcggtctctgagactgtcctgtaccgctcgtcgtcgtcgtcngcncgcgcgtcgtacgtcgtccggtccggtccgccgacggtaccgtacggaacggggaacgggacgggacgggtacgggtacgggtacggtacggttaggtttaaggtttaacggttacgggtacgggtacggtacgtacgtacgtacggtaaacgtaccgtcgtacggtacgggacgggtacgtacgtactactactacctacgtaacgtacgttacgttactaacgtaaacgtaactaacctacgtacgttacttaacttaaactaaacgtaaacggtaacgtaacggtaccggtaacgggaaccgggaaccggaaccggaaccggtaccggtaccgttacgttaacgttacgttggttaaggtaaggttaaggttaggttaggtacggtacggttacggttcggttacggtaaggtaggtaacgtacgtacgttacgtaacggttaacgggtaacggg

SEQ ID NO: 319803 - DNA, 614 bp, Homo sapiens
  misc_feature: GZ8MTXP01BJ0YF.19.67.G01.1.454.CMB.2.raw
  modified_base (548)..(548): a, c, t, g, unknown or other
  misc_feature (548)..(548): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtgggcggaggcttggtccagccgtgggcggtctctgagactgtcctgtcgaaccctcgtggggtctccgtcagcagcgactgtatgccgtgggtccgccgaggctccgaggggaagagggccggaggtgggtcgcgtaggttattttagagggtgggaccgactattcgtacggagaacctccaagtgggaacggggcccgtaagttccaaccctatcctacccaagtacgtacttttctacaagaaccactactcgtcttacttacaaatacgaacgagtccgtaggacgggccgaggacgacggtccgtactattagttgtgtgtagttagtttagnggtcgtagttgggcgttgggtggacgtaagtacgtcgacggttcgggggaacccgtaacccggggg

SEQ ID NO: 319804 - DNA, 628 bp, Homo sapiens
  misc_feature: GZ8MTXP01CJSRL.19.67.G01.1.454.CMB.2.raw
  modified_base (437)..(437): a, c, t, g, unknown or other
  misc_feature (437)..(437): n is a, c, g, or t
  modified_base (553)..(553): a, c, t, g, unknown or other
  misc_feature (553)..(553): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttcctgctgcaatttcaggagtgtccagtgtgaggtgcaacgtggtggagacgtgggcggaggcttggtccagccgtgggcggtctctgagactgtcctgtcgaccctcgtggggtctccgtcagcagcgactgtattgcctgggtccgccgaggctccgaggggaagaggccggagtgggtcgcgtaggttattttagaggtggaccgactagttcgtacggagaacctccgaagtgggaacgggccgtagttccacctatcctaccgagaggtacttttcnctaacgaacactactgtcttacttacaaattcgaacgacgtacccgtagggacgggaccgaaggacccgacgggtacctcttaattagtttgtggtaagtaaggttagttttaagngggtacgtaagttgggcgttaggggtaaggaaccgaaggtacgtcggacggttcgggggcccgtaaacccggggg

SEQ ID NO: 319805 - DNA, 595 bp, Homo sapiens
  misc_feature: GZ8MTXP01AX2JA.19.67.G01.1.454.CMB.2.raw
  modified_base (180)..(180): a, c, t, g, unknown or other
  misc_feature (180)..(180): n is a, c, g, or t
  modified_base (245)..(245): a, c, t, g, unknown or other
  misc_feature (245)..(245): n is a, c, g, or t
  modified_base (320)..(320): a, c, t, g, unknown or other
  misc_feature (320)..(320): n is a, c, g, or t
  modified_base (591)..(591): a, c, t, g, unknown or other
  misc_feature (591)..(591): n is a, c, g, or t
  modified_base (593)..(593): a, c, t, g, unknown or other
  misc_feature (593)..(593): n is a, c, g, or t
  modified_base (595)..(595): a, c, t, g, unknown or other
  misc_feature (595)..(595): n is a, c, g, or t
tcagtactctcgtgcacgaccggtgctcgatttagagtatacatattgggcttggtccagcctgggcggtcgtctgagactgtcctgtgaaccctctggggtctccgtcagcagcgactgtattgcctgggtccgccaggctccagggaagaggccggagtgggtcgcaggtatttttanaggtgggacgacattctacggagactccatggagggccgattcaccatctccagagactttttcncagaacacactgtctcttcaaatgaacagcctgagggccaggacacggccgtctattatgtgtgagagttttagnggcgagtggcgtgggtaggacagactcgaccggtcgggggaccaacggggtaccctggtacccacccgtctccctacgacgtcccctaccgaccgaacgggccctacgttcccgtcccttccccgcggcccgcccgtacgcctccgaggaccgtccgaccgtaccgacgacggacgacgacgccggcccgtcggcgtcgtccgtcggtacgaacgtaccgtacctcccgacgagacgttacgtcgcggcggcgcggcgacggcgcgagagngngn

SEQ ID NO: 319806 - DNA, 587 bp, Homo sapiens
  misc_feature: GZ8MTXP01AQAKE.19.67.G01.1.454.CMB.2.raw
  modified_base (408)..(408): a, c, t, g, unknown or other
  misc_feature (408)..(408): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctggggcggtctctgagactgtcctgtgaccctctggggtctccgtcagcagcgactgtattgcctgggtccgccaggctccgaggggaagaggcggaggtgggtcgcgaggtagtttttatagggtgggaccgacattcgtacggagaactccctgtgggagggccgattcgaccatcnccctagacgtactttctacagaacacgactcgtcttcttacaaattagaacgacgccgtagacggggccgaggaccgacggacccgtctacgtttattaggtgtggagttaggtttaattgggcgtagttgggcgttagggtggacgaagagtacgacggtcggggcgtaacccggggg

SEQ ID NO: 319807 - DNA, 614 bp, Homo sapiens
  misc_feature: GZ8MTXP01BL3PQ.19.67.G01.1.454.CMB.2.raw
  modified_base (553)..(553): a, c, t, g, unknown or other
  misc_feature (553)..(553): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctggggcggtctctgagactgtcctgtcgaaccctcgtggggtctccgtcagcagcgactgtattgccgtgggtccgccaggctccgagggggaagaggccgggaggtgggtcgcgtaggtttattttagagggtgggaccgtactagttcgtacggagaacctccgaagtgggacgggcccgtattcgacctatcctaccagtacgtacttttcacagaaacactactcgtcctacttacaaaatcgaaacacgtccgtgggaacggggccgaaggaccgacgggtccttactagtttattgtggtaagtaggttagttttagngggacgtagttggcgttgggtaaggacaaggtactcgacggttcgggggccgaaccggggg

SEQ ID NO: 319808 - DNA, 612 bp, Homo sapiens
  misc_feature: GZ8MTXP01CW4FE.19.67.G01.1.454.CMB.2.raw
  modified_base (562)..(562): a, c, t, g, unknown or other
  misc_feature (562)..(562): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagccgtgggcggtctctgagactgtcctgtgaaccctcgtggggtcctccgtcagcagcgactgtatgcctgggtccgccaggctccgagggaagaggccgggaggtgggtcgcgtaggttatttttagtagggtgggacgacgtattcgtaaacgggagaactccgaagtcgggacgggccgacttccgaccctatctcccagtacgtacttttcactaacgaaccacacttgtccttacttaccaaagtcgaaacgtacgccgtaggacgggaccgaacgggaaccgaccgggtccgtacgtagtttaagttggtgttgtagttagtttagnggttcgttagttgggtcgtgggtggacaggactcgaacggtaaccggggg

SEQ ID NO: 319809 - DNA, 566 bp, Homo sapiens
  misc_feature: GZ8MTXP01B7VFQ.19.67.G01.1.454.CMB.2.raw
  modified_base (516)..(516): a, c, t, g, unknown or other
  misc_feature (516)..(516): n is a, c, g, or t
  modified_base (541)..(541): a, c, t, g, unknown or other
  misc_feature (541)..(541): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtgggcggaggcttgggtccaggccgtggggcggtctctgagactgtcctgtgaacccctctgggggtctccgtcagcagcgactgtatgcctgggtccgccaggctccagggaagaggccggaggtgggtcgcgaggtatttttagtaggtgggaccgacattcgtacgggagaaccttcccaatgggagggcccgattccaccgaatctcccagagtacttttctcagtaaacacactgtctcttcaaatgaacagcctggacgggccgaggaccacggccgtctatattggtgtgagttagtttangggacgtagttggcttgggtggacnggatcgacgtggggccgaaccgggg

SEQ ID NO: 319810 - DNA, 581 bp, Homo sapiens
  misc_feature: GZ8MTXP01AD4QR.19.67.G01.1.454.CMB.2.raw
  modified_base (434)..(434): a, c, t, g, unknown or other
  misc_feature (434)..(434): n is a, c, g, or t
  modified_base (528)..(528): a, c, t, g, unknown or other
  misc_feature (528)..(528): n is a, c, g, or t
  modified_base (553)..(553): a, c, t, g, unknown or other
  misc_feature (553)..(553): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctggggcggtctctgagactgtcctgtcgaaccctctggggtctccgtcagcagcgactgtatgccgtgggtccgccaggctccgagggggaagagggccgggaggtggggtcgacgtagggttatttttagtaggggtggggaccgacatttcgtacggagactccaagtgggagggccgattcacatcctccagagtactttcncagtaaccacactgtactcttacaaatggaaacagccctggacggggccgaggcgaacggccgtctacttattggtgtaagtagttagtttagnggtcgagttgggcttggggtggacnggactcgacgtggggccgtaaccggggg

SEQ ID NO: 319811 - DNA, 633 bp, Homo sapiens
  misc_feature: GZ8MTXP01EVCQP.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgcaacgtggtggagacgtgggcggaggcttggtccaggccgtggggcggtctctgagactgtcctgtcgaaccctcgtggggtctccgtcagcagcgactgtatgccgtgggtcccgcgaggatccgaggggaagaggccgggagtgggtcgcgtaggttattttagagggtgggacgactattcgtacggagaactccgaagtgggacgggccgtagttccaaccatcctaccagacgtacttttcacaagaaacactaactcgtcctacttacaaatgaaacgagtcccgtagggacggggaccggacggaccgacgggtaccgttcttaagtttagttggtgtaaggtaagttaggtttagttcgggcgtaagttgggcgttggggtaaggactaaggtagtcggttaacgggtcggggaacccggtaacccggggg

SEQ ID NO: 319812 - DNA, 629 bp, Homo sapiens
  misc_feature: GZ8MTXP01CFPDY.19.67.G01.1.454.CMB.2.raw
  modified_base (402)..(402): a, c, t, g, unknown or other
  misc_feature (402)..(402): n is a, c, g, or t
  modified_base (482)..(482): a, c, t, g, unknown or other
  misc_feature (482)..(482): n is a, c, g, or t
  modified_base (595)..(595): a, c, t, g, unknown or other
  misc_feature (595)..(595): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtgggcggaggcttggtccagccgtggggcggtctctgagactgtcctgtcgaccctcgtgggtctccgtcagcagcgactgtattcgccgtgggtcccgccaggctccgaggggaagacgggccgggaggtgggtcgcgtaggtttatttttagagggtgggaacccgactagttcgtacggagaaccttccgngtcggggacgggccgattccacctatcctccagtacgtactttcacagaacacactgtacctcttaacaaatcgaaacgnggtccgtaggacggggaccgaacgggaccgaccgggtcccgttagttacgttagtttggtgttaaggaagttagggtttattgggtcgtagttcgggcgttgggtggtaacgngtacgtcggacggtcgggggccgtaacccggggg

SEQ ID NO: 319813 - DNA, 575 bp, Homo sapiens
  misc_feature: GZ8MTXP01B8IA1.19.67.G01.1.454.CMB.2.raw
  modified_base (237)..(237): a, c, t, g, unknown or other
  misc_feature (237)..(237): n is a, c, g, or t
  modified_base (424)..(424): a, c, t, g, unknown or other
  misc_feature (424)..(424): n is a, c, g, or t
  modified_base (427)..(427): a, c, t, g, unknown or other
  misc_feature (427)..(427): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacatttcnccacctccaagaacaaaacttctagcctggtaccaacagagaccaggacagcctcctaagttcgctcatttactgggtcttctacgcgcgaacgttccggggtccctgaccccggacgttccgggggcaggccgggtctgggaactagactttcgactctcaccatcagcagcctgcaggctagagntgnggactagtttatactgtacagtctaaatttcttttctactccgttccggtggtaccgttcggaaccgtaaggggacccaggggttacgaaaactccgaaggaccgttaaacgtggtcggaacttcggccttaacctaacgttcgttcg

SEQ ID NO: 319814 - DNA, 585 bp, Homo sapiens
  misc_feature: GZ8MTXP01BS9ZY.19.67.G01.1.454.CMB.2.raw
tcagtactctcgtgcacgaccggtgctcgatttagagtatacatattgggtttggggtctgggagaggagcccagcactgggattccgaggtgtttccattcggtgctcagcactgaacacagaggactcaccatggagtttggctgacctgggttttccttgctgcaatttcaggaggtgtccagtgtgaggtgcaactgggtggagacgtgggcgggaggcttgggtccaggccctggggcgtctctgagactgtcctgtgaaccctcgtggggtctccgtcagcagcgactgtattgcctgggtccgccaggctccgagggagaggccgggagtgggtcgctaggttatttttagtaggtgggacgacattcgtaaacgggagaactccagtcgggagggtccgattcgaccagtctccagtacgacttttctacagaacacactgtctacttacaaagttagaacagccctggacgggccggaggaccgacggtccgttcgttattcgttggtgttggtagttaggtttaagtgggcgttagttgggcgtgggtggacgaggacttcgaacggtccggggg

SEQ ID NO: 319815 - DNA, 632 bp, Homo sapiens
  misc_feature: GZ8MTXP01DROB7.19.67.G01.1.454.CMB.2.raw
tcagtactctcgtgcacgaccggtgctcgatttagagtatacatattggggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttgggtccagcctggggcggtctctgagactgtcctgtgaacccctctgggggtctccgtcagcagcgactgtattgccgtgggtccgccaggctccgaggggaagagggccggagtggggtcgcgtaggttatttttagtaggtgggtaccgactattcgtacggagaactccaagtggagggccgatcacatctccagagtactttctcaagtaaacactaactgtactcttacaaaattgaaacagtacccgtggaacggggacccgaagggacctacgggtccgtactaatttaagttgtggttgtaagttaggttttaagttcgggtacgtaagttcggggcttgggggttgggaacgaaggtaagttccggaaacggttcggggggaaccccgtaaaacccgggggg

SEQ ID NO: 319816 - DNA, 546 bp, Homo sapiens
  misc_feature: GZ8MTXP01DKZQF.19.67.G01.1.454.CMB.2.raw
  modified_base (378)..(378): a, c, t, g, unknown or other
  misc_feature (378)..(378): n is a, c, g, or t
  modified_base (530)..(530): a, c, t, g, unknown or other
  misc_feature (530)..(530): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctggggcggtctcgtgagactgtcctgtgaaccctctggggtctccgtcagcagcgactgtattgcctgggtcccgccaggctccgaggggaagaggccggagtgggtcgcaggtattttagaggtgggacgacattctaacggganctccatggagggccgattcacccatctccagagtacttttcactagaacacactgtctcttacaaattgaaacagccctggagggcccgaaggacaacggccgtcgtattagttgtgttgagttagtttagtggcgagttggctggtggacngatcgaacgtcggggg

SEQ ID NO: 319817 - DNA, 597 bp, Homo sapiens
  misc_feature: GZ8MTXP01AQ3IK.19.67.G01.1.454.CMB.2.raw
  modified_base (218)..(218): a, c, t, g, unknown or other
  misc_feature (218)..(218): n is a, c, g, or t
  modified_base (247)..(247): a, c, t, g, unknown or other
  misc_feature (247)..(247): n is a, c, g, or t
tcagtactctcgtgcacgaccggtgctcgatttagagtatacatattgggtttgggggtagctcaggaagcagagcctggagcatctccactatggcctgggctccactacttctcaccctcctcgctcactgcacaggttcttgggccaactttatgctgactcagccccatctgtgtcggagtctccgggaagacggtaaccatctttgcacccanaacagtggcaacattgccagctaatttgngcagtgtaccagcagcgccgggcacgtccccacattgtgatctatgagataatcaaagaccgtctcgggggtcctgactcggttctcgtcggctcatcgacaagcctcctcaactctcgcctccctcaccctatcctcgtggacctaggaaacgtaccgtaggaacgggaccgagggcctacgaaccttaccgtaacggttcgtacgtaggttaccttaagtcgagttacgcccggtcggtctagttcggttcggtccgttcggggacgggaacggaccgtaaaggtccgttacgccccgttcgtaacgggtccaacggcccgaacgggttccctccggcccccgttcgg

SEQ ID NO: 319818 - DNA, 609 bp, Homo sapiens
  misc_feature: GZ8MTXP01EVP5X.19.67.G01.1.454.CMB.2.raw
  modified_base (552)..(552): a, c, t, g, unknown or other
  misc_feature (552)..(552): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtgggcggaggcttggtccagcctgggcgtctctgagactgtcctgtcgaaccctcgtggggtctccgtcagcagcgactgtattgcctgggtccgccaggctccgaggggagacggccggaggtggggtcgcgtaggttattttagtagggtgggaccgacgtagttcgtacgggagaacgttccaagtcgggaggggcccgagttcaccatcctaccagacgtactttctacagtaaacactaactcgtcttcttacaaatcgaacgacgccgtggacggggaccgacggacgacggccgtctagttatcgtgtggtagttagtttagttggcgtagttgggngttggggtggaccgtaaggtacgttacggaccggttcgggggcccgtaacccggggg

SEQ ID NO: 319819 - DNA, 604 bp, Homo sapiens
  misc_feature: GZ8MTXP01AT8QN.19.67.G01.1.454.CMB.2.raw
  modified_base (398)..(398): a, c, t, g, unknown or other
  misc_feature (398)..(398): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtgggcggaggcttggtccaggcccgtggggcggtctctgagactgtcctgtcgaaccctcgtggggtctccgtcagcagcgactgtattgccgtgggtccgccgaggctccgaggggaagagggccgggaggtgggtcgcgaggtttatttttagagggtgggaccgacattcgtacggagaactccgngtcgggagggccgagttcaccatctccagtagtactttcacaagaaccactactgtcttacttacaaatcgaaacgcgccgtaggacgggaccgaggaccgaccgggccgttcctagtttagttggttggtaagtagttagtttagttgggcgtagttgggcgttgggtggacgaagacgtcgacggtcggggccgtaacccgggg

SEQ ID NO: 319820 - DNA, 619 bp, Homo sapiens
  misc_feature: GZ8MTXP01AKKFB.19.67.G01.1.454.CMB.2.raw
  modified_base (567)..(567): a, c, t, g, unknown or other
  misc_feature (567)..(567): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctggggcgtctctgagactgtcctgtcgaccctcgtggggtctccgtcagcagcgactgtattgcctgggtccgccaggctccgaggggaagagggccgggagtgggtcgcgtaggttatttttagtagggtgggaccgacattcgtacggagtaacctccgaagtgggacgggccgagttccaccagttcctccagtagtacttttctacaagaacactactcgttacttcctttacaaaattcgaaaccgtacgacccgttagggaacgggggacccgaacgggaaccgaccgggtcccggttcttaagtttagttgtggtaagtagttagtttagngggtgagttggcgttgggtggacaagactcgacggtcggggccgaaccgggg

SEQ ID NO: 319821 - DNA, 622 bp, Homo sapiens
  misc_feature: GZ8MTXP01DR5SG.19.67.G01.1.454.CMB.2.raw
  modified_base (249)..(249): a, c, t, g, unknown or other
  misc_feature (249)..(249): n is a, c, g, or t
  modified_base (326)..(326): a, c, t, g, unknown or other
  misc_feature (326)..(326): n is a, c, g, or t
  modified_base (348)..(348): a, c, t, g, unknown or other
  misc_feature (348)..(348): n is a, c, g, or t
  modified_base (430)..(430): a, c, t, g, unknown or other
  misc_feature (430)..(430): n is a, c, g, or t
  modified_base (617)..(617): a, c, t, g, unknown or other
  misc_feature (617)..(617): n is a, c, g, or t
  modified_base (619)..(619): a, c, t, g, unknown or other
  misc_feature (619)..(619): n is a, c, g, or t
  modified_base (621)..(621): a, c, t, g, unknown or other
  misc_feature (621)..(621): n is a, c, g, or t
tcagtactctcgtgcacgaccggtgctcgatttagagtatacatattgggcttggtccagcctgggcggtctctgagactgtcctgtgaaccctctggggtctccgtcagcagcgactgtattgcctgggtccgccaggctccagggaagaggccggagtgggtcgcaggttattttttatagggtgggacgacatttctacggagactccatggagggccgattcaccatctccagagtactttttcncagaacacactgtctcttcaaatgaacagcctggagggccgaggacacggccgtctattattgtgtgagtagtttanggcgatgggctgggtggacagntcgacgtggggaccagggaaccctggtaccaccgtctcctcacgccctccgacgaacgggcccagtccggtccttcccccgnggccgccctgcctccgacggacgccaccctaccgacgacggaccacgacggcccgggcccgtggggcctcggcccgttcggggttaccaaacgggtaccttaacccgttaaccccgaacggacgtaacggttaaccgtcggaacgggccggggttcgacggggcccgaaagggccgacgagttaggngngng

SEQ ID NO: 319822 - DNA, 577 bp, Homo sapiens
  misc_feature: GZ8MTXP01ELNND.19.67.G01.1.454.CMB.2.raw
  modified_base (357)..(357): a, c, t, g, unknown or other
  misc_feature (357)..(357): n is a, c, g, or t
  modified_base (387)..(387): a, c, t, g, unknown or other
  misc_feature (387)..(387): n is a, c, g, or t
  modified_base (521)..(521): a, c, t, g, unknown or other
  misc_feature (521)..(521): n is a, c, g, or t
  modified_base (550)..(550): a, c, t, g, unknown or other
  misc_feature (550)..(550): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtgggcggaggcttggtccagccgtggggcgtctctgagactgtcctgtcgaacccctctgggggtctccgtcagcagcgactgtattgcctgggtccgccaggctccgaggggaagaggccggaggtgggtcgcgtaggttatttttanaggtgggaccgacatctacggagaactccntgggagggccgattccgaccagtctacccagtagtactttctactagaaacacaactgtacttcttacaaatgaaacagcctggacgggccgacggacgacggccgtctagtttatgtgtgtaagttgtttaangggtcgagttgggcgttgggtggacaagnttcgacggtggggcccgtaaccggggg

SEQ ID NO: 319823 - DNA, 518 bp, Homo sapiens
  misc_feature: GZ8MTXP01DKIQH.19.67.G01.1.454.CMB.2.raw
  modified_base (318)..(318): a, c, t, g, unknown or other
  misc_feature (318)..(318): n is a, c, g, or t
  modified_base (406)..(406): a, c, t, g, unknown or other
  misc_feature (406)..(406): n is a, c, g, or t
  modified_base (419)..(419): a, c, t, g, unknown or other
  misc_feature (419)..(419): n is a, c, g, or t
  modified_base (478)..(478): a, c, t, g, unknown or other
  misc_feature (478)..(478): n is a, c, g, or t
  modified_base (515)..(515): a, c, t, g, unknown or other
  misc_feature (515)..(515): n is a, c, g, or t
  modified_base (517)..(518): a, c, t, g, unknown or other
  misc_feature (517)..(518): n is a, c, g, or t
tcagtactctcgtgcacgaccggtgctcgatttagagtatacatattgggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagacttttctcagaacacactgtctcttcaaatgaacagcctgagggccgaggacacggccgtctattattgtgtgagagtttanggcgatgggctggtgacagatcactggggcagggaccctggtccacgtctcctcagccctccacaagggcccatcgtctcccctggcnccctgctcaggcncacctccgagagggcacgacgccggccctggggctgcctggtcaaggcctcttcccagngacgcgtggacgcgggcttgggcaaggcgcagttagngnn

SEQ ID NO: 319824 - DNA, 649 bp, Homo sapiens
  misc_feature: GZ8MTXP01AVSTS.19.67.G01.1.454.CMB.2.raw
  modified_base (393)..(393): a, c, t, g, unknown or other
  misc_feature (393)..(393): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtgggcggaggcttggtccagcctggggcgtctctgagactgtcctgtcgaaccctcgtggggtctccgtcagcagcgactgtattcgccgtgggtcccgccgaggctccgaggggaagagggccggaggtgggtcgcgtaggttattttagagggtgggaccgacattcgtacggagaacttccngtgggagggccgattccgaccatcctccagtacgtacttttcacaagaaaccacactgtctacttacaaatacgaaacgacgtccgtggacggggaccgacggaccgaccgggtacccgtcgttaagtttagttggtggttaaggtaaggttaggttttaagttcggggtacggtaagttcggggttacgttggggttaagggacgtaagggtacttaccggaacgggttcggggggaaccccgtaaacccggggg

SEQ ID NO: 319825 - DNA, 806 bp, Homo sapiens
  misc_feature: GZ8MTXP01DHOYO.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactgggtggagacgtgggcgggaggcttggtccaggccgtgggcggtctcgtgagactgtcctggtcgaaccctcgtggggtctccgtcagcagcgtactgtagttcgccgtgggtcccgccgacgggcctacccggaagggggaaacggacggggcccgggggtaagggttcgggggttccggacgttaaggggttttaagtttttaaggtaggggttaggggaaccccgtactagtttccgtaacgggagtaaaccttccgaaggttcggggaacggggtacccgtaacttccgaacctacgtccgtaccctaaagtacgttacttttactacgtaaacgaaactacctaacttcggttaccttaccttaactaaaagttacgaaacggtacggtacccggttacgggaacgggggacccggaaacggggtaccgaacccggggtaacccgttaccgttaagttttaaggttggttaggttaagggtaagggttaaggttttaaggttcgggtacggtaaggttcggggttcggttagggggttaagggaaaccgtaagggttaactcccgggttacgggtaaccggggggaacccgtaaacccggggg

SEQ ID NO: 319826 - DNA, 568 bp, Homo sapiens
  misc_feature: GZ8MTXP01EHQJT.19.67.G01.1.454.CMB.2.raw
  modified_base (523)..(523): a, c, t, g, unknown or other
  misc_feature (523)..(523): n is a, c, g, or t
  modified_base (547)..(547): a, c, t, g, unknown or other
  misc_feature (547)..(547): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctggggcggtctctgagactgtcctgtgaaccctcgtggggtctccgtcagcagcgactgtattgcctgggtccgccaggctccgaggggaagagggccgggaggtggggtcgcgtaggttatttttagagggtgggaccgacattcacggagaactccaagtgggagggccgattcgccatctccagagtacttttctaccaagtaaacactactgtcctcttacaaaatcgaaacagccctaggacgggccgaaggacacggcccgtatattagttgtgtgaagttagtttagnggcgagttggcttgggtgacaagntcgacgtggggccgaacgggg

SEQ ID NO: 319827 - DNA, 635 bp, Homo sapiens
  misc_feature: GZ8MTXP01EVTSP.19.67.G01.1.454.CMB.2.raw
  modified_base (454)..(454): a, c, t, g, unknown or other
  misc_feature (454)..(454): n is a, c, g, or t
  modified_base (477)..(477): a, c, t, g, unknown or other
  misc_feature (477)..(477): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctggggcggtctctgagactgtcctgtcgaccctctggggtctccgtcagcagcgactgtattgcctgggtccgccagggctccgaggggaagagggccgggagtggggtcgcgaggttatttttagagggtggggtaccgactatttcgtaacgggagaaaccttcccgaagttggggaaggggcccgagtttaccaccgtaatccttccagacgtaacttttcncaagaacacactgtctccttaanaaactagaacgacgcgtaggacgggaccgacggaccgaccggtccgttacttaagtttagttggtgtaaggtaagttagtttagttgggtacgtggttcgggttcgttggggtaagacgtaacggtacgtcggacggtccggggaacccggtaacggg

SEQ ID NO: 319828 - DNA, 693 bp, Homo sapiens
  misc_feature: GZ8MTXP01AROTB.19.67.G01.1.454.CMB.2.raw
  modified_base (606)..(606): a, c, t, g, unknown or other
  misc_feature (606)..(606): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtgggcggaggcttggtccagccgtggggcggtctcgtgagactgtcctgtcgaaccctcgtggggtctccgtcagcagcgactgtattcgccgtgggtccgccgaggcctccgaggggaagagggccgggaggtgggtcgcgtaggttattttagtagggtggaccgactagttcgtacggagtaacctccgaagtggggacgggcccgtacgttccaacctactcctaccgagtacgtactttttcgacaagtaaacctactaacgttcgttaccttaccttaacaaaagttcgaaacgtacggtacccgttagggaacggggtcccgaacgggaccgaaccgggtcccgttacttagtttaagttggttggtaaggtaaggttaaggttttaagnggggtacgtaacggttgggttcgttaggggtaacgggaacgaaggtacgtacggaccggttcgggggaaccccggtaaacccggggg

SEQ ID NO: 319829 - DNA, 551 bp, Homo sapiens
  misc_feature: GZ8MTXP01BWSSL.19.67.G01.1.454.CMB.2.raw
  modified_base (470)..(470): a, c, t, g, unknown or other
  misc_feature (470)..(470): n is a, c, g, or t
  modified_base (521)..(521): a, c, t, g, unknown or other
  misc_feature (521)..(521): n is a, c, g, or t
  modified_base (523)..(523): a, c, t, g, unknown or other
  misc_feature (523)..(523): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtgggcggaggcttgggtccagccgtggggcggtctctgagactgtcctgtcgaccctctgggtctccgtcagcagcgactgtattgcctgggtccgccaggctccgagggagaggccgggaggtgggtcgcgtaggttagtttttagtaggtggggacgacgtattacgtaacggagaacgtccagtgggacgggccgagttcaccatctccagacgtactttcactagaacacactgtcttacttacaaagtgtaacngacctgacggccgagacgcgtccgtctattatgtgttgagttgttagtcgngnttggctggtgcgagatcgaacgtcgggg

SEQ ID NO: 319830 - DNA, 610 bp, Homo sapiens
  misc_feature: GZ8MTXP01C6JWX.19.67.G01.1.454.CMB.2.raw
  modified_base (209)..(209): a, c, t, g, unknown or other
  misc_feature (209)..(209): n is a, c, g, or t
  modified_base (281)..(281): a, c, t, g, unknown or other
  misc_feature (281)..(281): n is a, c, g, or t
  modified_base (308)..(308): a, c, t, g, unknown or other
  misc_feature (308)..(308): n is a, c, g, or t
  modified_base (320)..(320): a, c, t, g, unknown or other
  misc_feature (320)..(320): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctggcgggacatcgtgatcgacccagtacccagactcactggctgtgtctcgtgggcgagacggccaanaatcaactgcaggtccagccaagaactatttcaccacctaccaaagaacaaaacttctagcctagaaccaanagacaccgaggacagccctactagtcnctctatttacgnggtcttcgtacgcgtacgtaacgttccggggtccctacggacccccgtacggttccgggggactacggggtccgggtacgtagggaacctaggtactttccactcctacaccgatcgagcacgcctgacgaggtctagaacgtagtgtggtacttagtttatactgtacagtactaatttctttctactccgtcggtgtaccgttcggaaccgtaagggaccgtaggggacgtaaactcggaaacgacgttaacgtgggtacgtcgtacgaccttactaacgttcgttcg

SEQ ID NO: 319831 - DNA, 569 bp, Homo sapiens
  misc_feature: GZ8MTXP01D2SMB.19.67.G01.1.454.CMB.2.raw
  modified_base (534)..(534): a, c, t, g, unknown or other
  misc_feature (534)..(534): n is a, c, g, or t
  modified_base (551)..(551): a, c, t, g, unknown or other
  misc_feature (551)..(551): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccgagggagaggccgggagtgggtcgcgaggtatttttagaggtggggacgacatttctaacgggagaacgtccagttcgggaaggggcccgaattccgaaccctatcctccgagtacgtacttttctcaagtaacacacttgtctacttcaaagtcgaacagccctggacgggcccgaggaccacgggtccgtactattatgtgttgagttagttagtggcgnttgggctgggtcggacngttatcgaacgtcggggg

SEQ ID NO: 319832 - DNA, 615 bp, Homo sapiens
  misc_feature: GZ8MTXP01D64IC.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgcaactgggtggagacgtggcggaggcttggtccagccgtggggcggtctctgagactgtcctggtcgaaccctcgtggggtctccgtcagcagcgactgtattgcctgggtccgccaggctccgaggggaagaggccggaggtgggtcgcgtaggttatttttagagggtgggaccgactattcgtacggagaacctccaagtgggacgggcccgtattccaaccagtctcccaagtagtactttctacaagaaacactaacttcgtcttacttacaaaatcgaaacgacgtccgtaggacggggacccgaacggtacccgacggtcccggttactaagtttagttgtggtaagtaggttagtttagttggcgtagttgggcgttgggtgacaagtctcgacgtcggggccgtaaccgggg

SEQ ID NO: 319833 - DNA, 587 bp, Homo sapiens
  misc_feature: GZ8MTXP01C1I7G.19.67.G01.1.454.CMB.2.raw
  modified_base (379)..(379): a, c, t, g, unknown or other
  misc_feature (379)..(379): n is a, c, g, or t
  modified_base (386)..(386): a, c, t, g, unknown or other
  misc_feature (386)..(386): n is a, c, g, or t
  modified_base (503)..(503): a, c, t, g, unknown or other
  misc_feature (503)..(503): n is a, c, g, or t
  modified_base (533)..(533): a, c, t, g, unknown or other
  misc_feature (533)..(533): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctggggcggtctctgagactgtcctgtcgaaccctcgtggggtctccgtcagcagcgactgtattgcctgggtccgccaggctccgaggggaagaggccgggagtggggtcgctaggttatttttagagggtgggaccgacattcgacgganaactccngtgggagggccgattccgaccagtctccgagagtaacttttcactaagaaacactactgtcctacttacaaatcgaacgagcccgtaggacgggaccggaggaccgacggtcccgtnttacgttatggtgtaagtagttagtttagngggtcgagttggcgttgggtgacgaagtagtcgaacgtcgggccgtaaccgggg

SEQ ID NO: 319834 - DNA, 613 bp, Homo sapiens
  misc_feature: GZ8MTXP01ER2SA.19.67.G01.1.454.CMB.2.raw
  modified_base (205)..(205): a, c, t, g, unknown or other
  misc_feature (205)..(205): n is a, c, g, or t
  modified_base (237)..(237): a, c, t, g, unknown or other
  misc_feature (237)..(237): n is a, c, g, or t
  modified_base (263)..(263): a, c, t, g, unknown or other
  misc_feature (263)..(263): n is a, c, g, or t
  modified_base (356)..(356): a, c, t, g, unknown or other
  misc_feature (356)..(356): n is a, c, g, or t
  modified_base (372)..(372): a, c, t, g, unknown or other
  misc_feature (372)..(372): n is a, c, g, or t
  modified_base (379)..(379): a, c, t, g, unknown or other
  misc_feature (379)..(379): n is a, c, g, or t
  modified_base (387)..(387): a, c, t, g, unknown or other
  misc_feature (387)..(387): n is a, c, g, or t
tcagtactctcgtgcacgaccggtgctcgatttagagtatacatattgggtttgggggagctacaacaggcaggcaggggcagcaagatggtgttgcagaccccaggtcttcatttctctgttgctctggatctctggttcctgcggggacatcgtgatgacccagtacccagactcactggctgtgtctctgggcgagcgccanaatcaactgcaggtccagccagaacattttcnccacctcaagaacaaaactctagccnggtaccaacagagaccaggacagcctacctaagtgctcattactgggtctcgtacgcgcgtaatcggggtccctgaccccgagttccggggcnggcggtctgggcagtnttcactntaccaccntccagcagccctgccgaggctgaaagagttgtggtacagtttaagtcttggtccagtcttaaatttacttttttacttacttcccttcccgggtacggtaccggtttacccgggaacccgtaaaacgggggttaccccgaaagggggttcggtaaaaacgtcaaaacggggttaaccgaaccggtttgggcggtctcggtaccgaccccttaagttccgtttcccg

SEQ ID NO: 319835 - DNA, 589 bp, Homo sapiens
  misc_feature: GZ8MTXP01BFGXR.19.67.G01.1.454.CMB.2.raw
  modified_base (390)..(390): a, c, t, g, unknown or other
  misc_feature (390)..(390): n is a, c, g, or t
  modified_base (529)..(529): a, c, t, g, unknown or other
  misc_feature (529)..(529): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgcaacgtggtggagacgtgggcggaggcttggtccagccgtggggcggtctctgagtactgtcctgtcgaaccctgtggggtctcgtcagcagcgactgtattgccgtggtccgccaggctccgagggaagaggccgggagtgggtcgcgtaggttattttagagggtgggaccgactattcgacggagaacctccngtgggacgggccgattccgaccatcctaccagtacgtactttctacagaacactactgtctactacaaattcgaacgagtaccgtggacgggacgacggaccgacggtccgttctattagtgtgtgtaagttgtttagnggtacgtagttggttgttgggtaagacgaagactcgttacggtcggggccgtaaccgggg

SEQ ID NO: 319836 - DNA, 632 bp, Homo sapiens
  misc_feature: GZ8MTXP01CJL1L.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtgggcggaggcttgggtccagccgtggggcggtctcgtgagactgtcctgtcgaaccctcgtggggtctccgtcagcagcgactgtatgccgtgggtccgcaggctccgagggaagaggccggagtgggtcgctaggttattttagaggtgggaccacattcgaacggagaacgtcccaagtgggagggcccgtattccaccgatcctcccagtaacgtacttttcacaagaaaccactaactgtctaccttacaaagttcgaaacacggtacccgtaggaacggggacccgaagggacccgacggggtacccttcgttaagttaattggttaggtaaggtaaggttagttttagggcggtagtagttgggttcgttgggaagtataaggtacgtcggacgggtcggggaacccgtaaccggg

SEQ ID NO: 319837 - DNA, 848 bp, Homo sapiens
  misc_feature: GZ8MTXP01DASHK.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttgcttgctgcaatttcaggaggtgtccagtgtgaggtgcaacgtggtggagactgggcggaggttcgttcgtcgcgtcggtcgggtcgtctcgtaggacgtcgtcgtcgtggtaccgtaccgtcgggtcgggtcctccgtacgacgacgacggaccgtacgttagttcgtccggtccgggttccggggccccgaccgggacggtcccggtaccggggaaagggggaaacggcgggggtaccgggtaggggttcggggtccgtaggttaaggtttttaagtttagggtacggggttacgggaacctacttagttaccggacggaaacgtacctcggaggtcggggaccgggtacctacttacccacgtacttcccgtaacgaaggttacctttactttaccaaacggtaaaacctaaacctacctttaacggttccgttaccctttaaccgtttaaaacaaaccgttacgggaaaacccgtccggtaaccggtagggggaaccccggggtaccggaacggtaaccccggtacccggggtttaccctttaagtttaacgttttaggttgggttaaggtaaaggttagggttttaaagttttggcggggtacttacgggttgggttaccgggttggggaaaccgaacgtaaggtacgttaacccgggtcgggggttaacccgggggaaaccccggg

SEQ ID NO: 319838 - DNA, 561 bp, Homo sapiens
  misc_feature: GZ8MTXP01B3NUO.19.67.G01.1.454.CMB.2.raw
  modified_base (495)..(495): a, c, t, g, unknown or other
  misc_feature (495)..(495): n is a, c, g, or t
  modified_base (517)..(517): a, c, t, g, unknown or other
  misc_feature (517)..(517): n is a, c, g, or t
  modified_base (529)..(529): a, c, t, g, unknown or other
  misc_feature (529)..(529): n is a, c, g, or t
  modified_base (538)..(538): a, c, t, g, unknown or other
  misc_feature (538)..(538): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtgggcggaggcttggtccagcctggggcggtctctgagactgtcctgtgaaccctctggggtctccgtcagcagcgactgtattgcctgggtccgccaggctccgaggggaagagggccgggagtggggtcgcgtaggttatttttagtagggtgggaccgacagttcgtacggagaactccaagttgggagggcccgaagttccacctatcctccagagtacttttctacagaaacacactgtctcttacaaatcgaacagcctgacgggccgaggacacggcctntattattgtgtgagttagttanggtcgattcggnttggtgacngtatcgacgtggggcctaacggg

SEQ ID NO: 319839 - DNA, 595 bp, Homo sapiens
  misc_feature: GZ8MTXP01A4X5C.19.67.G01.1.454.CMB.2.raw
  modified_base (538)..(538): a, c, t, g, unknown or other
  misc_feature (538)..(538): n is a, c, g, or t
  modified_base (551)..(551): a, c, t, g, unknown or other
  misc_feature (551)..(551): n is a, c, g, or t
tcagtactctcgtgcacgaccggtgctcgatttagagtatacatattgggtttggggggaggaggagcccagcactgggattccgaggtgtttccattcggtgctcagcactgaacacagaggactcaccatggagttttggctgaccttgggttttccttgctgcaatttcaggaggtgtccagtgtgaggtgcaactggtggagactgggcggaggcttggtccagcctgggcgtctctgagactgtcctgtcgaaccctcgtggggtctccgtcagcagcgactgtattgccgtgggtcccgcaggctccgaggggaagaggccggagtggggcgcgtaggttatttttagagggtggggacacatttcacggagaactccaagtgggaagggcccattcgacccatcctacagatacttttcacagaaacacacgtcgtctcttacaaattgaaacgagtacccgtaggacgggcccgaagggaccaacggggcccttataatttagttgtggtaagtagttagttttaccggnggtcgtagttggngttgggaacggataacgacgtcgacggtcggggaaccgaacggg

SEQ ID NO: 319840 - DNA, 674 bp, Homo sapiens
  misc_feature: GZ8MTXP01ETG9L.19.67.G01.1.454.CMB.2.raw
  modified_base (514)..(514): a, c, t, g, unknown or other
  misc_feature (514)..(514): n is a, c, g, or t
  modified_base (542)..(542): a, c, t, g, unknown or other
  misc_feature (542)..(542): n is a, c, g, or t
  modified_base (619)..(619): a, c, t, g, unknown or other
  misc_feature (619)..(619): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgcaacgtggtggagacgtgggcggaggtcttggtccaggccgtggggcggtctcgtgagactgtcctgtcgaaccctcgtggggtctccgtcagcagcgactgttattcgccgttcggggtcccgccgacgggcctccggaagggggaacggacgggggcccggggagggtcgggggtcgtacgtaggggttttaattttttaaggaggggttggggaaccccgtactaagttccgtaacggggagaaacccttccgaaggttggggaacggggccctattccaacctatcctacccagtacgtacttttcactagaaacncaactgtctacttacaaaatcgaaacgngcccgttagggacgggaccgaaggaccgaacgggtcccgtatatttatggtagtggagttagttagttgggagttgngggttgttgggtaagagaagtacgtacgttacgggtaacgggaaccggtaaccgg

SEQ ID NO: 319841 - DNA, 685 bp, Homo sapiens
  misc_feature: GZ8MTXP01DHIAU.19.67.G01.1.454.CMB.2.raw
  modified_base (540)..(540): a, c, t, g, unknown or other
  misc_feature (540)..(540): n is a, c, g, or t
  modified_base (614)..(614): a, c, t, g, unknown or other
  misc_feature (614)..(614): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactgggtggagacgtgggcggagggctttggtccagccgtgggcggtcgtctgacgacgtcgtcctagtcgaaccctgtggggtctccgtcagcagcgactgtattcgccgtgggtcccgccgacggcctaccggaaggggaacggacgggccgggaggtcgggggtacgtcgtaaggtttagtttttaaggagggtgggaacccgtactagttcgtaacgggaacgaaccttccgaaggttggggaacgggcccgtaattcccgaacctacgtacctacccgaagtacgttacttttcacgtaaagaaactactaacttctacttacttacaaattcggaaacncggccgtaggacgggaccgaggaccgacgggtaccctacgttatttagttggtgtaagtagttaggttttaggngggtagtgttggttcggttagggtaagaacgtggtacgtcggttacgggtaaccggggaaccggtaacggg

SEQ ID NO: 319842 - DNA, 672 bp, Homo sapiens
  misc_feature: GZ8MTXP01DX43T.19.67.G01.1.454.CMB.2.raw
  modified_base (243)..(243): a, c, t, g, unknown or other
  misc_feature (243)..(243): n is a, c, g, or t
  modified_base (286)..(286): a, c, t, g, unknown or other
  misc_feature (286)..(286): n is a, c, g, or t
  modified_base (331)..(331): a, c, t, g, unknown or other
  misc_feature (331)..(331): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctggcggggacatcgtgatcgacccagtacccagactcactggctgtgtctcgtgggcgagacggccaacaatcaactgcaggtccagccaagaactatttcnccacctacaaagaaactaaaacttctacgcctaggtaaccaanagaacgaccaaggacacgtccctactaagtgctactagtttacgngggtcttcgacgcgtacgtaacgttccgggggtaccctcggaccccgtacggttccgggggactacggggtccggggttcgtagggggtaacctaggtaacttttcccaaccttccctacaaccgtatccaaggccaacggtccctgaccgaacgggtctaggaaagtgtgggtacggacgttaagtttttacgtacttggtacctagtacttaaatttacttttttctaacgtcccgttcggtacgggtaccgttccgggaacgtaacgggaccggtagggttacgaaaactcgaaaggcgaacgtcggtaggtcctaggaccttacctaagttcgttcg

SEQ ID NO: 319843 - DNA, 571 bp, Homo sapiens
  misc_feature: GZ8MTXP01DWUGH.19.67.G01.1.454.CMB.2.raw
  modified_base (369)..(369): a, c, t, g, unknown or other
  misc_feature (369)..(369): n is a, c, g, or t
  modified_base (460)..(460): a, c, t, g, unknown or other
  misc_feature (460)..(460): n is a, c, g, or t
  modified_base (528)..(528): a, c, t, g, unknown or other
  misc_feature (528)..(528): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtgggcggaggcttgggtccagccgtggggcggtctctgagactgtcctgtcgaaccctcgtggggtctccgtcagcagcgactgtattgcctgggtccgccaggctccgaggggaagaggccggagtgggtcgcgtaggttattttagaggtggaccganattcgtacggagaactccaagtgggagggccgagttccaacctatcctccagtagtactttctcaagaaacacactgtctacttacaaatnaacgagccgtagacggggaccgagacgtacggacccatcctattaattgtgtgagtagtttagtgggngagttggcgtgggtcgaagagattcgaacgttggggaacccgg

SEQ ID NO: 319844 - DNA, 552 bp, Homo sapiens
  misc_feature: GZ8MTXP01CVE9V.19.67.G01.1.454.CMB.2.raw
  modified_base (301)..(301): a, c, t, g, unknown or other
  misc_feature (301)..(301): n is a, c, g, or t
  modified_base (428)..(428): a, c, t, g, unknown or other
  misc_feature (428)..(428): n is a, c, g, or t
  modified_base (486)..(486): a, c, t, g, unknown or other
  misc_feature (486)..(486): n is a, c, g, or t
  modified_base (500)..(500): a, c, t, g, unknown or other
  misc_feature (500)..(500): n is a, c, g, or t
  modified_base (507)..(507): a, c, t, g, unknown or other
  misc_feature (507)..(507): n is a, c, g, or t
  modified_base (510)..(510): a, c, t, g, unknown or other
  misc_feature (510)..(510): n is a, c, g, or t
  modified_base (512)..(512): a, c, t, g, unknown or other
  misc_feature (512)..(512): n is a, c, g, or t
  modified_base (518)..(518): a, c, t, g, unknown or other
  misc_feature (518)..(518): n is a, c, g, or t
  modified_base (525)..(525): a, c, t, g, unknown or other
  misc_feature (525)..(525): n is a, c, g, or t
  modified_base (528)..(528): a, c, t, g, unknown or other
  misc_feature (528)..(528): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttgggtccagcctggggcggtctctgagactgtcctgtgaccctctggggtctccgtcagcagcgactgtattgcctgggtccnccaggctccgaggggaagagggccggagtggggtcgcgtaggttatttttagagggttgggaccgactatttcgtacggagaacttccaagtgggagggccgatcaccatctccagagtacttttcncaagaacacactgtctcttacaaatgaacagccgtgacgggccgaggacacggccgtntattatgtgtgagngtttagnggngngttggngttgggngangactcgacggtcggggccgaaggg

SEQ ID NO: 319845 - DNA, 581 bp, Homo sapiens
  misc_feature: GZ8MTXP01BXBXQ.19.67.G01.1.454.CMB.2.raw
  modified_base (436)..(436): a, c, t, g, unknown or other
  misc_feature (436)..(436): n is a, c, g, or t
  modified_base (504)..(504): a, c, t, g, unknown or other
  misc_feature (504)..(504): n is a, c, g, or t
  modified_base (536)..(536): a, c, t, g, unknown or other
  misc_feature (536)..(536): n is a, c, g, or t
  modified_base (548)..(548): a, c, t, g, unknown or other
  misc_feature (548)..(548): n is a, c, g, or t
  modified_base (554)..(554): a, c, t, g, unknown or other
  misc_feature (554)..(554): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgcaactggtggagacgtggcggaggcttggtccagccgtgggcggtctctgagactgtcctgtcgaaccctcgtggggtctccgtcagcagcgactgtattgcctgggtccgccaggctccgaggggaagagggccggaggtggggtcgacgtaggttatttttagagggtagggacccgtacagttcgtacggagaacctccgaagtgggagggcccgattcgcatctccagagtactttcnacgaacacactgtctctacaaatacgaacgacgccgtaggacggcccgaaggaccgacggtacccgtnttaattattggttggtgtagttagttttaggnggtagtgttggngttggngagaagcgtcgacggtcgggcgaacgg

SEQ ID NO: 319846 - DNA, 540 bp, Homo sapiens
  misc_feature: GZ8MTXP01DQ41O.19.67.G01.1.454.CMB.2.raw
  modified_base (295)..(295): a, c, t, g, unknown or other
  misc_feature (295)..(295): n is a, c, g, or t
  modified_base (369)..(369): a, c, t, g, unknown or other
  misc_feature (369)..(369): n is a, c, g, or t
  modified_base (386)..(386): a, c, t, g, unknown or other
  misc_feature (386)..(386): n is a, c, g, or t
  modified_base (445)..(445): a, c, t, g, unknown or other
  misc_feature (445)..(445): n is a, c, g, or t
tcagtactctcgtgcacgaccggtgctcgatttagagtatacatattgggtttggggggtagctcaggaagcagagcctggagcatctccactatggcctgggctccactacttctcaccctcctcgctcactgcacaggttcttgggccaactttatgctgactcagccccactctgtgtcggagtctccggggaagacggtaaccatcttttgcacccacaacagtggcaaacattgccagcaattttgtgcagtggtaccagcagcgcccgggcacgttcccccaccattgngatctatgaggataaatcaaaagaccgtctgggggtccctgacttcggtctctcggcctcatcgacagctcccncaactctcgccctcccncaccatctctggactgaagactgaggacgaggcctagactactactgtctagttgttangactagccgcgtcagttggtcggtcgttcgggcggagggacccaaaggtcttacggccttcgtaaggtcaacgccctaggcctcgcccccgttcg

SEQ ID NO: 319847 - DNA, 615 bp, Homo sapiens
  misc_feature: GZ8MTXP01CVEBS.19.67.G01.1.454.CMB.2.raw
  modified_base (547)..(547): a, c, t, g, unknown or other
  misc_feature (547)..(547): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtgggcggaggcttggtccagccgtggggcggtctctgagactgtcctgtcgaaccctgtggggtctccgtcagcagcgactgtattgccgtgggtcccgccgaggcctccgaggggaacgagggccgggaggtggggtcgcgtaggttatttttagagggtgggaacccgactagttcgacggagaacctccgaagtgggacgggcccgagttccaaccacgtcctaccgagtacgtacttttctcaagaacactactgtcttactacaaatcgaacgacgccgtaggacgggccgacggacacggtccgtctattatggtgtggtagttagtttagnggtacgtagttgggttcgttgggtaaggactaaggtacgtcgacggtcggggaaccgtaacccggggg

SEQ ID NO: 319848 - DNA, 606 bp, Homo sapiens
  misc_feature: GZ8MTXP01AL3WE.19.67.G01.1.454.CMB.2.raw
  modified_base (511)..(511): a, c, t, g, unknown or other
  misc_feature (511)..(511): n is a, c, g, or t
  modified_base (544)..(544): a, c, t, g, unknown or other
  misc_feature (544)..(544): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgcaactggtggagactggcggaggcttggtccagcctgggcgtctctgagactgtcctgtgaccctctggggtctcgtcagcagcgactgtattgcctgggtccgccgaggctccgaggggagagggccggagtgggtcgcgaggttattttagagggttgggaccgactagtttcgtacgggagaaccttcccgaagttcgggaaggggcccgagttcacctatctacccagtaacgtactttctacacgtaaacacactgtaccttcttacaaatggaactagcccgtggacgggccgaggaccgacggtcccgtnttattagtttggtggtaagtagttagtttaggnggtacgtgttgggttcgttgggtaagacgtaagacgtcggttacggtcggggccgtaacggg

SEQ ID NO: 319849 - DNA, 604 bp, Homo sapiens
  misc_feature: GZ8MTXP01BS9CG.19.67.G01.1.454.CMB.2.raw
  modified_base (249)..(249): a, c, t, g, unknown or other
  misc_feature (249)..(249): n is a, c, g, or t
  modified_base (373)..(373): a, c, t, g, unknown or other
  misc_feature (373)..(373): n is a, c, g, or t
tcagtactctcgtgcacgaccggtgctcgatttagagtatacatattgggtttggggggtagctcaggaagcagagcctggagcatctccactatggcctgggctccactacttctcaccctcctcgctcactgcacaggttcttgggccaactttatgctgactcagccccactctgtgtcggagtcgtcggggaagacggtaaccattctttgcaccacaacagtgcaacattgccagctaatttgngcagtggtaccagcagccgcccgggcacgttcccccactattgtgatctatgagataatacaaagtccgtcgtcggggtcctgactcggtctcgtcgctcatcgacaagcctccactactctcncctcctcacactctctcggactagaacgtacgtacggacggacgacgctagaacttactacggtgtctacgttacttagtcgagtacgccgtacggtccgtagttcggttcggttcggttcgggacgggtaacgggaacccgtaaacgggtccgttacggttacccggttaccgtaacgggttacccgaacggccccgtaaacgggcccgtcccggttccccccgttccgg

SEQ ID NO: 319850 - DNA, 655 bp, Homo sapiens
  misc_feature: GZ8MTXP01CF34Y.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtggcggaggcttggtccagccgtgggcggtctctgagactgtcctgtcgaccctcgtggggtctccgtcagcagcgactgtattgccgtggtccgccaggctccgaggggaagaggccggaggtggggtcgcgtaggttatttttagtaggtgggaccgactattcgtacgggagaacgtccaagtgggaacggggccgtagttccaccgatcctacccagtacgtacttttctacaagaaaccacgtaacttcgtacttaccttacaaaagttacgaaaccgacggtaccccgttagggaacgggggaccccggaagggacccgaccgggtaccccggttcttaagtttagtttggtggtaaggtaaggttaggttttagttgggtacggtagttgggttgttggggtggacaaggtatcgacggtcgggggccgaaacccggggg

SEQ ID NO: 319851 - DNA, 582 bp, Homo sapiens
  misc_feature: GZ8MTXP01ELWIU.19.67.G01.1.454.CMB.2.raw
  modified_base (531)..(531): a, c, t, g, unknown or other
  misc_feature (531)..(531): n is a, c, g, or t
tcagtactctcgtgcacgaccggtgctcgatttagagtatacatattggggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcgtctctgagactgtcctgtcgaaccctctggggtctccgtcagcagcgactgtattgccgtgggtccgccaggctccgagggaagaggccggagtgggtcgcgtaggttattttagagggtgggaccgactattcgtacggagaactccgaagtcgggagggcccgattccaccgtatctaccagtacggtaccttttctacaagaaaccactaactcgtacttcttacaaatcgaacgtagccgtaggacgggccgaggacacggtcgtctattagttgtgtgtagttagtttagnggcgtagttggcgttggtggactgagtcgacggtcggggccgtaaccgggg

SEQ ID NO: 319852 - DNA, 698 bp, Homo sapiens
  misc_feature: GZ8MTXP01B4IXC.19.67.G01.1.454.CMB.2.raw
  modified_base (324)..(324): a, c, t, g, unknown or other
  misc_feature (324)..(324): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagactgggcggaggcttggtccagccgtgggcggtctctgagactgtcctgtgaccctgtgggtctccgcagcagcgactgtatgccgtgggtccgccgaggcctccgagggaaggngggcccgggaggtcggggtcgcgtagggttatttttagtagggtagggacgtactagttccgtaaacgggagtaacctccgaagttcggggacggggcccgtaagttccaaccctactccgtacccgaagtacgttaacctttttcctaaccgtaaacgaaacctaccgtaccttcgttacccttactttacccaaaagttcggtaaaacctacggtaccccgttaggggaaccgggggacccggaaggggaacccgtaccggggtcccggttacttagtttaaggttggtggttaggtaagttaggtttaagtgggacgttaggttcgggtcgtaggggtcggaactggttactccggaacggtaaccggggg

SEQ ID NO: 319853 - DNA, 628 bp, Homo sapiens
  misc_feature: GZ8MTXP01CS453.19.67.G01.1.454.CMB.2.raw
  modified_base (480)..(480): a, c, t, g, unknown or other
  misc_feature (480)..(480): n is a, c, g, or t
  modified_base (550)..(550): a, c, t, g, unknown or other
  misc_feature (550)..(550): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgcaactggtggagacgtgggcgggaggcttggtccaggccgtgggcggtctctgagactgtcctgtcgaccctcgtcggggtctccgtcagcagcgactgtattgccgtgggtccgccaggctccgaggggagaggccgggagtgggtcgcgtaggttatttttagagggtgggaccgactagttcgtacgggacgaacctcccgaagtcgggacgggccgtattccaccgatcctacccagtacgtacttttcacagaacactactgtctcttacaaatcgaacgngaccgtgggacgggacccgaggaccgaccggtccgttactattagttgtggtaaggtagttaggtttagnggggtacgtaggttcgggttcgttgggtaacgggactaaggtacgtccgaacggtcgggggaacccgtaacccggggg

SEQ ID NO: 319854 - DNA, 593 bp, Homo sapiens
  misc_feature: GZ8MTXP01AY7PG.19.67.G01.1.454.CMB.2.raw
  modified_base (241)..(241): a, c, t, g, unknown or other
  misc_feature (241)..(241): n is a, c, g, or t
  modified_base (267)..(267): a, c, t, g, unknown or other
  misc_feature (267)..(267): n is a, c, g, or t
  modified_base (272)..(272): a, c, t, g, unknown or other
  misc_feature (272)..(272): n is a, c, g, or t
  modified_base (276)..(276): a, c, t, g, unknown or other
  misc_feature (276)..(276): n is a, c, g, or t
  modified_base (437)..(437): a, c, t, g, unknown or other
  misc_feature (437)..(437): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctggcgggacatcgtgatgacccagtacccagactcactggctgtgtctcgtgggcgagaccggccacaatcaactgcaggtccagccagaactatttccnccacctcaaagaacaaaactctagcngacanaganaccagacagcctactaagttgctctatttacgtgggtcttactacgcggacgtaacgttccgggggtccctgacccccggtagttccgggggacacgggccggggtactggggaactaggtactttcgactctcaccatcagcagcctgcaggctagaagntgtaggtcttaagtttacttacgtgtacagtacttaatttctttttcgtactcccgtcggtggtaaccgttcgggaaccgaaaggggccgtaaggggttacgaaactcgaacggttaaccgacgtggtggaactcggaccacctaattcgttaacg

SEQ ID NO: 319855 - DNA, 616 bp, Homo sapiens
  misc_feature: GZ8MTXP01BAZMC.19.67.G01.1.454.CMB.2.raw
  modified_base (559)..(559): a, c, t, g, unknown or other
  misc_feature (559)..(559): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtgggtggagacgtgggcggaggcttggtccaggcccgtggggcggtctctgagtactgtcctggtcgaaccccgtcgtggggtcctccgtcagcagcgactgtattcgccgtgggtcccgccgaggcctaccgaggggaaaggacgggccgggaggtgggtcgcgtaggtttattttagagggtgggaccgactagttcgtacggagaacctccgaaggtgggacgggccgtattccgacctatcctaccagtagtacctttctacagaaactacactgtacttctacaaatcgaaacgcgacgtaggacgggaccgaggaccgacggcccgttatattagtgtgtgtaagttagtttagnggtacgtagttggttgttgggtgagaagactcgacggtcggggaaccgtaaccgggg

SEQ ID NO: 319856 - DNA, 869 bp, Homo sapiens
  misc_feature: GZ8MTXP01D09YS.19.67.G01.1.454.CMB.2.raw
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttgcttgctgcaatttcaggaggtgtccagtgtgaggtgcaactggtggagactgggcggagggttcgtcggcgcgtcggtgggtcgtctcgtagacgtcgtcgtcgtggtacccgtacccgttcgggtcgggtccctcccgtagacgacgacggtccgtaacgttgttagtcccggtccgggttccggggccccgaccggacggtcccgtaacccgggggaaaagggggaaacgggccgggggtacgggtagggggttcgggggtaccgtaggttaaggtttttaagtttacgggtaggggtaccgggaactacgttagttaccggtaacggaacctaccgtcgtagggtcggggaccgggtacctactacccgactacgtcctacgaagtacgtttacctttacgaacgtaaaccgaactaccgttacgttccgttactttacctaaaataaacgtacggggaaaacccgtcggtacccggtaagggggacccgggtacccggaacgggaacccggtaaacccgggggttccctttaaacgtttaagttttaaggttgggtttaaggtaacgggttaaagggttttaaacgggtttttaagggcccggggttaacggttaaggggttccggggttacgggttgggggttaaaccggaacggtaaaggtccggttaccgggtaaccgggggttaacccgggggtaaaccccgggg

SEQ ID NO: 319857 - DNA, 576 bp, Homo sapiens
  misc_feature: GZ8MTXP01AG74Y.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagccgtggggcggtctctgagactgtcctgtcgaccctctggggtctccgtcagcagcgactgtattgcctgggtccgccaggctccgaggggaagaggccggaggtgggtcgcgtaggttatttttagtaggtgggaccgacagttcgtacggagaactccaagtgggagggccgattcgaccatctccagagtactttctacagaacacactgtctcttacaaatgaacgagccgtggacgggccgaacggacgaacggccgtactagtttagtgttggtgtagttagtttagttggtcgtagttgggcgttgggtggacgaagatcgacgtcggggccgtaaccgggg

SEQ ID NO: 319858 - DNA, 656 bp, Homo sapiens
  misc_feature: GZ8MTXP01EZTEU.19.67.G01.1.454.CMB.2.raw
  modified_base (311)..(311): a, c, t, g, unknown or other
  misc_feature (311)..(311): n is a, c, g, or t
  modified_base (392)..(392): a, c, t, g, unknown or other
  misc_feature (392)..(392): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtgggcggaggcttgggtccaggccgtggggcggtctcgtgagactgtcctgtcgaaccctcgtcggggtctccgtcagcagcgactgtatgccgtgggtcccncaggctccgaggggaagagggccggaggtgggtcgcgtaggttattttagaggtcgggaaccgtactagttccaacggganaacctccaagtgggagggcccgtattcaccgatcctccgagacgtactttcacgaagaaaccactaactcgttacctcttaacaaagttcgaaacgtacggccgtagggaacggggcccggaaggaccgtaacgggtccccgttacgttatttagttcgtggttaaggtaagttaggtttaacgttgggacgtaaggttcgggcgttggggttaacggagaacggtcgtaccgacgggtcgggggttaacccgtaacccggggg

SEQ ID NO: 319859 - DNA, 639 bp, Homo sapiens
  misc_feature: GZ8MTXP01CNPG1.19.67.G01.1.454.CMB.2.raw
  modified_base (376)..(376): a, c, t, g, unknown or other
  misc_feature (376)..(376): n is a, c, g, or t
  modified_base (394)..(394): a, c, t, g, unknown or other
  misc_feature (394)..(394): n is a, c, g, or t
  modified_base (414)..(414): a, c, t, g, unknown or other
  misc_feature (414)..(414): n is a, c, g, or t
tcagtactctcgtgcacgaccggtgctcgatttagagtatacatattggggtttgggggggagaggagcccagcactgggattccgaggtgtttccattcggtgctcagcactgaacacagaggactcaccatggagtttggctgacctgggttttcctgctgcaatttcaggaggtgtccagtgtgaggtgcaactggtggagacgtgggcggaggcttggtccagccgtggggccggtctcgtgagacgtgtcctgtcgaaccctcgtgggggtctccgtcagcagcgactgtattgccgtgggtccgccaggctaccgaggggaagagggccggagtgggtcgcgtaggttattttagtaggtgggaaccganattcgacggagaactccngtgggagggccatcacatcnccagtagtactttctcagaacacactgtacttacttaacaaattagaaacgtacggacccgttaggaacgggggcccgaagggaacccgacgggtacccgttaccttaaagtttagtttggtaggtggtaagttaggttttaagttccgggtacgtaagttgggttccgttaggggttcggactaacggacttcgacgggttcggggaaccccgtaaaccggggg

SEQ ID NO: 319860 - DNA, 798 bp, Homo sapiens
  misc_feature: GZ8MTXP01AQ5UR.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttcctgctgcaatttcaggagtgtccagtgtgaggtgcaacgtggtggagacgtgggcggaggtcttggtccaggccgtggggcggtctcgtgagactgtcctgtcgaccctgtgggtctcgtcagcagcgactgtatcgccgtgggtcccgcgaggcctaccggaaggggaacgacgggccgggaggtggggtcgcgtaaggtttatttttaacggaggggtggggaaccctacgtagtttaccgaacgggaataacccgtccgaagggttcggggaacgggggtcccctaacgtttcccgaaccctacgttacccgtacccgaaaggtaacggtttaaccctttttcgaaaccgtaaacgggtaaaaccctacctaaaccgttcgttacccttacgtttaaaccaaaagttaccggaaacgacggtacccggtaacggggaccgggggaacccgaacggggacccggaccggggttcccgttaacgtttaaggttttaacggttcggttgggtaagttaaggggtttaaggtttttacggggcggggtacggtagggttcgggttcggttacggggtaacggtaaggtaacggttacggtaccgggttaccgggggtccgggggaacccgggtaaccgggg

SEQ ID NO: 319861 - DNA, 643 bp, Homo sapiens
  misc_feature: GZ8MTXP01BB4YB.19.67.G01.1.454.CMB.2.raw
  modified_base (567)..(567): a, c, t, g, unknown or other
  misc_feature (567)..(567): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtgggcggaggcttggtccaggccgtggggcggtctctgagactgtcctgtcgaaccctcgtggggtctccgtcagcagcgactgtattgccgtgggtccgcaggctccgaggggaagacggccggagtcgggtcgcgtaggttattttagaggtgggaccgactagttcgtacggagaacctccgaagtgggagggccgattccacctatcctccagtacgtactttctacaagaacactactcgtcttacttacaaattcgaaacgacgtccgtacggacggggacccgaacgggaccgaccgggtacccgttacttaagtttaagtttgggtggtaaggtaaggttaggttttaagnggggtacgtaagttcggggttcgttagggtaaggacgaagtacgtacgacggttcgggggcccgtaaacccggggg

SEQ ID NO: 319862 - DNA, 659 bp, Homo sapiens
  misc_feature: GZ8MTXP01DRCL7.19.67.G01.1.454.CMB.2.raw
  modified_base (445)..(445): a, c, t, g, unknown or other
  misc_feature (445)..(445): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactgggtggagactggcggaggcttgggtccagcctgggcgtctctgagactgtcctgtgaaccctctggggtctccgtcagcagcgactgtattgcctgggtccgccaggctccgaggggaagaggccggaggtgggtcgcgaggttatttttagaggtgggaccgacattctacggagaaactccaagtgggacgggacccgtattccacctatctcccagagtaacttttctacagaaacactactntctacttacaaattgaaacgagcccgtaggaacggggcccgaagggtacccgaacgggccccggttactaatttaagttcggttgggttaaggtaaggttaacggtttttaaagttcggggtacggtaagttcggggcggttagggggttcggggtaaaacgtaaggtaacgtaccggttaccgggtaaccgggggaacccggtaaaccggggg

SEQ ID NO: 319863 - DNA, 628 bp, Homo sapiens
  misc_feature: GZ8MTXP01EG9UN.19.67.G01.1.454.CMB.2.raw
  modified_base (536)..(536): a, c, t, g, unknown or other
  misc_feature (536)..(536): n is a, c, g, or t
  modified_base (574)..(574): a, c, t, g, unknown or other
  misc_feature (574)..(574): n is a, c, g, or t
  modified_base (590)..(590): a, c, t, g, unknown or other
  misc_feature (590)..(590): n is a, c, g, or t
  modified_base (596)..(596): a, c, t, g, unknown or other
  misc_feature (596)..(596): n is a, c, g, or t
  modified_base (603)..(603): a, c, t, g, unknown or other
  misc_feature (603)..(603): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgcaacgtggtggagacgtgggcggaggcttggtccagccgtggggcgtctctgagactgtcctgtcgaaccctcgtggggtctccgtcagcagcgactgtattgccgtgggtccgccaggctccgaggggaagagggccgggagtggggtcgcgtaggttatttttagagggtgggaaccgactagttcgtacgggacgaaccttccgaagttggggacgggcccgtattccgaacctattcctaccagtacgtacttttcacaagaaacactactgttacctctttacaaattgaaacacggcccgttagggacggggccgaaggaccgacgggacccgttnttaatttagttggtgtaagtagttaggtttagttgggngtagttgggcttgggngggaanaagtacncgacgggtcggggaaccgtaacggg

SEQ ID NO: 319864 - DNA, 769 bp, Homo sapiens
  misc_feature: GZ8MTXP01EOL4J.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgcaacgtggtggagacgtgggcggaggcttggtccaggccgtggggcggtctcgtgagactgtcctgtcgaaccctcgtggggtctcgtcagcagcgtactgtattgccgtgggtcccgccgacggctaccggagggggaagacggggtccgggaggtcgggggttacggcgttagggtttagtttttaaggtaggggtacggggtaacccgtaacgtacgtttaccggtaaccgggtaacgtaacccgttacccgtaagggttacgggggaaacgggggtacccggtaactttacccgaacccgtacgttaccctacccgtaaagtacggttactttttaccgacgtaacggtaaacctacttaccgttacgttaccttacttaactaaagttacgaaacgacggtaccgtagggaacggggaccggaacgggaaccgtaccgggtaccgttacgtttaagtttagttggttaggtaaggtaagttaggtttagttgggtacgtagttggggttcgttggggtaacggaacgaaggtacgtacgaccgggtcggggttaaccggtaacccggggg

SEQ ID NO: 319865 - DNA, 619 bp, Homo sapiens
  misc_feature: GZ8MTXP01D5NSI.19.67.G01.1.454.CMB.2.raw
  modified_base (475)..(475): a, c, t, g, unknown or other
  misc_feature (475)..(475): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgaccttgggttttccttgctgcaatttcaggaggtgtccagtgtgaggtgcaacgtgggtggagacgtgggcggaggcttggtcccagcccgtggggcgtctcgtgagtactgtccctgtcgaaccctcgtgggtctccgcagcagcgactgtattgccgtggtccgccaggctaccgagggaagacggccgggagtgggtcgcgtaggttatttttagagggtgggacgactagttcgtaaacggagctccagtgggacgggccgtatcgaccatctcagagtactttctacagtaacactaactcgtctacttacaaagtacaacngccgtaggacggcccgaaggaccacggtccgttactagtttgttgtggttgtaaggttacgtttaagtgggttccggttaagttcgggtcggttagggttaaccggaaacgaggttaacgtccggttaacgggtaaccgggggg

SEQ ID NO: 319866 - DNA, 723 bp, Homo sapiens
  misc_feature: GZ8MTXP01E10I3.19.67.G01.1.454.CMB.2.raw
  modified_base (651)..(651): a, c, t, g, unknown or other
  misc_feature (651)..(651): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgcaacgtgggtggagacgtgggcggaggtcttgggtccaggccgtggggcgtctctgagactgtcctgtcgaaccctcgtgggtctccgtcagcagcgactgtattcgccgtcgggtcccgccgaggctccgaaggggaacggagggccgggaggtcggggtcgcgtaggtttaattttagtaggggtcgggaacccgtactagttcgtaacgggacgtaaacctaccgaaggtggggaacggggtacccggtactttaccgaacccctacttaccctacccgtaaagtaccggtttaacttttacctacgaaacgtaaaccactaccttcgttcttaccttaacaaaacttcgaaacgtacggtccgtacgggaaccggggacccggaacgggaccgtaccgggtaccgttacttaagttttacgttggttaggtaaggtaaggttaggttttaggngggcgtaagttcgggttcgttggggttaagacgaaggtagtccggacggtcgggggaacccgtaaccggggg

SEQ ID NO: 319867 - DNA, 577 bp, Homo sapiens
  misc_feature: GZ8MTXP01AO8RV.19.67.G01.1.454.CMB.2.raw
  modified_base (524)..(524): a, c, t, g, unknown or other
  misc_feature (524)..(524): n is a, c, g, or t
  modified_base (548)..(548): a, c, t, g, unknown or other
  misc_feature (548)..(548): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttgggtccagcctggggcggtctctgagactgtcctgtgaacccctctggggtctccgtcagcagcgactgtattgcctgggtccgccaggctccgaggggaagagggccggaggtggggtcgcgtaggttatttttagtagggtggggaccgactattcgtacgggagaaactccgaagtcgggaggggccgagttcaccatcctccagacgtactttctacagaaacacactgtctacttacaaatacgaacgagtcctgacgggccgaggacacggcgtctattatgtgtgagttagtttagnggcgtagttggcgttgggtcgagngagtccgacggtcgggggcccgaacgggg

SEQ ID NO: 319868 - DNA, 557 bp, Homo sapiens
  misc_feature: GZ8MTXP01CY4FU.19.67.G01.1.454.CMB.2.raw
  modified_base (196)..(196): a, c, t, g, unknown or other
  misc_feature (196)..(196): n is a, c, g, or t
  modified_base (218)..(218): a, c, t, g, unknown or other
  misc_feature (218)..(218): n is a, c, g, or t
  modified_base (247)..(247): a, c, t, g, unknown or other
  misc_feature (247)..(247): n is a, c, g, or t
  modified_base (283)..(283): a, c, t, g, unknown or other
  misc_feature (283)..(283): n is a, c, g, or t
  modified_base (287)..(287): a, c, t, g, unknown or other
  misc_feature (287)..(287): n is a, c, g, or t
  modified_base (299)..(299): a, c, t, g, unknown or other
  misc_feature (299)..(299): n is a, c, g, or t
  modified_base (365)..(365): a, c, t, g, unknown or other
  misc_feature (365)..(365): n is a, c, g, or t
  modified_base (377)..(377): a, c, t, g, unknown or other
  misc_feature (377)..(377): n is a, c, g, or t
  modified_base (382)..(382): a, c, t, g, unknown or other
  misc_feature (382)..(382): n is a, c, g, or t
tcagtactctcgtgcacgaccggtgctcgatttagagtatacatattgggtttgggggtagctcaggaagcagagcctggagcatctccactatggcctgggctccactacttctcaccctcctcgctcactgcacaggttcttgggccaactttatgctgactcagccccactctgtgtcggagtctcggggaanacggtaaccatctttgcaccanaacagtgcaacattgccagctaattttgncagtgacagcacgcgccggcaccgtccccactatgngatntatgagaataanacgaaacgtcgtcgtcgggtcctgtactcggttctcgtcgctcatcacactcctccaccactctcnccctcctcaccntctcngacagaagacgtaggaggacgaggctagtactactacgtgtctattacttagtgagtacgccgtcgtctagtcggtcggttccggtacggggacgggaacggaccgaacggtccgttacgttccgttaccgtaacggtccgaaccgcccgacggcccgtcccggttcccccgtcg

SEQ ID NO: 319869 - DNA, 588 bp, Homo sapiens
  misc_feature: GZ8MTXP01EURKX.19.67.G01.1.454.CMB.2.raw
  modified_base (491)..(491): a, c, t, g, unknown or other
  misc_feature (491)..(491): n is a, c, g, or t
  modified_base (552)..(552): a, c, t, g, unknown or other
  misc_feature (552)..(552): n is a, c, g, or t
  modified_base (562)..(562): a, c, t, g, unknown or other
  misc_feature (562)..(562): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttcctgctgcaatttcaggaggtgtccagtgtgaggtgcaacgtggtggagactgggcggaggcttggtccagccgtgggcgtctctgagactgtcctgtgaccctgtgggtctccgcagcagcgactgtattgccgtgggtccaccgaggctccgagggagacgggccggaggtgggtcgcgtaggttattttagtagggtgggacgacgtattcgaaacgggagaaccgtccgaagtcggggacggggtcccgtagtttccaacccgtatccgtaccaaggtacgtaccttttcacaagtaaccactactcgtactacttacaaagtgaacncgccgtaggacggccgaggaccgcggtccgttactattgtgtgttgagttagtttagcggngttagttggngtggtgactagacgtcgcggtcgggg

SEQ ID NO: 319870 - DNA, 737 bp, Homo sapiens
  misc_feature: GZ8MTXP01DQFW1.19.67.G01.1.454.CMB.2.raw
  modified_base (238)..(238): a, c, t, g, unknown or other
  misc_feature (238)..(238): n is a, c, g, or t
  modified_base (243)..(243): a, c, t, g, unknown or other
  misc_feature (243)..(243): n is a, c, g, or t
  modified_base (270)..(270): a, c, t, g, unknown or other
  misc_feature (270)..(270): n is a, c, g, or t
  modified_base (274)..(274): a, c, t, g, unknown or other
  misc_feature (274)..(274): n is a, c, g, or t
  modified_base (678)..(678): a, c, t, g, unknown or other
  misc_feature (678)..(678): n is a, c, g, or t
  modified_base (706)..(706): a, c, t, g, unknown or other
  misc_feature (706)..(706): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggagtgtccagtgtgaggtgcaactggtggagactggcggaggcttggtccagcctgggcgtctgngagtntcgtctgtacgacctggtggtctcgtnagcngcgtactgtatcgcgtcggcccgacgcgcctacggaagggaaggcgggaccggtaggtcggggtcgacggttaaggttttagttttaaggagggggttacggaacccgtaacgttacgttaccggtaacgggaacgtaacccgtacctaaggggtacgggggaaccgggtacccgttaacgttacccgaaccgttacttaccccttacccgaaggttaacgtttacccgttttcaaccgaaacgtaaacctaccgtacgtttaccgtccttaccgtaaacctaaaagttaccgaaaacgggtccgttaccggtaggggaacccgggaccgggaaaccgggtacccggaaccggtcccggtttaattaaagtttagttcggtaggtaagtaaggttacgtttagnggacgtagttcggttgttgggtaacganaagtctcggacggtcgggaacgtaacccggg

SEQ ID NO: 319871 - DNA, 624 bp, Homo sapiens
  misc_feature: GZ8MTXP01DK63G.19.67.G01.1.454.CMB.2.raw
  modified_base (536)..(536): a, c, t, g, unknown or other
  misc_feature (536)..(536): n is a, c, g, or t
  modified_base (568)..(568): a, c, t, g, unknown or other
  misc_feature (568)..(568): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtgggcggaggcttggtccagccgtgggcgtctcgtgagactgtcctgtcgaccctcgtggggtctcgcagcagcgactgtatgcctgggtccgcaggctaccgagggacgagggccggaggtgggtccgcgtaagggttatttttagaggggtgggaacgtactagtttccgtaaacgggacgaactccgaaggtgggaacgggtccgaatttcccgaacctacttctaccgagtagtacttttcacaacgaacacactgtctacttaacaaagttacgaacaacgccgtaggacgggacccgaaggaaccgccggtcccgttnttaattagtgttgttagtaggttagtttaggnggttacgttggttgggtcgtgggtcggacgtagttacgtaaccggaacgggtcggg

SEQ ID NO: 319872 - DNA, 652 bp, Homo sapiens
  misc_feature: GZ8MTXP01DA4L1.19.67.G01.1.454.CMB.2.raw
  modified_base (589)..(589): a, c, t, g, unknown or other
  misc_feature (589)..(589): n is a, c, g, or t
  modified_base (619)..(619): a, c, t, g, unknown or other
  misc_feature (619)..(619): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgcaacgtgggtggagacgtgggcggaggcttggtccagccgtggggcggtctctgagactgtcctgtcgaaccctcgtggggtctccgtcagcagcgactgtattgccgtggtcccgccaggctccgaggggaaggaggccggaggtcgggtcgcgtaggttattttagagggtgggaccgactagttcgtaacggagaacctccgaaggttcggggacggggtcccgtaattcccaactactcctacccagtacgttactttctacgaaacgaaacactactcgttcctacttaacaaacttacgaaacgaacgtcccgttagggaacggggacccggaacggaccgaccgggtaccgttactaagtttagttggtgtaagtaagttagtttagnggtacgtagttgggcgttgggtaaggacgnggtactcggacggtcggggaaccgtaaccgggg

SEQ ID NO: 319873 - DNA, 701 bp, Homo sapiens
  misc_feature: GZ8MTXP01ADZEX.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtgggtggagacgtgggcggaggcttgggtccaggcctggggcggtctctgagactgtcctgtcgaaccctcgtggggtctccgtcagcagcgactgtatgccgtgggtcccgcaggctccgagggaagagggccggaggtgggtcgcgtaggttatttttagagggtgggaaccgtacagtttcgaacggagaacctccgaagtggggacggggtccgtattccgacctatcctaccgagtacgtacttttcacaacgaaactacacttcgtccttacttacaaatgaaaccgcggtcccgtagggaacgggggacccgaaggggacccgtaccgggtacccgttacgtttaagtttagtttgggttaggttaagggtaaaggtttagggttttaaacgttgggggtaccgtaaggttccggggttcggtttagggggttaacgggaacgtaaggtacggttacccggacggggttcggggggaaccccgtaaacccgggggg

SEQ ID NO: 319874 - DNA, 666 bp, Homo sapiens
  misc_feature: GZ8MTXP01DFI4P.19.67.G01.1.454.CMB.2.raw
  modified_base (588)..(588): a, c, t, g, unknown or other
  misc_feature (588)..(588): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtgggtggagacgtgggcgggaggcttggtccaggccgtggggccggttctctgagactgtcctgtcgaaccctcgtggggtctccgtcagcagcgactgtattgccgtgggtccgccgaggctccgaggggaaggagggccgggaggtgggtcgcgtaggtttatttttagagggttgggaccgactagttcgtaacgggagaacctccaagtgggacgggcccgtattccactatcctaccagtacgttacttttctacaacgaaacctactacttgtccttaccttaacaaattacgaaacgtacggtccgtagggaacggggacccgaagggaccgaccgggtcccgttattatttagttggttggtaaggtaagttaggttttagnggggtacgtaagttcgggcgttaggggtaaggtaacgaaggtaacgtcgaacgggtcgggggaacccggtaaccgggg

SEQ ID NO: 319875 - DNA, 606 bp, Homo sapiens
  misc_feature: GZ8MTXP01DE3KT.19.67.G01.1.454.CMB.2.raw
  modified_base (301)..(301): a, c, t, g, unknown or other
  misc_feature (301)..(301): n is a, c, g, or t
  modified_base (334)..(334): a, c, t, g, unknown or other
  misc_feature (334)..(334): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagtttggctgacctgggttttcctgctgcaatttcaggaggtgtccagtgtgaggtgcaactggtggagactggcggaggcttggtccagcctggggcggtctctgagactgtcctgtcgaaccctgtggggtctccgtcagcagcgactgtatcgccgtgggtccncgaggctacgagggaagaggcggaggtgggtcncgtaggttatttagaggcggacatatcgtagacgaactcaagtgggaggctatcactatctacgaagtacgtactttacacaacaaactactactcgtacttaccttaaaacaaagtaacgaacggacgaccggtacgggaaccgggaccggtaacggaccgtaccggtaccgttacttagttagttgtaggtaagtaaggttagttacgttggagtagttcggttggttggtaagagaagtacgtcggacgggtcgggaaccggtaacggg

SEQ ID NO: 319876 - DNA, 578 bp, Homo sapiens
  misc_feature: GZ8MTXP01BEZQB.19.67.G01.1.454.CMB.2.raw
  modified_base (440)..(440): a, c, t, g, unknown or other
  misc_feature (440)..(440): n is a, c, g, or t
  modified_base (470)..(470): a, c, t, g, unknown or other
  misc_feature (470)..(470): n is a, c, g, or t
  modified_base (524)..(524): a, c, t, g, unknown or other
  misc_feature (524)..(524): n is a, c, g, or t
  modified_base (549)..(549): a, c, t, g, unknown or other
  misc_feature (549)..(549): n is a, c, g, or t
tcagtactctcgtgcacgaccggtgctcgatttagagtatacatattgggtttgggggagaggagcccagcactgggattccgaggtgtttccattcggtgctcagcactgaacacagaggactcaccatggagttttggctgacctgggttttccttgctgcaattttcaggaggtgtccagtgtgaggtgcaactgggtggagactgggcggaggcttggtccagcctggggcggtctctgagactgtcctgtcgaacccctctgggggtctccgtcagcagcgactgtattgcctggggtcccgccaggcctccagggggaagagggccgggagtggggtcgcgtaggttatttttagagggttgggaccgacagttcgtacggagaaacttccaagtgggaagggccgatttccgaccatctccagagacttttcncagaacacactgtctcttacaaatgaaacngcctgacgggccgaggacgacggccgtctattatggtgtaagagttaggtttangggcgtagttgggcgttggtcgganggtatcgacggtcggggccgtaacggggg

SEQ ID NO: 319877 - DNA, 624 bp, Homo sapiens
  misc_feature: GZ8MTXP01CEB55.19.67.G01.1.454.CMB.2.raw
  modified_base (409)..(409): a, c, t, g, unknown or other
  misc_feature (409)..(409): n is a, c, g, or t
  modified_base (565)..(565): a, c, t, g, unknown or other
  misc_feature (565)..(565): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgcaacgtggtggagacgtgggcggaggcttggtccagccgtggggcggtctcgtgagactgtcctgtcgaccctcgtggggtctccgtcacgcagcgactgtattcgccgtcgggtcccgccgaggccgtaccgaaggggaagcgggaccgggaggtggggtcgcgtaggtttattttaggagggtcggaaccactagtcgtacggactaactccngtgggagggcctatccgaccagtcctacgagtacgtacctttcacaagaacacctactcgtacttacttaacaaatacgaacgagcccgtaggaccgggaccgaacggaccgacggtcccgtattacgttaagtggtgtaagtagttaggtttagnggtagtgttggttgttagggtaagacgaagtacgtcggacgggtcgggaaccgtaacgg

SEQ ID NO: 319878 - DNA, 680 bp, Homo sapiens
  misc_feature: GZ8MTXP01DEE0Z.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgcaactgggtggagacgtgggcggaggcttggtccagccgtgggcgtctctgagctgtcctgtcgaccctcgtggggtctccgtcagcagcgactgtattcgccgtgggtcccgccgaggcctaccgaggggaagacgggccgggaggtgggtcgcgtaggttattttagagggtgggaccgatagttcgtacggagaactccaagtcgggacgggccgtattccgacctatcctacagtacgtactttcgactaagaacctactactcgttaccttacttaacaaagttcgaaacgtacggtaccccgttagggaaccggggacccgaacgggacccgtaccgggtaccccggttatttaagtttaagtttggttggtaaggttaaggttaggtttttaaagggcgggtacggtagttcgggttcggttagggtaacggtaacgtaaggtacgtacggaccgggtccggggaacccggtaaccggg

SEQ ID NO: 319879 - DNA, 708 bp, Homo sapiens
  misc_feature: GZ8MTXP01B6DDT.19.67.G01.1.454.CMB.2.raw
  modified_base (281)..(281): a, c, t, g, unknown or other
  misc_feature (281)..(281): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgcaacgtggtggagacgtgggcggaggcttggtccaggccgtggggcggtctcgtgagactgtcctgtcgaccctgtgggtctccgtnagcagcgactgtattcggccgtgggtcccgccgaggcctccggaggggaacggacgggccgggaggtcggggtcgcgttaaggtttatttttagaggggtagggaacccgtacgtagtttaccgtaacggggataaaccctccgaagtcggggaacgggtcccgtattcccaaccctagttcccgtacctaaggtaacgttaccttttcacaaagaaacccacctacttacgttaccttaccttaacaaacgtcgaaaccgtacggtaccccgtaggggaaccggggcccggaaacgggaacccgtacgggtacccgttattagtttagttggtgtaagggtaagtttggtttaagttcgggagtgttcgggcgttggggaacgacgtaaggtctccggacgggtcgggggaacccgtaaccggggg

SEQ ID NO: 319880 - DNA, 692 bp, Homo sapiens
  misc_feature: GZ8MTXP01BIB7R.19.67.G01.1.454.CMB.2.raw
  modified_base (400)..(400): a, c, t, g, unknown or other
  misc_feature (400)..(400): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctggggcgtctctgagactgtcctgtcgaaccctcgtggggtctccgtcagcagcgactgtattcgccgtgggtcccgccgaggcctccgagggggaacgagggccgggaggtgggtcgcgtaggttattttagtaggggtggaccgactagttcgtacggacgaacctccgngtgggacgggtccgattccaccgtatcctccaagtacgttacttttcgacaagaaaccaacgtacttcgtccttaccttaactaaaacgttacggaaaccgtacggtacccgttacgggaacggggacccggaacgggaaccgaccggggtaccccggttacttaagtttagtttggtggttaaggtaaggttaggttttaagttggggtaccgtaaggttgggttcgttgggggtaaggaacgtaaggtacgtccggttaacggtcgggggttaacccgtaaacccggggg

SEQ ID NO: 319881 - DNA, 630 bp, Homo sapiens
  misc_feature: GZ8MTXP01A7A64.19.67.G01.1.454.CMB.2.raw
  modified_base (405)..(405): a, c, t, g, unknown or other
  misc_feature (405)..(405): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgcaacgtggtggagacgtgggcggaggcttggtccaggccgtggggccggtctcgtgagtactgtcctgtcgacccgtcgtggggtctccgtcagcagcgactgtattgccgtgggtcccgccgaggccgtccgagggggaagacgggccgggaggtggggtcgcgtaggttagtttttagagggtcggggaccgactagttcgtacggganaaccgtcccaaggtgggacggggtcccgtattccaccgatcctaccagtacgtactttctacagaacactactcgtctcttacaaatcgaacgacgccgtaggacggggccgaacggaccgaacggtccccggttatagtttaagtggttgtgtaaggttagttagttggacgtagttgggttcttgggtgacgtggactcgacggtcggggccgtaaccggggg

SEQ ID NO: 319882 - DNA, 608 bp, Homo sapiens
  misc_feature: GZ8MTXP01CIBFK.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtgggcggagggcttgggtccagcctggggcggtctctgagactgtcctgtcgaaccctctggggtctccgtcagcagcgactgtattcgccgtgggtccgccaggctccgaggggaagaggccggaggtgggtcgcgtaggttatttttagtagggtgggaccgacgattcgtacggagaaccttccgaagtgggagggccgattccacatcctccagagtactttctacacgaacacactgtctcttacaaattcgaacgagccgtggacgggccgaaggacgacggccgttcttattagtttgtggttggagttagttttaagttcgggtacgtagttgggcgttggggtggtacgaaggtacgttcgaccggttgggggaacccgtaaaccggggg

SEQ ID NO: 319883 - DNA, 662 bp, Homo sapiens
  misc_feature: GZ8MTXP01CAXG9.19.67.G01.1.454.CMB.2.raw
  modified_base (556)..(556): a, c, t, g, unknown or other
  misc_feature (556)..(556): n is a, c, g, or t
  modified_base (592)..(592): a, c, t, g, unknown or other
  misc_feature (592)..(592): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgcaacgtgggtggagacgtgggcggaggcttgggtccaggccgtggggcggtctcgtgagtactgtcctgtacgacccgtcgtggggtctcgtcagcagcgactgtattcgccgtgggtcccgccgacggcgtaccgaggggaaggacgggccgggaggtcgggtcgcgtaggttattttagagggtgggaccgactagttcgacggagtaacctccgaagtcgggacgggtccgattccaccgtatccctaccgaaggtacgttaccttttcacaagaaacctactactcgtacttacttaacaaagttacgaacgacgtccgtagggaacgggaccggaacggaccgtacggtacccgttnttaagttagttggtggtaagtaaggttaggtttagngggacgtaagttgggttcgttagggtaaggacgtaagtacgtacgacgggtcggggaaccgtaaccgggg

SEQ ID NO: 319884 - DNA, 697 bp, Homo sapiens
  misc_feature: GZ8MTXP01CQL91.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagtttggctgacctgggttttccttgctgcaatttcaggaggtgtccagtgtgaggtgcaactggtggagacgtgggcggaggcttggtccagccgtggggcggtctctgagactgtcctgtcgaaccctcgtggggtctccgtcagcagcgactgtattcgccgtgggtcccgccaggcctccgaggggaagagggccggaggtcgggtcgcgtaggtttatttttaagagggttcggggaacccgtactagttccgtaacgggagtaaccttcccgaagttcggggaacggggacccgtattccgaacccgtatcccttacccaagtacgtacttttcacgtaacgaaactactactcgttacctacttaacaaattacggaaacacggtacccgtagggacggggacccggaacgggaaccgtaccgggtacccgttacgttaagtttagttggttggtggtaaggttaggtttttaacggcgggtacggtaggttcgggttcgttaggggtaacgacgtaaggtacgtacggttacgggtcggggaacccgtaacgggg

SEQ ID NO: 319885 - DNA, 581 bp, Homo sapiens
  misc_feature: GZ8MTXP01E2DAD.19.67.G01.1.454.CMB.2.raw
  modified_base (250)..(250): a, c, t, g, unknown or other
  misc_feature (250)..(250): n is a, c, g, or t
  modified_base (460)..(460): a, c, t, g, unknown or other
  misc_feature (460)..(460): n is a, c, g, or t
tcagtactctcgtgcacgaccggtgctcgatttagagtatacatattgggtttggggggtagctcaggaagcagagcctggagcatctccactatggcctgggctccactacttctcaccctcctcgctcactgcacaggttcttgggccaactttatgctgactcagccccatctgtgtcggagtcgtccggggaagacggtaaccatctttgcacccacaacagtgcaacattgccagctaattttgngcagtggtacagcagcgcccgggcacgttcccccacattgtgatctatgaggataatacaaagccgtcgtcgggggtccctgtacttcggtctcgtcggcctcatccgacaacgtcctccctaccaactctcgccctccctcaccatctcgtagactagaagacgtaggacggacgaggctagtactactacggtgtctacgtacttagngtagtacggccgtggtcagttcgtcggtcgttcggggacgggacgggaccgaacggtcgttacggttaccgttccggtaacgcgaaccggcccgtacgggcctcccgttcccccgttccgg

SEQ ID NO: 319886 - DNA, 859 bp, Homo sapiens
  misc_feature: GZ8MTXP01CQMYL.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgctaatttcaggaggtgtccagtgtgaggtgcaacgtggtggagacgtgggcggaggcttggtccagccgtgggcggtctcgtgagtactgtcctgtcgaaccctcgtcggggtctccgtcagcagcgactgtattcgccgtgggtcccgccgaggcctaccgaggggaaggagggccgggaggtcggggtcgcgtaggtttattttagtagggtgggaccgtactagtttcgtaacgggagtaaccctaccgaaggttacggggacggggtacccgtaacgtttcccaacccgtacttacccgtacccgtaaggtaacggtttaaccctttttccgtaaccgtaaaccggaaaacctaacccgttaaccgtttcggttaccctttaccgtttaaactaaaaacgtttaacggaaaaccggtaaccggtacccgggttaacggggaaccgggggtaacccgggtaaacggggaaccccggtaacccggggttaccccggtttaccgtttaaacgttttacgtttacggggtttaggttaacgggttaaagggtttaacgggttttttaaaggttcgggggtaccggtaagggttcgggggttccggttagggggttaacggggaaaccgtaagggtacgttaccgggttaccggggttaacccggggggttaacccgggttaaaaccccgggggg

SEQ ID NO: 319887 - DNA, 625 bp, Homo sapiens
  misc_feature: GZ8MTXP01ARJKA.19.67.G01.1.454.CMB.2.raw
  modified_base (307)..(307): a, c, t, g, unknown or other
  misc_feature (307)..(307): n is a, c, g, or t
  modified_base (545)..(545): a, c, t, g, unknown or other
  misc_feature (545)..(545): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctggggcggtctcgtgagactgtcctgtgaacccctcgtggggtctccgtcagcagcgactgtatgccgtggtccgccnggctccgagggaagaggccgggagtgggtcgcaggttattttagagggtgggaccgtacagttctacggagaacctccaagtgggacgggccagttcaccagtcctccagacgtacttttctacagaaacacgtactcgtctacttacaaacttgaacgagaccgttggaacggggaccgacggaccgaccggacccggttacttaagtttaacttggttgtggagttaggttttaanggggacgtaagttcggggcgttaggggttggaaccgtaaggtataccggttaacggttcgggggcccgtaaaccgggggg

SEQ ID NO: 319888 - DNA, 563 bp, Homo sapiens
  misc_feature: GZ8MTXP01C127I.19.67.G01.1.454.CMB.2.raw
  modified_base (505)..(505): a, c, t, g, unknown or other
  misc_feature (505)..(505): n is a, c, g, or t
  modified_base (516)..(516): a, c, t, g, unknown or other
  misc_feature (516)..(516): n is a, c, g, or t
  modified_base (540)..(540): a, c, t, g, unknown or other
  misc_feature (540)..(540): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactgggtggagactgggcggaggcttggtccagcctggggcggtctctgagactgtcctgtgaaccctctggggtctccgtcagcagcgactgtattgccgtgggtccgccaggctccgaggggaagaggccggaggtggggtcgcgtaggttatttttagtagggttgggaccgactattcgtaacggagaactccaagtgggagggccgattcaccatctccagacgtactttactcaagaactacactgtctcttacaaatgaactagcctggacgggccgaggacacggtcgtctattatgtggtnagttagtttangggcgtagttggcttgggtggacngatcgacgtggggcctaacgggg

SEQ ID NO: 319889 - DNA, 600 bp, Homo sapiens
  misc_feature: GZ8MTXP01AUVWH.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtgggcggaggcttgggtccagccgtggggcggtctctgagactgtcctggtcgaacccctcgtggggtctccgtcagcagcgactgtatgcctgggtccgcaggctccgaggggagaggccggaggtgggtcgcgtaggttatttttagaggggtgggacccgactattcgtaacgggagaacctccgaagtgggagggccgattcgaccatcctaccagtacgtacttttcacagaaccactactgtactacttacaaatcgaaacagcccgtaggacggggccgaacggaccgacgggcccgttactagttagttggtgtgtaggttagtttagcgggtgtagttgggcgttgggtgacgtaagagtcgacggtggggccgaaccgggg

SEQ ID NO: 319890 - DNA, 637 bp, Homo sapiens
  misc_feature: GZ8MTXP01B9CXW.19.67.G01.1.454.CMB.2.raw
  modified_base (566)..(566): a, c, t, g, unknown or other
  misc_feature (566)..(566): n is a, c, g, or t
  modified_base (583)..(583): a, c, t, g, unknown or other
  misc_feature (583)..(583): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgcaacgtgggtggagacgtgggcgggaggcttgggtccagccgtggggcggtctctgagactgtcctgtcgaccctcgtggggtctccgtcagcagcgactgtattgccgtgggtccgccaggctccgaggggaaggaggccgggaggtgggtcgcgtaggttatttttagagggtgggaccgactagttcgtaacgggacgaaccttcccgaaggttcgggacggggcccgtagtttccaccctatcctacccagaacgtacttttcacaagaaaccactacttgtctcttacaaatacgaaacgagaccgtggacgggaccgagggaccgacggtccgtcttagttagttgtgtaagtagttaggtttagngggtacgtagttcgggngttgggtggaccgaaggtaacttcggaacggtcgggggaacccgtaaccggggg

SEQ ID NO: 319891 - DNA, 648 bp, Homo sapiens
  misc_feature: GZ8MTXP01DTI1G.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtgggtggagacgtgggcggaggcgttggtccaggccgtggggcggtctcgtgagactgtcctgtcgaccctcgtgggtctcgtcagcagcgactgtattgccgtgggtcccgccaggctaccgaggggaagacgggccgggaggtggggtcgcgtaggtttattttagaggggtggaccgactagttcgaacggagaactccgaaggtgggacgggcccgtattaccgaaccacgttcctaccgagtacgttactttacgactaagaaacctactacttcgtacctacgtacaaaagtcgaaacgacgtcccgtagggaacgggccgaaacggaccgtacggtacccgttattagttagttgtgtaaggtagttagtttagcgggtagagttgggcgttagggtggtacaaggtactcggaacgggtccgggggaacccgtaaccggggg

SEQ ID NO: 319892 - DNA, 582 bp, Homo sapiens
  misc_feature: GZ8MTXP01AB6A9.19.67.G01.1.454.CMB.2.raw
  modified_base (390)..(390): a, c, t, g, unknown or other
  misc_feature (390)..(390): n is a, c, g, or t
  modified_base (410)..(410): a, c, t, g, unknown or other
  misc_feature (410)..(410): n is a, c, g, or t
  modified_base (515)..(515): a, c, t, g, unknown or other
  misc_feature (515)..(515): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgcaactggtggagactgggcggaggcttgggtccagcctggggcggtctctgagactgtcctgtcgaccctgtggggtctccgtcagcagcgactgtattgcctgggtccgccaggctccgagggaacgaggccggaggtgggtcgcgtaggttatttttagaggttggggaccactagttcgtacggagaactccngtggacgggcgatcacatcnccagagtctttcacagaacactatcgtctcttacaaatggaaaccgcgcgtggacgggccgagaccgacggtcctattattagttgtgtaaggtagttagttagngggtacgtaggttgggttcgttggggtggacgaagtacgtcgacgggtcggggaaccgtaaccgggg

SEQ ID NO: 319893 - DNA, 713 bp, Homo sapiens
  misc_feature: GZ8MTXP01AN0QR.19.67.G01.1.454.CMB.2.raw
  modified_base (193)..(193): a, c, t, g, unknown or other
  misc_feature (193)..(193): n is a, c, g, or t
  modified_base (305)..(305): a, c, t, g, unknown or other
  misc_feature (305)..(305): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtncaactggtggagactgggcggaggcttggtccaggccgtggggcggtctctgagtactgtcctgtgaccctcgtggggtctccgtcagcagcgactgtatgccgtgggtccncaggctccgagggaagcgggccggagtcgggtcgtcgtaggttatttttagagggttcgggaaccgtactagttcgtacgggagtaacctccgaagtcggggacggggcctattaccaccgatcctacccgagtacgttacttttccacgaaacggtaaacctacgtaacttcgttaccttactttaaaccgaaaatttcgggaaaacctacggtaccccggttagggaaccgggggaccccggaaagggtaacccgaaccggggtcccgtttaacttaacgtttaagttgggtgttaagggtaagtttacggttttaacgggcgggtaacgtcgggttcggggttcggttaggggtaacgacgtaacggtacgtcggttaccggggtcgggggaacccgtaacgggg

SEQ ID NO: 319894 - DNA, 590 bp, Homo sapiens
  misc_feature: GZ8MTXP01EV9U7.19.67.G01.1.454.CMB.2.raw
  modified_base (464)..(464): a, c, t, g, unknown or other
  misc_feature (464)..(464): n is a, c, g, or t
  modified_base (531)..(531): a, c, t, g, unknown or other
  misc_feature (531)..(531): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtggcggaggcttggtccagcctgggcggtctctgagactgtcctgtgaaccctcgtggggtctccgtcagcagcgactgtatgcctgggtccgccaggctccgagggaagagggccggaggtgggtcgcgtaggttattttagagggtgggaccgactattcgtacggagaactccaagtgggagggccgattcacctatctaccagtacgtactttcactagaacctactactgtcttcttacaaatcgaaacgngtcccgtaggacggggccgaacgggaccacgggtcctcgttattaagttgtgtgtagttaggtttangggtcgagttgggcttggggtgacgtaagactcgacggtcgggggttccgaaccggggg

SEQ ID NO: 319895 - DNA, 532 bp, Homo sapiens
  misc_feature: GZ8MTXP01BP0CB.19.67.G01.1.454.CMB.2.raw
  modified_base (221)..(221): a, c, t, g, unknown or other
  misc_feature (221)..(221): n is a, c, g, or t
  modified_base (288)..(288): a, c, t, g, unknown or other
  misc_feature (288)..(288): n is a, c, g, or t
  modified_base (329)..(329): a, c, t, g, unknown or other
  misc_feature (329)..(329): n is a, c, g, or t
  modified_base (359)..(359): a, c, t, g, unknown or other
  misc_feature (359)..(359): n is a, c, g, or t
  modified_base (368)..(368): a, c, t, g, unknown or other
  misc_feature (368)..(368): n is a, c, g, or t
  modified_base (377)..(377): a, c, t, g, unknown or other
  misc_feature (377)..(377): n is a, c, g, or t
  modified_base (433)..(433): a, c, t, g, unknown or other
  misc_feature (433)..(433): n is a, c, g, or t
tcagtactctcgtgcacgaccggtgctcgatttagagtatacatattgggtttggggggtagctcaggaagcagagcctggagcatctccactatggcctgggctccactacttctcaccctcctcgctcactgcacaggttcttgggccaactttatgctgactcagccccactctgtgtcggagtcgtccggggaagacggtaaccatctttgcaccanaacagtggcaacattgccagctaattttgtgcagtggtacagcagccgccggcacgtccccacatgngatctatgagataatacaaagcgtcgtgggtcctgatcgtntctcggctcatcgacagcctccacaactcncgcctcccncaccatctntgactagaagcgtaggaggacgaggctagacttacctacgtgtcaacgttcttaangactagccgtcgtcagtcgtggtcgtcgggcggaggaccgaagtcgttacggccgttcgtaaggtcgaacgcccgaggttcctccgttccccgttccgg

SEQ ID NO: 319896 - DNA, 643 bp, Homo sapiens
  misc_feature: GZ8MTXP01BFHGP.19.67.G01.1.454.CMB.2.raw
  modified_base (571)..(571): a, c, t, g, unknown or other
  misc_feature (571)..(571): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtggcggaggcttggtccagccgtgggcggtctctgagactgtctgtcgaccctgtggggtctcgtcagcagcgactgtatgccgtgggtccgccaggctccgaggggaagagggccgggaggtgggtcgcgtaggttattttagagggtgggaccgactagttcgacggagaacctccaagtgggacggggcccgattccaaccgtacttcctacccgagtacgtacctttctacaagaaacctactactgtaccttcttaacaaagtacgaaacgagtacccgtagggaacgggacccggaaggaccgtaccgggtacccgttacgttaagtttaagttgtggtaaggtagttaggtttangggtcgtaagttgggcgttggggtaacggagtaagtacgtcgaacgggtcggggttaaccgtaacccggggg

SEQ ID NO: 319897 - DNA, 694 bp, Homo sapiens
  misc_feature: GZ8MTXP01CHO0Q.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgcaacgtggtggagacgtgggcggaggcttggtccaggccgtggggcggtctctgagactgtcctggtcgaccctcgtcggggtcctcgtcagcagcgactgtattcgccgtgggtccgccaggcctccgagggaagagggccggaggtgggtcgcgtaggtttattttagagggtagggaccgactagttacgtacgggagtaaccgtcccgtaagtggggacggggtacccgtagttaccaccgtatcccgtacaagtacgttacttttactacaacgaaacacctaacttcgttacttacttaacgtaaattacgaaacgtacggtccgttaggaacgggggaccgaacgggaacccgtaccgggtacccgttacgttaacgttttagttaggttggttaaggtaaggttaagggttttaagttggggacgttaagttgggttgttacggggtaagacgtaagtacgtacgttacggtcggggccgtaaacccggggg

SEQ ID NO: 319898 - DNA, 673 bp, Homo sapiens
  misc_feature: GZ8MTXP01C88NB.19.67.G01.1.454.CMB.2.raw
  modified_base (377)..(377): a, c, t, g, unknown or other
  misc_feature (377)..(377): n is a, c, g, or t
  modified_base (566)..(566): a, c, t, g, unknown or other
  misc_feature (566)..(566): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgcaactgggtggagacgtgggcggaggcttggtccagccgtggggccggtctctgagactgtcctggtcgaaccctcgtggggtctccgtcagcagcgactgtattcgccgtgggtcccgccgaggcctaccggaaggggaagacgggccggaggtcggggtcgacgtaggtttattttaaggnggtacgggaaccgtactagttcgtaacggacgtaacctccgaagtgggaacgggtcccgtaattcccaaccgtatccctacagtacgttaccttttcacgaagaaacctactacttcgtacttactaacaaaatcgaaacgtacgtaccgtaggaccggggaccgaacggacccgaccggtacccgttnttaagtttagttggtgtaagtaaggttagtttagcgggtacgtagttcgggttcgttagggtaagaacgaaggtactacggacggtcgggggaacccgtaaccgggg

SEQ ID NO: 319899 - DNA, 573 bp, Homo sapiens
  misc_feature: GZ8MTXP01B1WMQ.19.67.G01.1.454.CMB.2.raw
  modified_base (525)..(525): a, c, t, g, unknown or other
  misc_feature (525)..(525): n is a, c, g, or t
  modified_base (535)..(535): a, c, t, g, unknown or other
  misc_feature (535)..(535): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgcaactggtggagacgtgggcggaggcttggtccagccgtggggcggtctctgagactgtcctgtcgaaccctctggggtctccgtcagcagcgactgtattgcctgggtccgcaggctccgagggagaggccggagtgggtcgcgtaggttatttttagagggtgggaccgacgtattcgacgggagaactccaagtgggagggccgtattccgaccatcctaccagtacgtacttttcactaagaaaccactaactgttctacttacaaatcgaacagccgtagacggggccgacggacgacggccgtctattatgtgtgagttgttagngtcgattggngttgggtgacaagtatcgacgtcggggcgtaaccgggg

SEQ ID NO: 319900 - DNA, 653 bp, Homo sapiens
  misc_feature: GZ8MTXP01A2IUN.19.67.G01.1.454.CMB.2.raw
  modified_base (586)..(586): a, c, t, g, unknown or other
  misc_feature (586)..(586): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtgggcggaggcttggtccaggcctggggcggtctctgagactgtcctgtcgaaccctcgtgggggtctccgtcagcagcgatgtattgccgtgggtccgccgaggctccgagggaagaggccggagtgggtcgcgaggttattttagagggtgggaccgactagtttcgtaacggagaaaccttcccgaagtcggggaacggggcccgtaattccgacccagttcctaccctaaggtacgtacctttttctacgaagaaaccactacctgttacttccttacaaagttcgaaacgagtccgtaggacggggacccgaacgggaccgaccgggtcccgttacgttatttagttagtgtggtaaagttaggttttaagngggtcgtaagttgggttcgttgggtgggacctaaggacgtcgacgggtcggggccgtaacccggggg

SEQ ID NO: 319901 - DNA, 633 bp, Homo sapiens
  misc_feature: GZ8MTXP01AYZ3E.19.67.G01.1.454.CMB.2.raw
  modified_base (393)..(393): a, c, t, g, unknown or other
  misc_feature (393)..(393): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtgggcggaggcttggtccagccgtggggcgtctctgagactgtcctgtcgaaccctcgtggggtctcgtcagcagcgactgtattgccgtgggtccgccgaggctccgaggggaagaggccggaggtgggtcgcgtaggttattttagtagggtggaccgactagttcgtacggagaactccgngtgggacgggccgattcacctatcctccagtacgtactttcacaagaacactactgtccttacttacaaagttcgaacgacgtccgtaggacggggaccgaagggaccgaccgggtccgttacttaagtttaagttggtaggtggtaaggttaggttttaggttcgggtacgtaaggttgggttccgttaggggtcggacgtaaggacgtcgacgggttcggggaaccgtaacccggggg

SEQ ID NO: 319902 - DNA, 665 bp, Homo sapiens
  misc_feature: GZ8MTXP01EIPGP.19.67.G01.1.454.CMB.2.raw
  modified_base (274)..(274): a, c, t, g, unknown or other
  misc_feature (274)..(274): n is a, c, g, or t
  modified_base (299)..(299): a, c, t, g, unknown or other
  misc_feature (299)..(299): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggtttccttgctacaatttcaggaggtgtccagtgtgaggtgcaactggtggagacgtggcggaggcttgggtccagccgtgggcggtctctgagactgtcctgtgaaccctgtgggtctccgnagcagcgactgtatgcctgggtccnccaggctccgaggggacgaggccggagtgggtcgcgtagggttattttagagggtgggacgactagttcgtaacgggagtacctacccaagtgggggaaacgggggtccctaatttcccgaacccctagtccctacccgtagacgttaacctttttcacaagtaacaactacttgtccttacttaccaaaattgaaaccaggggtcccgtaggacggggacccgaagggacccaccggggtccttacttaagttaagttggtgtaggtaagttaaggttttagtcgggttacggtagtttcgggcgttggggttacggaacgtagtaacgtcgacggttacggggcccgttaacggggtaaccccg

SEQ ID NO: 319903 - DNA, 606 bp, Homo sapiens
  misc_feature: GZ8MTXP01AWTYT.19.67.G01.1.454.CMB.2.raw
  modified_base (234)..(234): a, c, t, g, unknown or other
  misc_feature (234)..(234): n is a, c, g, or t
  modified_base (239)..(239): a, c, t, g, unknown or other
  misc_feature (239)..(239): n is a, c, g, or t
  modified_base (461)..(461): a, c, t, g, unknown or other
  misc_feature (461)..(461): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctcgtgggcgagacggccacaatcaactgcaggtccagccagaactntttcnccacctacaaagaactaaaacttctagcctaggtaaccaacagagaccaggacacgccctacctaagttcgctctatttacgtgggtccttcgtacgcgacgtaacgttccgggggtccctggacccccgtagttccgggggcagggtccggggtacgtggggaacaggtactttccaccttcctacaccatccagccacgccctgcgagggctaggaaagngttggtggacttagtttatactgtcagtacttaatttcttttctacttcccgtcggtggtaccgttcgggaaccgaaggggttaccgtaggggttacgaaactcgaaggacgttacgtggtggctcggccttactaacttcgtcg

SEQ ID NO: 319904 - DNA, 648 bp, Homo sapiens
  misc_feature: GZ8MTXP01D9N1E.19.67.G01.1.454.CMB.2.raw
  modified_base (485)..(485): a, c, t, g, unknown or other
  misc_feature (485)..(485): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagactggcggaggcttggtccagcctgggcggtctctgagactgtcctgtcgaaccctcgtggggtctccgtcagcagcgactgtattgccgtgggtcccgccagggctccgaggggaagagggccggaggtgggtcgcgtaggttatttttagagggtgggacccgactatttcgtaacgggagtaaacccttccaaggtggggaaacggggcccgtaatttacccgaacccattcctaccagtacgtacttttctacaagaaacactactgtctcttanaaactgaaacgagcctaggacggggaccgagggaaccaccgggtaccgttacgtaagtttagttggtgtaagtaaggttaggtttaagttgggtacgtagttgggttcgttgggtaaggacgtaagtacgtcgttaacggtcgggggaaccgtaacccggggg

SEQ ID NO: 319905 - DNA, 621 bp, Homo sapiens
  misc_feature: GZ8MTXP01DNH51.19.67.G01.1.454.CMB.2.raw
  modified_base (369)..(369): a, c, t, g, unknown or other
  misc_feature (369)..(369): n is a, c, g, or t
  modified_base (402)..(402): a, c, t, g, unknown or other
  misc_feature (402)..(402): n is a, c, g, or t
  modified_base (560)..(560): a, c, t, g, unknown or other
  misc_feature (560)..(560): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgcaacgtggtggagacgtgggcggaggcttggtccagcccgtggggccggtctcgtgagactgtcctgtcgtaacccgtctggggtctccgtcagcagcgactgtagttgccgtgggtcccgccaggcctccgaggggaagagggccggaggtgggtcgcgtaggttatttttagngggtgggaacgactattcgtacggagaactccngtgggagggccagttccacatctacccagtacgtacttttctcaaacgaaaccactacttcgtcttacttaacaaactagtaacgacgccgtacggacggggaccgaggaccgaccggtaccgtacttagtttagttggttgtggtagttagtttagnggtacgtagttgggttagttgggtaaggactggactcgacggtcggggccgtaacccgggg

SEQ ID NO: 319906 - DNA, 584 bp, Homo sapiens
  misc_feature: GZ8MTXP01C44X9.19.67.G01.1.454.CMB.2.raw
  modified_base (204)..(204): a, c, t, g, unknown or other
  misc_feature (204)..(204): n is a, c, g, or t
  modified_base (236)..(236): a, c, t, g, unknown or other
  misc_feature (236)..(236): n is a, c, g, or t
  modified_base (313)..(313): a, c, t, g, unknown or other
  misc_feature (313)..(313): n is a, c, g, or t
  modified_base (366)..(366): a, c, t, g, unknown or other
  misc_feature (366)..(366): n is a, c, g, or t
  modified_base (422)..(422): a, c, t, g, unknown or other
  misc_feature (422)..(422): n is a, c, g, or t
  modified_base (425)..(425): a, c, t, g, unknown or other
  misc_feature (425)..(425): n is a, c, g, or t
tcagtactctcgtgcacgaccggtgctcgatttagagtatacatattgggtttggggagctacaacaggcaggcaggggcagcaagatggtgttgcagacccaggtcttcatttctctgttgctctggatctctggttcctgcgggacatcgtgatgacccagtacccagactcactggctgtgtctctgggcgagacggccanaatcaactgcaggtccagccagaactatttcnccacctaccaaagaacaaaacttctagcctaggtaccaacagagaccaggacagcctacctaagttgctcatttacngggctttctacgcgacgaagttccggggtccctggaccccgagttccgggggnaggcgggtctgggaacagtatttcactctcaccatcagcagcctgcaggctagaantgnggactagtttatactgtacagtactaaatttactttttctaactcccgttaccggtggtaccgtttccgggaaccgtaaacggggccgtaaggggttaggtaaaactcgaaacggacgttaaacgtgggtaggcttcggaccaccgtaattccgtttcg

SEQ ID NO: 319907 - DNA, 569 bp, Homo sapiens
  misc_feature: GZ8MTXP01ELXHY.19.67.G01.1.454.CMB.2.raw
  modified_base (526)..(526): a, c, t, g, unknown or other
  misc_feature (526)..(526): n is a, c, g, or t
  modified_base (542)..(542): a, c, t, g, unknown or other
  misc_feature (542)..(542): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctggggcgtctctgagactgtcctggtcgaacccctcgtggggtctccgtcagcagcgactgtatgcctgggtccgccaggctccgagggagaggccgggagtgggtcgcgtaggttatttttagtagggtgggaccgactattctacggagaaccttccaagttgggacgggccgattccaccgaatctaccagagtacttttcactagaaaccacacttgtcttactacaaatgaacagcctgacgggccgaggacacggccgtctattatgtgtaagagttagttattggcgtagnggttgttggtggacgngtagtccagtcgggggccgtaacgggg

SEQ ID NO: 319908 - DNA, 588 bp, Homo sapiens
  misc_feature: GZ8MTXP01BMRON.19.67.G01.1.454.CMB.2.raw
  modified_base (500)..(500): a, c, t, g, unknown or other
  misc_feature (500)..(500): n is a, c, g, or t
  modified_base (528)..(528): a, c, t, g, unknown or other
  misc_feature (528)..(528): n is a, c, g, or t
  modified_base (557)..(557): a, c, t, g, unknown or other
  misc_feature (557)..(557): n is a, c, g, or t
tcagtactctcgtgcacgaccggtgctcgatttagagtatacatattgggtttgggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtgggcggaggcttgggtccagcctggggcggtctctgagactgtcctgtcgaaccctctgggggtctccgtcagcagcgactgtattgcctgggtccgccaggctccgaggggagaggccggaggtgggtcgcgaggttatttttagtagggtggggaaccgactattcgtaacgggagaacctccaagtgggaagggccgattccaccgatctccagacgtactttctcaagaacacactgtctcttacaaatgaacagtccctgacgggccgaaggaccgacgggtcccgtnttattagttgtgtgtaagttagtttagngggtacgtagttgggcgttgggtggacgngtacgtcgacggtcgggggcctaaccggggg

SEQ ID NO: 319909 - DNA, 619 bp, Homo sapiens
  misc_feature: GZ8MTXP01AN9ZJ.19.67.G01.1.454.CMB.2.raw
  modified_base (276)..(276): a, c, t, g, unknown or other
  misc_feature (276)..(276): n is a, c, g, or t
  modified_base (292)..(292): a, c, t, g, unknown or other
  misc_feature (292)..(292): n is a, c, g, or t
  modified_base (407)..(407): a, c, t, g, unknown or other
  misc_feature (407)..(407): n is a, c, g, or t
  modified_base (487)..(487): a, c, t, g, unknown or other
  misc_feature (487)..(487): n is a, c, g, or t
tcagtactctcgtgcacgaccggtgctcgatttagagtatacatattgggtttgggggtagctcaggaagcagagcctggagcatctccactatggcctgggctccactacttctcaccctcctcgctcactgcacaggttcttgggccaactttatgctgactcacgccccactctgtgtcggagtcgtcggggaagacggtaaccattctttgcaccacaacagtggcaacattgccagctaattttgtgcaggtgtaccagcagcggcccggnacgtcccccacattgngatctatgagataagtacaaaaggccgtgtcgggggtccctgtacgttcggttctcgtcggcctcagtcgacaacgcctccctaccaaacctcgtcctccctaccctcaaacccncttcgtcgttacgggaaccttaggaaacgaccgtaggagggacgtaacggcttacggacttactaccgtggtccgtactntttagtgaacgttcggcccgtcgggttgtaggttcggttcgggttcggtacggggcgggaacggaccgtaacggtccgttacggttccgttcgtaacgccgaaccgacccgacggccgtcccgttcccgtcg

SEQ ID NO: 319910 - DNA, 558 bp, Homo sapiens
  misc_feature: GZ8MTXP01D4BPX.19.67.G01.1.454.CMB.2.raw
  modified_base (332)..(332): a, c, t, g, unknown or other
  misc_feature (332)..(332): n is a, c, g, or t
  modified_base (417)..(417): a, c, t, g, unknown or other
  misc_feature (417)..(417): n is a, c, g, or t
  modified_base (424)..(424): a, c, t, g, unknown or other
  misc_feature (424)..(424): n is a, c, g, or t
  modified_base (522)..(522): a, c, t, g, unknown or other
  misc_feature (522)..(522): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagtttggctgacctgggttttcctgctgcaatttcaggaggtgtccagtgtgaggtgcaactggtggagactgggcggaggcttgggtccagcctgggcgtcgtctggagacgtgtcctgtgacctgtgggtctcgtcagcagcgactgtatgcctggtccgccaggcctcgagggaagaggccggagtgggtcncaggttattttagaggtggggacacgatttcgaaacgggatctcaagtcgggaacgggccgaattcaccatcctcagatactttnaccaaanaacacactgtactactactaagtacgacgacgacgtacggacggacgacggacgacgtaccgtacgtacttagtgtgttagtagttagttagtgttgngttggtgtggtaacggacgtagacgtcgcggtcggg

SEQ ID NO: 319911 - DNA, 606 bp, Homo sapiens
  misc_feature: GZ8MTXP01AMCUY.19.67.G01.1.454.CMB.2.raw
  modified_base (221)..(221): a, c, t, g, unknown or other
  misc_feature (221)..(221): n is a, c, g, or t
  modified_base (368)..(368): a, c, t, g, unknown or other
  misc_feature (368)..(368): n is a, c, g, or t
  modified_base (385)..(385): a, c, t, g, unknown or other
  misc_feature (385)..(385): n is a, c, g, or t
tcagtactctcgtgcacgaccggtgctcgatttagagtatacatattgggtttggggggtagctcaggaagcagagcctggagcatctccactatggcctgggctccactacttctcaccctcctcgctcactgcacaggttcttgggccaactttatgctgactcagccccactctgtgtcggagtctccggggaagacggtaaccatctttgcacccanaacagtgcaacatgccagctaatttgtgcagtggtaccagcagcgcccggcacgttcccccacatgtgatctatgagataatcaaagccgtcgtggggtccctgatcggttctcgtcggctcatccgacaacgcctcctccaactcncgccctcctcaaccctntctcgtagacagaacgacgtggacggacgacgtctacgtaaccttaccgtacgtcgtacgtacgttacgttagtacgtacgtccggccggtacgtcgtacgttcgggtcggttccggttcggggacgggtaaacggacccgtacggtaccgttaccggttcccgttaccgtaacggtaccgaacccggacccggtacggttcccgtcccgttcccccgtcg

SEQ ID NO: 319912 - DNA, 678 bp, Homo sapiens
  misc_feature: GZ8MTXP01DMSME.19.67.G01.1.454.CMB.2.raw
  modified_base (602)..(602): a, c, t, g, unknown or other
  misc_feature (602)..(602): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtgggtggagacgtgggcggaggcttgggtccaggccgtggggcggtctcgtgagactgtcctgtcgaacccctcgtggggtctccgtcagcagcgactgtattcgccgtgggtccccgccgaggcctaccgaggggaaggacggccgggaggtcgggtcgcgtaggttattttagagggtcggaccgactattcgtacggagaaccttccgaagtcgggacgggccgattccaccgactccctaccgagtacgttaccttttcacaaagaaacctactacttcgttacttacttaacaaagtcgaaacgacggtcccgtagggaaccggggacccggaacgggaacccgacgggtacccgtttagttaagtttagttggtggttaaggtaaggttaggtttagngggtacgtaggttgggttcgttaggggtaaggaacgaaggtacgtacgacgggtcgggggaaccgtaacccggggg

SEQ ID NO: 319913 - DNA, 631 bp, Homo sapiens
  misc_feature: GZ8MTXP01B5FJL.19.67.G01.1.454.CMB.2.raw
  modified_base (398)..(398): a, c, t, g, unknown or other
  misc_feature (398)..(398): n is a, c, g, or t
  modified_base (553)..(553): a, c, t, g, unknown or other
  misc_feature (553)..(553): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgcaacgtggtggagacgtgggcggaggcttgggtccaggccgtggggcggtctcgtgagactgtcctgtcgaacccgtcgtggggtctccgtcagcagcgactgtattgcctgggtccgccaggctccgaggggaagaggccgggagtggggtcgcgtaggttatttttagaggtgggaccgactagttcgtacggagaactccngtgggagggccgtattcacatcctaccagtacgtactttctacagaaacacactcgtcttcttacaaattcgaacgacgtccgtgggacggggccgaacgggaccgaccggtccgttacttagtttagttggtaggtggtaagttaggtttaagngggtacggtagttcgggttacggttgggtaaggaacgaagtaacgtcgacgggttcgggggaacccgtaaaccggggg

SEQ ID NO: 319914 - DNA, 621 bp, Homo sapiens
  misc_feature: GZ8MTXP01C2X8T.19.67.G01.1.454.CMB.2.raw
  modified_base (567)..(567): a, c, t, g, unknown or other
  misc_feature (567)..(567): n is a, c, g, or t
  modified_base (580)..(580): a, c, t, g, unknown or other
  misc_feature (580)..(580): n is a, c, g, or t
  modified_base (592)..(592): a, c, t, g, unknown or other
  misc_feature (592)..(592): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgctaatttcaggaggtgtccagtgtgaggtgcaacgtggtggagacgtgggcggaggcttggtccagccgtggggcggtctctgagactgtcctgtcgaaccctcgtggggtctccgtcagcagcgactgtattgcctgggtcccgccaggctccgaggggaagagggccggaggtggggtcgcgtaggttatttttagagggtgggaccgactattcgtacggagtaacctaccgaagtgggacggggacccgtaattccggcctaatccctacccagaacgtacttttcacaacgaaaccactacttcgtaccttacttacgaaaattcgaacgaacgcccgtaggacggggccgacggaccacggtaccgtctaattagttgtgtaagagttgtttaagnggtcgagttgggnttagggtgacgngtactcgacggtcggggccgtaaccgggg

SEQ ID NO: 319915 - DNA, 638 bp, Homo sapiens
  misc_feature: GZ8MTXP01BQNFI.19.67.G01.1.454.CMB.2.raw
  modified_base (439)..(439): a, c, t, g, unknown or other
  misc_feature (439)..(439): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtgggcggaggcttggtccaggccgtggggcggtctcgtgagactgtcctgtcgaccctcgtggggtctccgtcagcagcgactgtattgccgtgggtcccgccaggctccgaggggaagaggccggaggtgggtcgcgtaggttattttagaggtggaccgtactagttcgtacggagaacctccgaagtgggacgggccgattcaccatcctccagtacgtacttttcnctaagaacactactcgtactacttacaaatcgaacgacgtccgtaggacggggaccggacggaccgtaccgggaccgttacttaagtttagttggttggtaagttaaggttaggttttaacgttgggtcgtaaggttcgggttcggttggggtgggactaaggacgttcgacggttcgggggaacccgtaacccggggg

SEQ ID NO: 319916 - DNA, 728 bp, Homo sapiens
  misc_feature: GZ8MTXP01CN1FG.19.67.G01.1.454.CMB.2.raw
  modified_base (324)..(324): a, c, t, g, unknown or other
  misc_feature (324)..(324): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtgggcggaggcttggtccagccgtgggcggtctctgagactgtcctgtcgaccctcgtggggtctccgtcagcagcactgtattgcctgggtccgccgaggctccgaaggggaagngggccggaggtcgggtcgcgtaggttattttagtagggtgggaccgactagttcgaacggacgaaccttccgaagtcggggaacgggcccgtaattcccgaacctatccctacccgtaagtacggttaacctttttccgtaccgtaacggaaacctacctaaccttcgttaccttactttaaccaaagttacgaaaccgaggtacccgtagggaaccgggggacccgaacggggacccgaaccggggtaccccgttacttaaacgtttagtttggtggttaagggtaaaggttaggtttttaaagcggggtaacgttggttcgggttcggttagggggttaacggaaccgtaagggaacttccggaaaccgggttcgggggaaccccggttaaaccccgggggg

SEQ ID NO: 319917 - DNA, 623 bp, Homo sapiens
  misc_feature: GZ8MTXP01BE90T.19.67.G01.1.454.CMB.2.raw
  modified_base (590)..(590): a, c, t, g, unknown or other
  misc_feature (590)..(590): n is a, c, g, or t
  modified_base (601)..(601): a, c, t, g, unknown or other
  misc_feature (601)..(601): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtgggcggaggtcttgggtccagccgtggggcgtctcgtgagactgtcctgtcgaaccctcgtggggtctccgtcagcagcgactgtagtgccgtgggtccgccgaggcctccgaggggaagacgggccgggaggtcgggtcgcgtaggtttattttagagggtgggaccgactagttacgtacgggagaacctccgaagttgggacgggcccgtagttcacccgtatcctaccaagagtaccttttcacgaagaaccactactgtcctacttacaatgaacgtacgcgtagggacgggccgacggaccgacgggtcccttattagttagttggtggtaaggtaaggttagttttagcgggtcgtaagttggttcgttgggnggacaagtacncgacggtggggccgaaccgggg

SEQ ID NO: 319918 - DNA, 552 bp, Homo sapiens
  misc_feature: GZ8MTXP01BT03J.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccgagggagaggccggagtgggtcgcaggtatttttagaggtgggaccgacattcgtacggagaactccaagtgggagggccgattcaccatcctccagagacttttctcagaacacactgtctcttacaaatgaacagcctgacgggccgaggacacggccgtctattattgtgtgtagttagtttattgggcgagttgggcgttgggtgggacaagtgtcgacgtgggggcccgtaaccgggg

SEQ ID NO: 319919 - DNA, 529 bp, Homo sapiens
  misc_feature: GZ8MTXP01D1FST.19.67.G01.1.454.CMB.2.raw
  modified_base (293)..(293): a, c, t, g, unknown or other
  misc_feature (293)..(293): n is a, c, g, or t
  modified_base (344)..(344): a, c, t, g, unknown or other
  misc_feature (344)..(344): n is a, c, g, or t
  modified_base (463)..(463): a, c, t, g, unknown or other
  misc_feature (463)..(463): n is a, c, g, or t
tcagtactctcgtgcacgaccggtgctcgatttagagtatacatattgggtttggggggtagctcaggaagcagagcctggagcatctccactatggcctgggctccactacttctcaccctcctcgctcactgcacaggttcttgggccaactttatgctgactcagccccatctgtgtcggagtcgtccggggaagacggtaaccatcttttgcacccacaacagtgcaacattgccagcaaattttgtgcagtggtaccagcagcgcccgggcacgttcccccacattgngatctatgaggataaatcaaaagaccgtcgtgggggtccctgatcggttcncgtcggctcatcgacaacgcctcctccaaactcctcgcccctccctcaccatcgtctggactgaagactggaagacgaggctgaactactacgtgtcagttctatgagtagccgcggtnagtgtggtcgtcggcggacgacgagcgttcgcgttcgtaagacgcgaccgacgcctccgcccgtcg

SEQ ID NO: 319920 - DNA, 700 bp, Homo sapiens
  misc_feature: GZ8MTXP01ER49K.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtgggcggaggtcttggtccaggccgtggggcggttctcgtgagactgtcctgtcgaacccgtgtcggggtctccgtcagcagcgactgtattcgccgtgggtccgccgaggcctccgaggggaaggacgggccgggaggtcgggtcgcgtagggtttattttaggaggggtcgggaaccgactattcgtaacgggagtaacctccgaaggtcgggaggggcccagttccaccatcctccaggtacgttacttttcacaagtaaacactacttcgtccttacttacaaaattcgaacgacgtcgtacggaacggggccgaacgggaccgtaccgggtacccgttacttaagtttaagtttggtggttaaggtaaggtttaggttttaacggttggggtaccggtaaggttcgggttcggttagggggtaacgggtaccgaaggtacgtaccgggaccgggttcgggggttaaccccgggtaaaccccggggg

SEQ ID NO: 319921 - DNA, 575 bp, Homo sapiens
  misc_feature: GZ8MTXP01E43DH.19.67.G01.1.454.CMB.2.raw
  modified_base (340)..(340): a, c, t, g, unknown or other
  misc_feature (340)..(340): n is a, c, g, or t
  modified_base (540)..(540): a, c, t, g, unknown or other
  misc_feature (540)..(540): n is a, c, g, or t
  modified_base (552)..(552): a, c, t, g, unknown or other
  misc_feature (552)..(552): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttgggtccagcctggggcggtctctgagactgtcctgtgaaccctgtggggtctccgcagcagcgactgtattgccgtgggtccgcaggctccgaggggaagaggccggagtggggtcncgtaggttatttttagagggtgggacgacgtattcgtaaacgggagaactccgagtcggggaggggcccgaattccgaccatctacccaggtagtaccttttctacaagaacacactgtctacttacaaatgaaactagcctggacgggccgaaggaccgacggtcccgttatattagttgtgttggagttagtttaggnggcgttgttggngtggtgacagactcgcggtcggg

SEQ ID NO: 319922 - DNA, 596 bp, Homo sapiens
  misc_feature: GZ8MTXP01CSNUD.19.67.G01.1.454.CMB.2.raw
  modified_base (434)..(434): a, c, t, g, unknown or other
  misc_feature (434)..(434): n is a, c, g, or t
  modified_base (541)..(541): a, c, t, g, unknown or other
  misc_feature (541)..(541): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtgggcggaggcttggtccagccgtggggcggtctctgagactgtcctgtcgaaccctcgtggggtctccgtcagcagcgactgtattgcctgggtccgccaggctccgaggggaagaggccggaggtgggtcgcgtaggttattttagtaggtgggaccgacagttcgacggagaacctccaagtgggacgggccgattccacctatcctccagagtaccttttcnctaagaactacactgtcttcttacaaaattcgaaacgacgcccgtaggacggggaccgaagggaccgacgggtcccgtcttattattgtggtgaagttgttttaggnggtcgtgttggttgttgggtgagtgacgtcggacgggtcggggaaccgtaacggg

SEQ ID NO: 319923 - DNA, 617 bp, Homo sapiens
  misc_feature: GZ8MTXP01A4E6L.19.67.G01.1.454.CMB.2.raw
  modified_base (546)..(546): a, c, t, g, unknown or other
  misc_feature (546)..(546): n is a, c, g, or t
  modified_base (564)..(564): a, c, t, g, unknown or other
  misc_feature (564)..(564): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttgggtccagcctggggcgtctctgagactgtcctgtcgaaccctgtggggtctccgtcagcagcgactgtatgccgtgggtccgccaggctccgaggggaagaggccgggaggtgggtcgcgtaggttattttagagggtggaccgactagttcgtaacggagaactccgaagtcggggacgggcccgtaattccgaacctatccctaccaagtacgtacttttcacaagaaaccactactgtacttcttacaaattcgaaacgacgtccgtaggacgggccgaaggaccgacggtccgtactattagtgtgtgtagttagtttagnggtacgtagttcgggttnttgggtaacgggactaaggacgtcggaacgttcgggggaacccgtaaccgggg

SEQ ID NO: 319924 - DNA, 664 bp, Homo sapiens
  misc_feature: GZ8MTXP01COHR2.19.67.G01.1.454.CMB.2.raw
  modified_base (278)..(278): a, c, t, g, unknown or other
  misc_feature (278)..(278): n is a, c, g, or t
  modified_base (596)..(596): a, c, t, g, unknown or other
  misc_feature (596)..(596): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgcaactggtggagacgtgggcggaggcttggtccagccgtggggcggtctctgagactgtcctgtcgaccctgtgggtctccgtnagcagcgactgtattcgccgtgggtcccgccgaggcctaccgaggggaacgagggccgggaggtggggtcgcgtaggttatttttagagggtcgggacctacgtatttcgacgggagaacctccgaagtcggggacgggcctattccacctatcctaccgtagacgttaccttttcacgaagaaacacctaacttcgttaccttacttaacaaagtacgaaaccgacggtcccgtagggaacgggggcccggaacgggacccgaccggggtcccgttacgttagtttagttggtggtaagtaaggttagttttacggngggtacgtgttcgggttcggttgggtaagacgtaagtacgtacgaccgggtcggggaaccgtaacggg

SEQ ID NO: 319925 - DNA, 715 bp, Homo sapiens
  misc_feature: GZ8MTXP01AWYBI.19.67.G01.1.454.CMB.2.raw
  modified_base (639)..(639): a, c, t, g, unknown or other
  misc_feature (639)..(639): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgctaatttcaggaggtgtccagtgtgaggtgcaacgtgggtggagacgtgggcggaggcttggtccaggccgtggggcggtctcgtgagactgtcctggtcgaaccctcgtggggtcctccgtcagcagcgtactgtattcggccgtcgggtcccgccgaggcctaccggaagggggtaaacggacgggggccggggtagggttcgggggtaccggtacgttaagggttttaagttttttaggagggggtcggggaaacccgtacgtagtttccgaacgggtagtaaccctaccgaaggtcgggggacgggaccccgtatttcccgaaccctattcccgtaccgaagtacgttacttttccgactaacgaacctacgtactcgtcttactacaaatcgaacaggtccgtagggacgggaccgaggaccgaccggtaccgtgttaactttagttggtggtaagtaaggttgtttagnggtacgtagttggggttcttaggggtcgaacgtaagtacgtacggaccgggtcggggttaacccggtaacccgggg

SEQ ID NO: 319926 - DNA, 643 bp, Homo sapiens
  misc_feature: GZ8MTXP01A9727.19.67.G01.1.454.CMB.2.raw
  modified_base (243)..(243): a, c, t, g, unknown or other
  misc_feature (243)..(243): n is a, c, g, or t
  modified_base (275)..(275): a, c, t, g, unknown or other
  misc_feature (275)..(275): n is a, c, g, or t
  modified_base (318)..(318): a, c, t, g, unknown or other
  misc_feature (318)..(318): n is a, c, g, or t
  modified_base (638)..(638): a, c, t, g, unknown or other
  misc_feature (638)..(638): n is a, c, g, or t
  modified_base (640)..(640): a, c, t, g, unknown or other
  misc_feature (640)..(640): n is a, c, g, or t
  modified_base (642)..(642): a, c, t, g, unknown or other
  misc_feature (642)..(642): n is a, c, g, or t
tcagtactctcgtgcacgaccggtgctcgatttagagtatacatattgggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggaggccgattcaccatctccagagtacttttcncagaacacactgtctcttcaaatgaacagccnggagggccgagacacggccgtctattatgtgtgagtagtttanggcgatgggctgggtagacagatcgacgtcggggccaggggaacccctggtaccaccgtctcctcgacgcccctaccaccgaacggggcccctagtcccggttcctcccccgtggcccgccccttgaccctccgacggacgccacccgtaccgaacgacggccgaaccgacggtcccggccccgttgggggcctcggcccgttagggtacccaaacggggtacccttaacccgtttccccgaaacgggttacgtaacgttacggtacgggaacggccgggggttcttacggggaacgaacggggcgtaccgagttacggngngng

SEQ ID NO: 319927 - DNA, 615 bp, Homo sapiens
  misc_feature: GZ8MTXP01B3XTR.19.67.G01.1.454.CMB.2.raw
  modified_base (486)..(486): a, c, t, g, unknown or other
  misc_feature (486)..(486): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtgggcggaggcttgggtccaggccgtggggcggtctctggagactgtcctgtcgaacccctcgtggggtctccgtcagcagcgactgtattgccgtgggtccgccaggctccgaggggaagaggccgggaggtgggtcgcgtaggttatttttagtagggtggggaccgacgagttcgtacggagaaccttccgaagtgggaggggccgtaattccaccgatcctccagtacgtactttctacagaacacactgtcttacttacaaattcgaaacgngtaccgtggaacggggcccgaaggaccgacgggcccgttacttattaattggtgtggagttagtttagttgggcgtagttggcgttgggtgggacaagactcgacgttcgggggaaccgtaaccggggg

SEQ ID NO: 319928 - DNA, 701 bp, Homo sapiens
  misc_feature: GZ8MTXP01DD1BK.19.67.G01.1.454.CMB.2.raw
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccaggcctggggcggtctctgagactgtcctgtgaaccctgtggggtctccgcagcagcgactgtattgcctggtccgccaggctacgagggagaggccggaggtcgggtcgcgtaggttatttttaaggtacgggtggggaacgtacgtagtttaccgtaaaccgggacgtaaccgtcccgaaggttcggggaacggggtccccggtaatttcccgaaccctacttacccgttccccaaggtacgttaaccttttttacctacgtaaacggtaaaccaaccgtaaccttcgttccttactttaccaaaggtttacgaaaccgtaaggccccgttaagggaccggggcccggaacggggaaccgaccggggtacccggttacttaagttttaagtttggttgttagggtaggttagtttaagtgggttacgttagttggaacgtgggtaagcgagttactcgaacggtccggggg

SEQ ID NO: 319929 - DNA, 640 bp, Homo sapiens
  misc_feature: GZ8MTXP01E218A.19.67.G01.1.454.CMB.2.raw
  modified_base (276)..(276): a, c, t, g, unknown or other
  misc_feature (276)..(276): n is a, c, g, or t
  modified_base (279)..(279): a, c, t, g, unknown or other
  misc_feature (279)..(279): n is a, c, g, or t
  modified_base (560)..(560): a, c, t, g, unknown or other
  misc_feature (560)..(560): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctggggcggtctctgagactgtcctgtgaccctctggttctccggtcancancactgtattgccgtcggttccgcccaggccgtcccgaagggggaaggagggcggggacccccggtgggggtccgccgagggttattttttaagtagggtggaccgacattctacggagaactcccgaagtgggacgggtccggattcaccgatcctccagacgtactttacttacacgaacaccactcgtctcttacactacgacgacgccgtacgggacggaccggaccggaccggaccgtccgttacctattagttgttgttaaggtagttagtttagnggtacgtcgttcggttcgttacggtaacggacgtaacgtacgtaccggaccggtaaccgggttaacccggtaaccccggg

SEQ ID NO: 319930 - DNA, 577 bp, Homo sapiens
  misc_feature: GZ8MTXP01DPLE8.19.67.G01.1.454.CMB.2.raw
  modified_base (525)..(525): a, c, t, g, unknown or other
  misc_feature (525)..(525): n is a, c, g, or t
  modified_base (533)..(533): a, c, t, g, unknown or other
  misc_feature (533)..(533): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagactgggcggaggcttggtccagcctgggcggtctctgagactgtcctgtcgaccctcgtggggtctccgcagcagcgactgtatgcctgggtccgccaggctccgagggagaggcccgggaggtgggtcgcgtaggttatttttagagggtgggacgactagttcgtaacgggagctccgagtgggagggccgattcgaaccatctccagagtactttcactagaacacactgtctacttacaaagtcgaacagccgtaggacgggccgaggtaccacggtcctacgttattagttgtggttgtagttagtttagngggttcgngttcgggcgttagggtcggagagactccgaacggtaaccggggg

SEQ ID NO: 319931 - DNA, 665 bp, Homo sapiens
  misc_feature: GZ8MTXP01BIQWA.19.67.G01.1.454.CMB.2.raw
  modified_base (403)..(403): a, c, t, g, unknown or other
  misc_feature (403)..(403): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgcaacgtggtggagacgtgggcggaggtcttggtccaggccgtggggcggtctcgtgagactgtcctgtcgaccctcgtggggtctccgtcagcagcgactgtattcggccgtcgggtccgccgaggctccgaggggaaggacgggccggaggtgggtcgcgtaggttattttagtagggtggaccgactattcgtaggacgaactccgngtgggacgggtccgattccactactctaccagtacgtacttttcacaagaactactacttcgtccttacttactaaatacgaacgacggtccgtacggaacggggaccgagggaaccgtacgggtcccgttactacgttttagtgggtttaggtaaggtaaggttaggtttaagttggggtacggtagttcggggttcgttaggggtaaggtacgtaaggtacgtccggttacgggtcgggggaacccggtaaacccggggg

SEQ ID NO: 319932 - DNA, 646 bp, Homo sapiens
  misc_feature: GZ8MTXP01AZWR4.19.67.G01.1.454.CMB.2.raw
  modified_base (584)..(584): a, c, t, g, unknown or other
  misc_feature (584)..(584): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagccgtggggcgtctctgagactgtcctgtcgaaccctcgtggggtctccgtcagcagcgactgtattcgccgtgggtcccgccgaggcctccgaaggggaaggagggcccgggaggtggggtcgcgtaggttatttttagagggtgggaaccgactagttcgtacggagaactccaagtgggacgggccgattccgaccatcctaccgagacgtacttttcgacagaaaccacaacttcgtaccttacttaccaaattacgaacgacggtacccgtagggaccgggggaccgaacggggaccaccggggtcccgttacgttaagttaacgtttggtggtaaggtagttaggtttaagngggtacgtagttcggttcgttgggtaaggacgaagtagtcgacgtcggggccgaaccggggg

SEQ ID NO: 319933 - DNA, 673 bp, Homo sapiens
  misc_feature: GZ8MTXP01DMB8I.19.67.G01.1.454.CMB.2.raw
  modified_base (586)..(586): a, c, t, g, unknown or other
  misc_feature (586)..(586): n is a, c, g, or t
tcagtactctcgtgcacgaccggtgctcgatttagagtatacatattgggtttggggggggagaggagcccagcactgggattccgaggtgtttccattcggtgctcagcactgaacacagaggactcaccatggagttttggctgacctgggttttccttgctgcaatttcaggaggtgtccagtgtgaggtgcaactgggtggagacgtgggcggaggcttggtccagcctggggcggtctctgagactgtcctgtcgaaccctcgtggggtctccgtcagcagcgactgtattgccgtgggtcccgccaggctccgagggggaagagggccgggaggtgggtcgcgtaggtttattttagagggtgggaccgactagttcgtaacgggagaacctccgaaggtgggacggggccctagttccaactatcctaccaagtacgtaccttttcacaacgaaacctactacttcgtcttacttaacaaattcgaaacgacgtcccgtagggacgggcccggaacgggaccgaccgggtacccgttattaagtttagttggttggtaaggtaaggttaggttttacgnggggtacgtaagttggggttcgttggggtaacggaacgtaaggtacgtccggttaccgggttcggggggaaccccgtaaaccggggg

SEQ ID NO: 319934 - DNA, 660 bp, Homo sapiens
  misc_feature: GZ8MTXP01ANTSN.19.67.G01.1.454.CMB.2.raw
  modified_base (325)..(325): a, c, t, g, unknown or other
  misc_feature (325)..(325): n is a, c, g, or t
  modified_base (348)..(348): a, c, t, g, unknown or other
  misc_feature (348)..(348): n is a, c, g, or t
  modified_base (423)..(423): a, c, t, g, unknown or other
  misc_feature (423)..(423): n is a, c, g, or t
  modified_base (599)..(599): a, c, t, g, unknown or other
  misc_feature (599)..(599): n is a, c, g, or t
  modified_base (614)..(614): a, c, t, g, unknown or other
  misc_feature (614)..(614): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgcaacgtgggtggagacgtgggcggagggcttgggtccaggccgtggggcggtccgtcgtggacgaacgtcggtcctagtacgaccctgtggggtctaccgcagcagcgactggtattcgccgtgggtcccncctaggccaccgagggggaacgngggtccgggaggtcggggtcgcgtaagggtttatttttaggaggggttagggaccccatagtttccgaacggganaaccttaccgaagtcggggaaaggggtccccagtttccaaccctattccctaccaaggtactacttttcacagaaccactactcgtacttccttaaactaaagtacgaacgcgccggtagggacgggaccgaggacgacggtactattagttagtggtgtaagtaggttaggttgnggtacgtagttcggnggttggtaaggagaacgacgtcgttacggtcgggaaccggtaacgg

SEQ ID NO: 319935 - DNA, 677 bp, Homo sapiens
  misc_feature: GZ8MTXP01BLSON.19.67.G01.1.454.CMB.2.raw
  modified_base (304)..(304): a, c, t, g, unknown or other
  misc_feature (304)..(304): n is a, c, g, or t
  modified_base (413)..(413): a, c, t, g, unknown or other
  misc_feature (413)..(413): n is a, c, g, or t
  modified_base (610)..(610): a, c, t, g, unknown or other
  misc_feature (610)..(610): n is a, c, g, or t
  modified_base (649)..(649): a, c, t, g, unknown or other
  misc_feature (649)..(649): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgcaacgtggtggagacgtgggcggaggcttggtccagccgtgggcgtctcgtgagctgtctgtcgacctcgtggggtctccgtcagcagcgactgtatcgccgtgggtccncgaggcctccgaggggaagcgggccgggaggtcggggtcgcgtaggtttaattttaggaggggtcgggaacccgtacgtagttacgtaaccgggacgtaacccgtacgngggtacgggaccgggaccgtactacccgactacgtcctacgacgtacgttactttcgaacgaacgtaacactacgttctacttactaactaacgtaacgaacggacgtacggtacgggaaccggacgggacgtaccggaccggttacccgttacgtttagttaaggtttgtaggtaaggtaaaggtttaggtttagnggtagtaggttcggttggttagggtaagacgaagtacgngttaccgggaacggttcggtaacccggg

SEQ ID NO: 319936 - DNA, 672 bp, Homo sapiens
  misc_feature: GZ8MTXP01C4C32.19.67.G01.1.454.CMB.2.raw
  modified_base (365)..(365): a, c, t, g, unknown or other
  misc_feature (365)..(365): n is a, c, g, or t
  modified_base (591)..(591): a, c, t, g, unknown or other
  misc_feature (591)..(591): n is a, c, g, or t
tcagtactctcgtgcacgaccggtgctcgatttagagtatacatattgggtttggggggggagaggagcccagcactgggattccgaggtgtttccattcggtgctcagcactgaacacagaggactcaccatggagttttggctgaccttgggttttccttgctgcaatttcaggaggtgtccagtgtgaggtgcaactgggtggagacgtgggcggaggcttggtccagccgtgggcggtctctgagactgtcctgtcgaaccctcgtggggtctccgtcagcagcgtactgtattcgccgtgggtcccgccgaggcctccgaggggaagaggccggaggtgggtcgcgtaggttattttagngggtaggacccgactattcgtacggacgaacctccaaggtggggacgggtacccgtaattccgaacctatccctaccgtaagtacgttaccttttcactaaagaaacctacgtacttcgtaccttctaacaaattacgaacgaacggccgtagggacggggacccgaacgggaccaccgggtcccgttattagttagttggtaggtaaggtaaggttaggtttagnggggtacgtaggttcgggttcgttaggggtaaggacgtaaggtaacgtccggaacgggtcgggggaacccgtaacccgggg

SEQ ID NO: 319937 - DNA, 618 bp, Homo sapiens
  misc_feature: GZ8MTXP01EYNBV.19.67.G01.1.454.CMB.2.raw
  modified_base (552)..(552): a, c, t, g, unknown or other
  misc_feature (552)..(552): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctggggcgtctctgagactgtcctgtgaaccctgtggggtctccgtcagcagcgactgtattgccgtgggtcccgccagggctccgagggggaagagggccgggaggtcgggggtcgcgtagggttatttttaagaggggttggggaacccgactagttcgtaacgggacgaaacctccgaagttcggggaaggggtcccgatttccaacccgattccctacccaagtacgtacttttcacagaaaccactactgtctcttacaaatgaacagcctggacgggccgaggacacggccgtctattagttgtgtgagttagtttagnggtacgagttgggcttaggggtggacaaggtaatccggaacggttcgggggaaccgtaaccggggg

SEQ ID NO: 319938 - DNA, 608 bp, Homo sapiens
  misc_feature: GZ8MTXP01AT1XA.19.67.G01.1.454.CMB.2.raw
  modified_base (389)..(389): a, c, t, g, unknown or other
  misc_feature (389)..(389): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcgccatggagttttggctgacctgggttttccttgctgcaatttcaggaggtgtccagtgtgaggtgcaactggtggagactgggcggaggcttggtccagccgtggggcggtctcgtgagactgtcctgtcgaaccctcgtggggtctccgtcagcagcgactgtattgccgtgggtccgccaggcctccgagggaagaggccggaggtgggtcgcgaggttattttagtagggtggaccgtacattcgacggagaactccngtgggagggccattcaccatctccagtacgtacttttcgacagaaacacactgtactcttacaaatagaacacgccgtagacggggccgaaggtaccgaccggtccgtacttagtttaagttggtagtggtaagttaggtttagttgggtcgagttgggttcgttgggtaaggtacgaaggtaacgtcggttaacggtcggggttaaccgaaccggggg

SEQ ID NO: 319939 - DNA, 554 bp, Homo sapiens
  misc_feature: GZ8MTXP01AWAAJ.19.67.G01.1.454.CMB.2.raw
  modified_base (487)..(487): a, c, t, g, unknown or other
  misc_feature (487)..(487): n is a, c, g, or t
  modified_base (518)..(518): a, c, t, g, unknown or other
  misc_feature (518)..(518): n is a, c, g, or t
  modified_base (524)..(524): a, c, t, g, unknown or other
  misc_feature (524)..(524): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgaccttgggttttccttgctgcaatttcaggaggtgtccagtgtgaggtgcaacgtggtggagacgtgggcggaggcttgggtccaggccgtgggcggtctctgagactgtcctgtgaaccctcgtggggtctccgcagcagcgactgtatgcctgggtccgccaggctccgagggagaggccggagtgggcgctaggttatttttagagggttgggacgacgattcgtaaacgagaagacctccgaagtgggagggccgaattccacccatcctaccagtagtacttttcactagaacacactgtctactacaaatgaacagcctggaggccgaggacncggcgtctataagtgttgtgagtgtttacgnggttgngtgggctgggtggcaaggtgttcggaacgg

SEQ ID NO: 319940 - DNA, 642 bp, Homo sapiens
  misc_feature: GZ8MTXP01DF7M2.19.67.G01.1.454.CMB.2.raw
  modified_base (209)..(209): a, c, t, g, unknown or other
  misc_feature (209)..(209): n is a, c, g, or t
  modified_base (281)..(281): a, c, t, g, unknown or other
  misc_feature (281)..(281): n is a, c, g, or t
  modified_base (306)..(306): a, c, t, g, unknown or other
  misc_feature (306)..(306): n is a, c, g, or t
  modified_base (472)..(472): a, c, t, g, unknown or other
  misc_feature (472)..(472): n is a, c, g, or t
  modified_base (632)..(632): a, c, t, g, unknown or other
  misc_feature (632)..(632): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctggcggggacatcgtgatcgacccagtacccagactcactggctgtgtctcgtgggcgagacggccanaatcaactgcaggtccagccagtaactatttcaccacctacaaagaactaaaacttctagccagtaaccaanagacgacaggacagcctactagtcnctctattacgtggtcttcgtacgcgtacgtaacgttccgggggtccctcggacccccggtacggttccgggggctacgggccggggttacgtaggggaactaggtactttaccactcctacaacccgatacaggccacggcccgtgacgaacgggtctaggaaagngtggtcggtacttaggtttacttacgtgtacagtacttaatttctttttcgtacttccgtaccggtggtaacccggttccggaaccgtaaacggggttaccgtaaggggttagtaaactcggaaacgttacggttaacgtggtacgtctagccttacgtnttcgttaacg

SEQ ID NO: 319941 - DNA, 611 bp, Homo sapiens
  misc_feature: GZ8MTXP01A16FU.19.67.G01.1.454.CMB.2.raw
  modified_base (541)..(541): a, c, t, g, unknown or other
  misc_feature (541)..(541): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtgggcggaggcttgggtccaggcctggggcggtctctgagactgtcctgtcgaacccctcgtgggggtctccgtcagcagcgactgtatgcctgggtccgcaggctcgagggagaggccgggagtgggtcgcgtaggttattttagtagggtgggaccgactagttcgtacggagaactccgaagtgggagggccgatttccgacctatcctccagtacgtactttctcaagtaaccactactgtctacttacaaatgaacgagccgtaggacgggccgaaggaccgacggtaccgttctagtttagttggtggtaagtaggttgtttaagngggtacgtagttcgggcttggggtaaggacgtaaggtagtccgacggtcgggggaaccgtaacccggggg

SEQ ID NO: 319942 - DNA, 630 bp, Homo sapiens
  misc_feature: GZ8MTXP01EN4BG.19.67.G01.1.454.CMB.2.raw
  modified_base (387)..(387): a, c, t, g, unknown or other
  misc_feature (387)..(387): n is a, c, g, or t
tcagtactctcgtgcacgaccggtgctcgatttagagtatacatattgggtttggggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagactgggcggaggcttggtccagccgtggggcggtctctgagctgtcctgtcgaaccctctggggtctccgtcagcagcgactgtatgcctgggtccgccaggctccgagggaagaggccggaggtgggtcgcgaggttatttttagagggtggggaccgacattcgtacggagaactccngtgggagggccgattcgaccatccctacagtagtaacttttcgtacaagaaaccactaactgtcctacttacaaaattgaaacgaacggcccgttaggacggggacccggagggaccgaccgggaccgttcctaagtttagttggttgtaaggtaaggttaggtttaagttgggacgtagttgggttcgttggggttaacggagtaagacgtacgttacggttcgggggccgtaacccggggg

SEQ ID NO: 319943 - DNA, 610 bp, Homo sapiens
  misc_feature: GZ8MTXP01B3T2E.19.67.G01.1.454.CMB.2.raw
  modified_base (551)..(551): a, c, t, g, unknown or other
  misc_feature (551)..(551): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtggcggaggcttggtccagccgtggggcggtctctgagactgtcctgtcgaaccctcgtggggtctccgtcagcagcgactgtattgccgtgggtcccgccgaggctccgagggaagacggccggaggtgggtcgcgtaggttattttagtagggtggaccgactagttcgacggagaactccaagtgggacgggccgattccactactctaccgagtacgtactttctacaagaacactactcgtcttacttacaaattacgaacgtacgccgtagggacgggaccgaggaccgacgggtacccgttctaagtttagttggtggtaagtaggttagtttagnggtacgtagttgggttcgttgggtgacgaagacgtcgacggtcggggccgtaaccgggg

SEQ ID NO: 319944 - DNA, 629 bp, Homo sapiens
  misc_feature: GZ8MTXP01EB5S6.19.67.G01.1.454.CMB.2.raw
  modified_base (267)..(267): a, c, t, g, unknown or other
  misc_feature (267)..(267): n is a, c, g, or t
  modified_base (435)..(435): a, c, t, g, unknown or other
  misc_feature (435)..(435): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtgggcggaggcttgggtccagccgtggggcgtctctgagactgtcctgtcgaaccctntggggtctccgtcagcagcgactgtatgcctgggtccgcaggctccgaggaagaggccggagtgggtcgcaggttattttagagggtgggaccactagttcgtacggacgaactccgaagtgggagggtccgattccgactatctccagtagtactttctcagaaacnctaactgtctcttaacaaagtcgaaacgtacgacccgtaggacggggacccgaagggacccgacggtaccccggttacttaagtttagttggttggtaagtaaggttagttttaagttgggaccgtaagttggggccttaggggttcggactaaggtaactcggaacggttcgggggaacccgtaaaccggggg

SEQ ID NO: 319945 - DNA, 592 bp, Homo sapiens
  misc_feature: GZ8MTXP01C4778.19.67.G01.1.454.CMB.2.raw
  modified_base (377)..(377): a, c, t, g, unknown or other
  misc_feature (377)..(377): n is a, c, g, or t
  modified_base (543)..(543): a, c, t, g, unknown or other
  misc_feature (543)..(543): n is a, c, g, or t
  modified_base (550)..(550): a, c, t, g, unknown or other
  misc_feature (550)..(550): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggagtgtccagtgtgaggtgcaactggtggagacgtgggcggaggcttggtccagccgtgggcgtctctgagactgtcctgtcgaaccctctggggtctccgtcagcagcgactgtattgcctgggtccgccaggctccgagggaagaggccggagtgggtcgcgaggttattttagtaggtgggaccgacagttctaacggganaacctccaagttgggacgggccgtattccaccgtatcctacccagtacgtaacttttctcaacgaaacactaaccttgtccttacttacaaaattgaaacgaagcccgtaggacgggccgaaggaccgacggtccgtctagttattgtgtgagttagtttgcgtgngttcggnttgggtgggacaaggatcgaacgtcgggggccgtaaccgggg

SEQ ID NO: 319946 - DNA, 798 bp, Homo sapiens
  misc_feature: GZ8MTXP01BGRTI.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtgggcggaggcttggtccagccgtggggcgtctctgagactgtcctgtcgaaccctgtggggtctccgtcagcagcgactgtattcgccgtgggtcccgccaggctccgaggggaagagggccggaggtgggtcgcgtaggtttactttttaagaggggttcggggaaccctacgtagtttacgtaacggggacgtaaacccttcccgaagttcgggggaacggggtcccgtaatttcccaaccctagtccctacccgaagggtacgttactttttaccacgaaagtaaacccactacttcggtaccttaccgtttaaccaaaagttcggaaaccgtacggtacccggtaaggggaaccgggggaccccggaaaggggaaccccgtaaccgggggtaccccgtttaacgtttaaagttttaaacggttgggtttacgggtaagggtaaagggtttaacgggtttttaaacgggcgggggtaccggttaacgggttcgggggttcgggttagggggtaaccgggtaacgtaacgggtaaccgtaccgggttaaccggggtaaccggggggttaaccccggtaaaccggggg

SEQ ID NO: 319947 - DNA, 576 bp, Homo sapiens
  misc_feature: GZ8MTXP01CK6O4.19.67.G01.1.454.CMB.2.raw
  modified_base (382)..(382): a, c, t, g, unknown or other
  misc_feature (382)..(382): n is a, c, g, or t
  modified_base (492)..(492): a, c, t, g, unknown or other
  misc_feature (492)..(492): n is a, c, g, or t
  modified_base (555)..(555): a, c, t, g, unknown or other
  misc_feature (555)..(555): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctcgtgggcgagacggccaacaatcaactgcaggtccagccagaactatttcaccactaccaaagaactaaaacttctagcctaggtaaccaacagaacgaccaggaccagccctacctaagttgactctatttacgtgggtctttctacgcgtacgaacgttccgggggccctgacccccgtaggttccggggntacgggcgggtcctgggaaccagtactttccgactcactacatcagcagtcctgcacggtctagaagtatgtaggacttagttttatacgtggttacagtacttaaattnttttactactcctcgggtgtacgttcggcaaagggcctagggagaaatcgaagacgacgttgnggctgccactcgttcttaacg

SEQ ID NO: 319948 - DNA, 541 bp, Homo sapiens
  misc_feature: GZ8MTXP01BIT9V.19.67.G01.1.454.CMB.2.raw
  modified_base (251)..(251): a, c, t, g, unknown or other
  misc_feature (251)..(251): n is a, c, g, or t
  modified_base (363)..(363): a, c, t, g, unknown or other
  misc_feature (363)..(363): n is a, c, g, or t
  modified_base (370)..(370): a, c, t, g, unknown or other
  misc_feature (370)..(370): n is a, c, g, or t
  modified_base (375)..(375): a, c, t, g, unknown or other
  misc_feature (375)..(375): n is a, c, g, or t
tcagtactctcgtgcacgaccggtgctcgatttagagtatacatattgggtttgggggtagctcaggaagcagagcctggagcatctccactatggcctgggctccactacttctcaccctcctcgctcactgcacaggttcttgggccaactttatgctgactcacgccccactctgtgtcggagtcgtccggggaagacggtaaccatctttgcaccacaacagtggcaacattgccagctaattttgngcagtggtacagcagcgccggcacgtccccacatgtgatctatgagataatacaaagcgtcgtgggtcctgactcgtctcgtcgctcatcgacacgcctccacctactcgcnccctccncaccntctcgtgactgaagacgtcggaggacgagctagactactcgtgtctagttacttatgagtacgccgtcgtctagtggtcggtcgttcgggcgggtacggacgtaacggtcgttacgttcccgttcgtaacggtccgaacgcccgtagggcctcccgttccccgtcg

SEQ ID NO: 319949 - DNA, 597 bp, Homo sapiens
  misc_feature: GZ8MTXP01EG0DH.19.67.G01.1.454.CMB.2.raw
  modified_base (295)..(295): a, c, t, g, unknown or other
  misc_feature (295)..(295): n is a, c, g, or t
  modified_base (382)..(382): a, c, t, g, unknown or other
  misc_feature (382)..(382): n is a, c, g, or t
  modified_base (491)..(491): a, c, t, g, unknown or other
  misc_feature (491)..(491): n is a, c, g, or t
tcagtactctcgtgcacgaccggtgctcgatttagagtatacatattgggtttggggggtagctcaggaagcagagcctggagcatctccactatggcctgggctccactacttctcaccctcctcgctcactgcacaggttcttgggccaactttatgctgactcagccccatctgtgtcggagtcgtccggggaagacggtaaccattctttgccacccacaacagtggcaacattgccagtctaattttgtgcagtggtaccagcagccgcccggcacgtcccccacattgnatcatgagataatacaaagtccgtcgtgggggtccctgtactcggttctcgtcggccttacagtcgacacgtcctcctccaacttcnccgtccctccctacaccattcctcgtaggactgaacgacgtaggaaggtcgaggctaggtactaacctacgttcgtctagttcttagtgtacgttacggccgtcgtacngttcggtggtcgttcgggacggtaacggggacctaaggtcttacggttccccgttccgtaagggtaccgaaccggcccgagggcccttccccggccccgtttccgg

SEQ ID NO: 319950 - DNA, 633 bp, Homo sapiens
  misc_feature: GZ8MTXP01ATPBN.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtgggcggaggcttggtccagccgtggggcggtctctgagactgtcctgtcgaaccctcgtggggtctccgtcagcagcgactgtattgccgtgggtccgccgaggctccgaggggaaggagggccgggaggtgggtcgcgtaggttattttagaggtgggaccgactagttcgacggagaactccgaagtgggacgggccgattccacatctaccagtacgtactttctacagaacactactcgtcttacttaccaaattcgaaacgtacggccgttagggaacggggaccggaacgggaccgaaccgggtcccgttacgttaagtttaagttggttaggttggtaaggttaggttttaagttgggtacgtagttgggttcgttgggtggacgaaggtatcgacggtcggggccgtaaccgggg

SEQ ID NO: 319951 - DNA, 561 bp, Homo sapiens
  misc_feature: GZ8MTXP01ACXIU.19.67.G01.1.454.CMB.2.raw
  modified_base (512)..(512): a, c, t, g, unknown or other
  misc_feature (512)..(512): n is a, c, g, or t
  modified_base (515)..(515): a, c, t, g, unknown or other
  misc_feature (515)..(515): n is a, c, g, or t
  modified_base (523)..(523): a, c, t, g, unknown or other
  misc_feature (523)..(523): n is a, c, g, or t
  modified_base (535)..(535): a, c, t, g, unknown or other
  misc_feature (535)..(535): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctggggcggtctctgagactgtcctgtcgaaccctctggggtctccgtcagcagcgactgtattgcctgggtccgccaggctccgaggggaagaggccggagtgggtcgcgaggttatttttagagggtgggaccgacattcgtacggagaactccaatgggagggccgattcacatctccagagtactttctacagaacacactgtctcttacaaatcgaacagtcccgtgacggggccgtaggacacggaccggtctattaagttgtgtgagttaggtttgnggngattgggngttgggtggacnggatcgacgtcggggccgaaccgggg

SEQ ID NO: 319952 - DNA, 609 bp, Homo sapiens
  misc_feature: GZ8MTXP01DBR3X.19.67.G01.1.454.CMB.2.raw
  modified_base (421)..(421): a, c, t, g, unknown or other
  misc_feature (421)..(421): n is a, c, g, or t
  modified_base (469)..(469): a, c, t, g, unknown or other
  misc_feature (469)..(469): n is a, c, g, or t
  modified_base (560)..(560): a, c, t, g, unknown or other
  misc_feature (560)..(560): n is a, c, g, or t
  modified_base (580)..(580): a, c, t, g, unknown or other
  misc_feature (580)..(580): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgcaactgggtggagacgtgggcggaggcttggtccagccgtggggcgtctctgagactgtcctgtcgaaccctcgtggggtcctcgtcagcagcgactgtattgccgtgggtcccgccgaggcctccggagggggaagacgggccgggagtggggtcgcgtaggtttattttagaggtggacccatattcgtaacgaagaactcaagtgggagggcctatccacatcnccagagtactttcacaagaacacacttgtctacttacaaatgaaacgngtaccgaggacggggacccgaggacccgacggtaccgtacttaagtttagtggtgtaagtaaggttagtttagttgggcgtagttccgggngttggggtaagacgtaaganccgttacggtcggggaaccgtaaccgggg

SEQ ID NO: 319953 - DNA, 661 bp, Homo sapiens
  misc_feature: GZ8MTXP01CZF8C.19.67.G01.1.454.CMB.2.raw
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgaccttgggttttccttgctgcaatttcaggaggtgtccagtgtgaggtgcaacgtggtggagactgggcggaggcttggtccaggcctggggcgtctctgagctgtcctgtgaccctgtgggtctccgcagcagcgactgtattgccgtgggtcccgccaggcctaccgaggggaaggacggccgggaggtcgggtcgcgtaggttatttttagagggtgggacgtatattcgtaacgggagaacctccagtgggacgggccgattaccgaccctattcctaccgagtaacgttaccttttacacgtaacgtaaccactacttgttccttactttacaaaattacggaaacctacggacccgttaggaacgggggacccgaaggaacccgtaaccggggtccccgttataacgttttaagttggttggttaggtagttaaggtttttacgtgggttacgttgttcgggtcgttgggtcggaacgtagttacgttcggttaacgggtaacgggg

SEQ ID NO: 319954 - DNA, 699 bp, Homo sapiens
  misc_feature: GZ8MTXP01B73TW.19.67.G01.1.454.CMB.2.raw
  modified_base (580)..(580): a, c, t, g, unknown or other
  misc_feature (580)..(580): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtgggcggaggcttggtccagccgtgggcggtctctgagactgtcctgtcgtaccctcgtggggtctccgtcagcagcgactgtattcgccgtcgggtccgccgaggccgtaccgagggggaaacggacgggccgggtaggtcggggtcgacgtaggtttatttttagagggtcgggaaccgtactagttcgtacggagtaaccgttccgaagtcgggacgggcccgtaattccgaacctacgtcctaccgagtacgttacctttttacacaacgtaaaccaccgtacttcgttaccttacttaacaaacttcggaaacacggtaccgtacgggaacggggaccgaacgggacccgtaacgggtccccgttnttaagtttagttcggttggtaaggtaaggttaggtttaagcgggtacgtaaggttcgggccgttggggtaacgacgtaagggtactcggttacgggtcggggaacccgtaacccggggg

SEQ ID NO: 319955 - DNA, 588 bp, Homo sapiens
  misc_feature: GZ8MTXP01ES8IH.19.67.G01.1.454.CMB.2.raw
  modified_base (448)..(448): a, c, t, g, unknown or other
  misc_feature (448)..(448): n is a, c, g, or t
  modified_base (563)..(563): a, c, t, g, unknown or other
  misc_feature (563)..(563): n is a, c, g, or t
  modified_base (569)..(569): a, c, t, g, unknown or other
  misc_feature (569)..(569): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtgggcggaggcttggtccagccgtgggcggtctctgagactgtcctgtgaaccctgtggggtctcgcagcagcgactgtatgcctgggtccgccaggctccgagggaagaggcccgggaggtgggtcgcgtaggttattttagaggggtgggacgacgtattcgtaaacggagaactccgagtgggacggccgtattcgaccctagtctaccagtacgtacttttcactacgaaacncgtaactcgtacttacttacaaagttgaactacgcccgtaggacgggccgagggaccacggggtcctacttattattggtagttggagttagttagtgggcgattcgggcgtggngggacnggactcgaacggtcggggg

SEQ ID NO: 319956 - DNA, 572 bp, Homo sapiens
  misc_feature: GZ8MTXP01BBG9S.19.67.G01.1.454.CMB.2.raw
  modified_base (376)..(376): a, c, t, g, unknown or other
  misc_feature (376)..(376): n is a, c, g, or t
  modified_base (437)..(437): a, c, t, g, unknown or other
  misc_feature (437)..(437): n is a, c, g, or t
  modified_base (518)..(518): a, c, t, g, unknown or other
  misc_feature (518)..(518): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttcctgctgcaatttcaggaggtgtccagtgtgaggtgcaacgtggtggagacgtgggcggaggcttggtccagcctgggcggtctcgtgagactgtcctgtgaccctgtgggtctccgcagcagcgactgtattgcctgggtccgcaggctccgagggagaggccggaggtcgggcgcgtaggttatttttagagggtgggacagattcgaacggganctcaagtgggaggccgatcacatctacagagtactttcacagaacactactgtctacttanaaatgaaacagccgtaggacgggccgaggaacccacgggtcccgttagtattagttggtagttggaagttagttttaaggngggttacgttgttgggtaacgtgggtaacggacagttactcggaacgggtcggg

SEQ ID NO: 319957 - DNA, 640 bp, Homo sapiens
  misc_feature: GZ8MTXP01BBEC0.19.67.G01.1.454.CMB.2.raw
  modified_base (572)..(572): a, c, t, g, unknown or other
  misc_feature (572)..(572): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtgggcggaggcttggtccagccgtggggcggtctctgagactgtcctgtcgaaccctgtcggggtctccgtcagcagcgactgtattgccgtgggtcccgcaggctccgaggggagagggccggaggtgggtcgcgtaggttattttagaggggtggaccgtacatttcgtacggagaaccttccaagtgggacgggcccgattccgacctatcctaccagtacgttacttttcacaagaaaccactactgttaccttcttaacaaatacgaacgtacgtcccgtagggacggggacccgaagggacccgaccggggtccgttacttaagtttagttggtgtaaggtaaggttaggttttaagngggtacgtagttcgggttcgttgggtaaggacgtaagacgtcgacgggtcggggaaccgtaaccgggg

SEQ ID NO: 319958 - DNA, 584 bp, Homo sapiens
  misc_feature: GZ8MTXP01D62RB.19.67.G01.1.454.CMB.2.raw
  modified_base (246)..(246): a, c, t, g, unknown or other
  misc_feature (246)..(246): n is a, c, g, or t
  modified_base (278)..(278): a, c, t, g, unknown or other
  misc_feature (278)..(278): n is a, c, g, or t
  modified_base (292)..(292): a, c, t, g, unknown or other
  misc_feature (292)..(292): n is a, c, g, or t
  modified_base (321)..(321): a, c, t, g, unknown or other
  misc_feature (321)..(321): n is a, c, g, or t
  modified_base (544)..(544): a, c, t, g, unknown or other
  misc_feature (544)..(544): n is a, c, g, or t
  modified_base (580)..(580): a, c, t, g, unknown or other
  misc_feature (580)..(580): n is a, c, g, or t
  modified_base (582)..(582): a, c, t, g, unknown or other
  misc_feature (582)..(582): n is a, c, g, or t
  modified_base (584)..(584): a, c, t, g, unknown or other
  misc_feature (584)..(584): n is a, c, g, or t
tcagtactctcgtgcacgaccggtgctcgatttagagtatacatattgggcttggtccagcctgggcggtctctgagactgtcctgtgaaccctctggggtctccgtcagcagcgactgtattgcctgggtccgccaggctccagggaagaggccggagtgggtcgcaggtattttttataggtgggacgacatttctacggagactccatggagggccgattcaccatctccagagtacttttcncagaacacactgtctcttcaaatgaacagccngagggccgaggacncggccgtctattatgtgtgagtagtttanggcgatgggctgggtgacagatcacgtggggccagggaccctggtaccaccgtctcctcgacgccctccaccgaacgggcccagtccgtccttccccgtggccgccctcgcctccgaggacgccacctccgagacggccacgacggcccgggcccgtggggcctcggcccgttgggtccgaaacgggtcctaccgttaaccccgaaggttacgacggttacgnggacgggcgggcgttacgggaacgaggcgacagagngngn

SEQ ID NO: 319959 - DNA, 616 bp, Homo sapiens
  misc_feature: GZ8MTXP01CR6JF.19.67.G01.1.454.CMB.2.raw
  modified_base (325)..(325): a, c, t, g, unknown or other
  misc_feature (325)..(325): n is a, c, g, or t
  modified_base (493)..(493): a, c, t, g, unknown or other
  misc_feature (493)..(493): n is a, c, g, or t
  modified_base (552)..(552): a, c, t, g, unknown or other
  misc_feature (552)..(552): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagccgtggggcggtctctgagactgtcctgtcgaacccctcgtggggtctccgtcagcagcgactgtattgcctgggtcccgccaggctccgaggggaagngggccggaggtggggtcgcgtaggtttatttttagtaggggttcgggaccgtactagtttcgtaacggagtaaacctccgaagtgggaacgggcccgaattccacctatcctccgagtacgtacttttcactaagaaacctactactgtactcttacaaatcgaaacngcccgtggacgggcccgagggaccacggccgtctagttattggtgttgagttgtttagnggtcgtagttcgggcttggggtaagacgtggtaacgtcgaacggttcgggggcccgtaacgggg

SEQ ID NO: 319960 - DNA, 823 bp, Homo sapiens
  misc_feature: GZ8MTXP01DIQFN.19.67.G01.1.454.CMB.2.raw
  modified_base (743)..(743): a, c, t, g, unknown or other
  misc_feature (743)..(743): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgacaacgtggtggagacgtgggcggaggtcgttcggtccacgccggtggggtccggtctcgtagacgtacgttcgtcctggtaccgtaaccccgtcggttcggggtcctccgtcacgcacgcgtacgtgttacgttcgcccggtcgggtccccgaccgacggtccgtaccggaagggggaacggacgggccgggtaggtcgggtcgacggttaggtttatttttaaggaggggtacggaacccgtactacgttacgtaacggacgtaacccgtaccgtaagggtcggggaaccggggtacccgtaacttacccgaaccgttacgttaccctaccgtaagttaaccgtttaccttttaccgtaaccgtaaacgaaacctaaccttaacgttccgttaccttaaccttaaactaaaacgtacggtaaaccggtaccgggtacccggttaacggggaacccgggggaccggaacccgggtaaccggtacccgggttaccccggttactttaagttttagtaggttggtaaggtaaggtttagggttttacggngggtacgtaggttcgggttcggttaggggtaacgaacgtaagtacgtacggttacgggtcggggaacccgtaacccgggg

SEQ ID NO: 319961 - DNA, 596 bp, Homo sapiens
  misc_feature: GZ8MTXP01BEQNV.19.67.G01.1.454.CMB.2.raw
  modified_base (252)..(252): a, c, t, g, unknown or other
  misc_feature (252)..(252): n is a, c, g, or t
  modified_base (395)..(395): a, c, t, g, unknown or other
  misc_feature (395)..(395): n is a, c, g, or t
  modified_base (491)..(491): a, c, t, g, unknown or other
  misc_feature (491)..(491): n is a, c, g, or t
tcagtactctcgtgcacgaccggtgctcgatttagagtatacatattgggtttggggggtagctcaggaagcagagcctggagcatctccactatggcctgggctccactacttctcaccctcctcgctcactgcacaggttcttgggccaactttatgctgactcagccccatctgtgtcggagtcgtccgggaagacggtaaccattctttgccacccacaacagtggcaacattgccagctaattttgngcagtggtaccagcagccgcccgggcacgttcccccactatgtgatctatgaggataaactacaaagtccggtcgtcgggggtccctgtacgttcggttctcgtcggcctcatcgacaacgcctcctcaactctcgcctcccncacctatctctaggactagtaagacgtaggacggacggacgctacgtactactacgtgttacctagttacctttagtgtacgtacgcccggtcgtntacggttggttcgggtccgttcggggacgggtacgggaccgtacgtcgacggttacccgttcgttaacggccgaacggcccgtggcctcccgttccccgtaaccg

SEQ ID NO: 319962 - DNA, 617 bp, Homo sapiens
  misc_feature: GZ8MTXP01EQDWV.19.67.G01.1.454.CMB.2.raw
  modified_base (556)..(556): a, c, t, g, unknown or other
  misc_feature (556)..(556): n is a, c, g, or t
  modified_base (571)..(571): a, c, t, g, unknown or other
  misc_feature (571)..(571): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtgggtggagacgtgggcgggaggcttggtccaggcccgtggggcggttctcgtgagactgtcctgtcgaaccctcgtggggtctccgtcagcagcgactgtattgccgtgggtccgccgaggctaccgaggggaaggagggccgggaggtgggtcgcgtaggtttattttagagggtgggaccgactagttcgtacggagaactcgaagtgggacgggcctattccacatctaccagtagtactttcacagaaaccactactgtcttacttacaaatcgaacgagtcccgtagggacggggaccgaaggaccgacgggtcccgttattagtttagttgtggtaagtagttagtttagngggtagtagttgggngttagggtgacgaagtactcggacggtcgggggccgtaaccggggg

SEQ ID NO: 319963 - DNA, 786 bp, Homo sapiens
  misc_feature: GZ8MTXP01D1PXP.19.67.G01.1.454.CMB.2.raw
tcagtactctcgtgcacgaccggtgctcgatttagagtatacatattggggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtgggtggagacgtgggcggaggcttggtccagccgtgggcggtctcgtgagctgtcctgtcgaccctcgtggggtctccgtcagcagcgactgtattcggccgtggggtcccgccgagggtcctccggaaggggaaggagggcccgggtaggtcggggtcgcggtaggtttatttttagaggggtgggaacctacgtattcgtacgggaacggtaaccgtaccctaaggtcgggaacggggtacccgggtaactttccgaaccctacgtacccttacccgaacgttaacggttaccttttaccttaccgaaacggtaaaccctaacctaaccttcggttacccttacctttaaccgtaaaactacggtaaacgtaaaccggtaccgttacgggaaccggggacccgggtaaccgggaccggtaaaccgggtcccgttacccgttattttaaagtttcggtaggttaagggtaaaggttaggttttacggttagggtaccggtaaggttggggttccggtttaggggtaaggggtaaccgtaaggacgttaccggaccggttaacgggggaacccgtaaacccggggg

SEQ ID NO: 319964 - DNA, 882 bp, Homo sapiens
  misc_feature: GZ8MTXP01EARPL.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgcaacgtgggtggagacgtgggcggaggcttcggtccagccgtgggcggtctctgagactcgtctgtcgacctgtcgggtctcgtcagcagcgtactgtacgttcggccgtcgggtcccgccgagggccgtaccggaagggggaaacgacgggggcccggggtagggttcgggggttacggacggttaagggttttaagtttttttaagggaagggggttcgggggaaacccgtacgttaacgtttaccgtaaccggggtaacgtaacccgttacccgtaagggttgggggaaaccggggtaccccgttaagtttccccaacccgttacgttacccttacccgaagttaccgtttaacctttttacccgacctaaacggtaaaccctaacgttaccgttacgttaccctttaactttaaccgaaaaatttccgggaaaaccgtaacggtcccggttaacgggggaaccgggggtacccggaaacggggacccgtaaccgggggttacccctttaacgtttaagttttaacggtttcgggttggttaaaggtaggggtttaaaggtttttacgggttgggggaccggttaaaggttcgggggttcggttacgggggttaaggtaaccgaaacgggtcgttacccggggacggggttaaccggggggttaaccccggtaaaaccccggggg

SEQ ID NO: 319965 - DNA, 753 bp, Homo sapiens
  misc_feature: GZ8MTXP01B3MWB.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgcaacgtggtggagacgtgggcggaggcttggtccagccgtgggcggtctcgtgagactgtcctgtcgaaccctcgtggggtctccgtcagcagcgactgtagttgccgtgggtcccgccgacggcctaccggaaggggaacggacggggccgggaaggtcgggggtcgacgtaggtttactttttagacggggttcggggaacccgtactaagttccgtaacgggtacgtaaaccttccgaaggttacggggacggggtacccgatttacccaccgtaaacttcccgtacccgtaagtacgttacctttttccaactaacggtaaacctacgtacttcgtaccttacttaactaaaacgttcgaaaccgacggtcccgtagggaaaccgggggcccgaaacggggacccgtaacgggggtacccttacgttaagtttaacgtttcggtaggttaaggtaagtttaggtttaagttggggtaccggtaagttggggttcgttaggggtaaggtacgtaagtacggttcgacgggttcgggggaacccggtaacccggggg

SEQ ID NO: 319966 - DNA, 739 bp, Homo sapiens
  misc_feature: GZ8MTXP01BSPQU.19.67.G01.1.454.CMB.2.raw
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcgtctctgagactgtcctgtgaccctctggggtctcgtcagtagcgactgtattgcctgggtccacgaggctccgaggggaagaggccggagtggggtcgcgtaggtatttttagagggtgggacgacctagttcgtacgggagactcccagtgggacggggcccgtaatttccaacctattaccttcccaaggtacgtaaccttttttcaccgtaaggaaacccaccgtaaacctttcggttacccttacctttacaaaaacgtttcgaaaacccgaaggggccccgttaggggaaccgggggtaccccggaaacggggtaacccgaacccgggggtcccgttaccgttaacgtttaacgtttcgggttacggttgggaaaggttaacggttttttaaaggcgggggttccgtaaacgttgggggaccgttgggggttacgggaaccgtaggaaacttccgggaaaccgggttcggggggaacccgttaaccgggggtaaaccccgg

SEQ ID NO: 319967 - DNA, 626 bp, Homo sapiens
  misc_feature: GZ8MTXP01AJ082.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgcaacgtgggtggagacgtgggcggaggtcttggtccaggccgtggggccgtctcgtgagtactgtcctgtcgaaccctcgtggggtctccgtcagcagcgactgtattgcctgggtcccgcaggctcgagggaagaggccggaggtgggtcgcgtaggttattttagtaggtgggaccgacagttcgtacggagaacctccaagtgggacggggcctacttccaccatcctccagagtaccttttcacagaaaccactactcgttaccttacttacaaattacgaaacgtacgacccgtggaacggggcccggaacgggacgaccgggtcccgttctaatttagtgttggtgtaaggttagtttagttgggcgtagttgggttcgttgggtggactaaggacgtcgacgggtcggggccgtaaacccggggg

SEQ ID NO: 319968 - DNA, 537 bp, Homo sapiens
  misc_feature: GZ8MTXP01C0LMN.19.67.G01.1.454.CMB.2.raw
  modified_base (291)..(291): a, c, t, g, unknown or other
  misc_feature (291)..(291): n is a, c, g, or t
  modified_base (465)..(465): a, c, t, g, unknown or other
  misc_feature (465)..(465): n is a, c, g, or t
  modified_base (513)..(513): a, c, t, g, unknown or other
  misc_feature (513)..(513): n is a, c, g, or t
tcagtactctcgtgcacgaccggtgctcgatttagagtatacatattgggtttggggggtagctcaggaagcagagcctggagcatctccactatggcctgggctccactacttctcaccctcctcgctcactgcacaggttcttgggccaactttatgctgactcagccccactctgtgtcggagtctccggggaagacggtaaccattcttttgcacccacaacagtggcaacattgccagcaattttgtgcagtggtaccagcagcgcccggcacgttccccacatgngatcatgaggataatacaaagaccgtcgtcgggggtccctgtatcggttctcgtcggctccatcgactaacgcctcctaccaaacctctcgcccctcctcacctatctctggactagaagacgtgaggaccgagctgactactacgttgtctagttctatgagtacgcgtcgtnagtggtcgtgtcggcggacgcgaagcttacggttccttcgaaggtccncgcccacggctccgaaccccgtcg

SEQ ID NO: 319969 - DNA, 619 bp, Homo sapiens
  misc_feature: GZ8MTXP01C7LIV.19.67.G01.1.454.CMB.2.raw
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtgggcggaggcttggtccagccgtgggcggtctctgagactgtcctgtcgaccctcgtggggtctccgtcagcagcgactgtatgcctgggtccgccgaggctccgagggagaggccggaggtgggtcgcgtaggttattttagtagggtggggacgacgtattcgtaaacgggacgtaacctccgagttgggacggggacccgacttaccgaccctatccgtaccaagtacgttaccttttcacaacgtaacacacttgtcttacttacaaagtcgaaacagtcccgtaggacgggccgaggaccgacggtccgttacgtactttgttgtgttggaagttaggtttagtgggttacgttagttcgggcgtgggtggaacgtaggacgtcggaacggtaaccggggg

SEQ ID NO: 319970 - DNA, 606 bp, Homo sapiens
  misc_feature: GZ8MTXP01DKDH5.19.67.G01.1.454.CMB.2.raw
  modified_base (546)..(546): a, c, t, g, unknown or other
  misc_feature (546)..(546): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtgggcggaggcttggtccagccgtgggcggtctctgagactgtcctgtcgaaccctcgtggggtctccgtcagcagcgactgtattcgccgtgggtcccgccgaggcctccgaggggaagagggccgggaggtgggtcgcgtaggttattttagaggtggaaccgactagttcgtacggagaacctccgaagtgggagggcccgtattccgccatcctaccagtacgtacttttcacaagaaaccactactgtctacttacaaatacgaacgagccgtaggacgggaccgaaggaccgacgggtacccgtacttattagttgtgtgagttagtttagnggacgtagttggcgttgggtaagacgtaagactcgacggtcggggaacccgtaaccgggg

SEQ ID NO: 319971 - DNA, 685 bp, Homo sapiens
  misc_feature: GZ8MTXP01CSLK0.19.67.G01.1.454.CMB.2.raw
  modified_base (604)..(604): a, c, t, g, unknown or other
  misc_feature (604)..(604): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgcaacgtggtggagacgtgggcggaggcttggtccagccgtgggcggtctctgagactgtcctgtcgaccctcgtgggtctccgtcagcagcgactgtattcgccgtcgggtccgccgaggcctccggaagggggaacggacgggccgggaggtcggggtcgacgtaggtttattttagaggggtgggaccgactattcgtaacggacgtaacctccgaagtcgggacggggtcccgtattccgaacctataccctaccgaagtacgttacttttctacaacgtaaacactactcgtccttacttaactaaatacgaacgacgtccgtagggacggggaccgaacggacccgtaccgggtaccgttacttaagtttaagttggtggtaaggtaaggttaggttttaagggngggtacggtaggttcgggttcggttagggtaacggaacgtaacggtacgtacggacgggtccggggaacccggtaaccggg

SEQ ID NO: 319972 - DNA, 619 bp, Homo sapiens
  misc_feature: GZ8MTXP01EQNFS.19.67.G01.1.454.CMB.2.raw
  modified_base (390)..(390): a, c, t, g, unknown or other
  misc_feature (390)..(390): n is a, c, g, or t
  modified_base (545)..(545): a, c, t, g, unknown or other
  misc_feature (545)..(545): n is a, c, g, or t
  modified_base (559)..(559): a, c, t, g, unknown or other
  misc_feature (559)..(559): n is a, c, g, or t
  modified_base (571)..(571): a, c, t, g, unknown or other
  misc_feature (571)..(571): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtgggcggaggcttggtccaggccgtggggcggtctcgtgagactgtcctgtcgtaacccctcgtcgggtctccgtcagcagcgactgtattgccgtcgggtccgccaggcctccgaggggaagaggccggagtgggtcgcgtaggtttattttagagggtggaccgactagtcgtaacggngaactccgaagtgggacgggtccgtacgttccaccgtactcctacccgagtacggttacttttcgtacaacgtaaacctactacgtcgtccttactacaaatcgaacgtcgccgtaggacgggccgaaggaccgaccggtcggtctaattgttgngtgagttgtttagnggtgagttcggngttggggtgacaagtagtcggacgtcgggggaacccgtaacccggggg

SEQ ID NO: 319973 - DNA, 699 bp, Homo sapiens
  misc_feature: GZ8MTXP01BJ9VI.19.67.G01.1.454.CMB.2.raw
  modified_base (611)..(611): a, c, t, g, unknown or other
  misc_feature (611)..(611): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtgggcggaggcttggtccagccgtggggcggtctcgtgagactgtcctgtcgaaccctcgtggggtctccgtcagcagcgactgtattcgccgtgggtcccgccgaggctccgaggggaaggagggccgggaggtgggtcgcgtaggtttatttttaggagggttggggaccacgtagttcgtaacgggacgtaacttcccgaaggttcgggaacgggggtcccgtagtttcccgacctaagttcctacccgtaagtaacgtacttttctacacgtaaacacctactcgtacttcttacaaatacgaacacggtacccgtgggacgggggacccgaagggaccgtaccgggtaccgttcgttaagtttagtttggtaggtggtaaggttaaggttttagggngggtacggtaggttcgggttcggttggggtaaggaacgtaacgggtacgtaccggttacgggtaaccgggggaacccggtaaccgggg

SEQ ID NO: 319974 - DNA, 580 bp, Homo sapiens
  misc_feature: GZ8MTXP01DXDE6.19.67.G01.1.454.CMB.2.raw
  modified_base (550)..(550): a, c, t, g, unknown or other
  misc_feature (550)..(550): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtgggcggaggcttggtccagcctgggcgtctctgagactgtcctgtcgaaccctcgtggggtctccgtcagcagcgactgtattgccgtgggtccgccgaggcctccgaggggaagaggccgggaggtgggtcgcgtaggttattttagaggtggaccacattcgacggacgaactccaagtgggacgggcctagttccacgtatcctaccagtacgtactttcacaagaacactactgtctctacaaatcgaacgacgccgtaggacgggccgaggaccgacggtaccgtcttattattgtgtgtagttagttagttggagtagttggcgttgggtggancgagtcgacggtcggggccgtaacccgggg

SEQ ID NO: 319975 - DNA, 597 bp, Homo sapiens
  misc_feature: GZ8MTXP01DGWFQ.19.67.G01.1.454.CMB.2.raw
  modified_base (537)..(537): a, c, t, g, unknown or other
  misc_feature (537)..(537): n is a, c, g, or t
  modified_base (566)..(566): a, c, t, g, unknown or other
  misc_feature (566)..(566): n is a, c, g, or t
  modified_base (571)..(571): a, c, t, g, unknown or other
  misc_feature (571)..(571): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtgggcggaggcttggtccagccgtgggcgtctctgagactgtcctgtcgaaccctctggggtctccgtcagcagcgactgtattgccgtggtccgccgaggctccgagggaagagggccggagtgggtcgcgtaggttatttttagaggtcgggaccgacatttcgtacggagaactcccaagtgggacgggccgtattccgaccatcctaccagagtacttttcacacgaaacactactgtctcttacaaatgaaacgacgcctggacggggccgaaggaccgacgggtaccgtacttattagttggtgtaagtagttaggtttagnggtacgtagttggttcgttgggtggacgngtacncgacggtcggggaaccgtaaccgggg

SEQ ID NO: 319976 - DNA, 603 bp, Homo sapiens
  misc_feature: GZ8MTXP01CVJUE.19.67.G01.1.454.CMB.2.raw
  modified_base (390)..(390): a, c, t, g, unknown or other
  misc_feature (390)..(390): n is a, c, g, or t
  modified_base (544)..(544): a, c, t, g, unknown or other
  misc_feature (544)..(544): n is a, c, g, or t
tcagtactctcgtgcacgaccggtgctcgatttagagtatacatattggggtttgggggggagaggagcccagcactgggattccgaggtgtttccattcggtgctcagcactgaacacagaggactcaccatggagttttggctgacctgggttttccttgctgcaattttcaggaggtgtccagtgtgaggtgcaactggtggagactggcggaggcttggtccagcctggggcggtctctgagactgtcctgtgaaccctcgtggggtctccgtcagcagcgactgtattgccgtgggtccgcaggctccgaggggaagaggccggagtgggtcgcaggtatttttagtaggtgggaccgactagttcgtaacgggagaacttccgngttgggagggccgattcaaccactctccagtagtaacttttctacaagaaacactaactcgtacttactacaaattagaaacacgtcctaggacggggaccgaacggaccgacgggtcccgtacttaagttattggtgtgaagttaggttttangggtacgagttgggcttagggtcggaagtaagagtcgacggtcggggccgtaaccgggg

SEQ ID NO: 319977 - DNA, 625 bp, Homo sapiens
  misc_feature: GZ8MTXP01BL3ZU.19.67.G01.1.454.CMB.2.raw
  modified_base (550)..(550): a, c, t, g, unknown or other
  misc_feature (550)..(550): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtgggcggaggcttggtccagccgtgggcggtctcgtgagactgtcctgtcgaccctcgtggggtctcgtcagcagcgactgtatgccgtgggtccgcagctcgagggagaggcggagtgggcgcgtaggttattttagaggtgggaccgactagttcgacggagaacctccgaagtgggacgggtccgatttccaccgatcctaccagtacgtacttttcacaacgaaacactaacttcgtactacgttaccaaatcgaaacaggccgtaggacggggaccgacggaccgaccgggtaccgttcgttaagtttagttggtggtaagtaaggttagtttagngggtcgtaggttgggcggttggggtaacggaagtaaggtacgtacggacggtcgggggaacccgtaacccggggg

SEQ ID NO: 319978 - DNA, 802 bp, Homo sapiens
  misc_feature: GZ8MTXP01CTTXO.19.67.G01.1.454.CMB.2.raw
  modified_base (281)..(281): a, c, t, g, unknown or other
  misc_feature (281)..(281): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgcaacgtggtggagacgtgggcggaggcttggtccaggccgtggggcggtctctgagactgtcctgtcgaccctcgtgggtctccgtnagcagcgactgtattcgccgtgggtcccgccgaggcctaccgaagggggaagacggggccggaggtcggggtcgcgtaaggtttatttttaaggaggggttcggggaaccgtacgtaagttccgtaacgggacgtaacccttccgaaggttcgggggacgggtacccgtattacccgaaccctaactcccgtacccgtaagtaacggttaacctttttccgacgtaaacggaaacctaaccttaccgttacggttaccttaacgtttaaacctaaaaagttaccggtaaaaccggacgggtacccggttacggggaaaccgggggtacccggaaacggggaacccgtaaccggggttaccccgtttaccgtttaagtttaacgtttcgggtggtttaagggtaaaggtttaggttttaaaggttggggtaccggttaaggttgggttccggttaggggttaagggaaccgtaaggtaacgtcccggttaacgggtccgggggaacccggtaaacccggggg

SEQ ID NO: 319979 - DNA, 664 bp, Homo sapiens
  misc_feature: GZ8MTXP01C8NAJ.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtgggcggaggcttggtccaggccgtggggcggtctctgagacttgtcctgtcgaaccctcgtggggtctccgtcagcagcgactgtattcgccgtgggtcccgccaggctccgagggaagaggccggaggtggggtcgcgtaggttattttagtaggtggggtaccgactagttcgtaacggagaacctccaagtgggacgggtcccgattccacctatcctccagacgttactttcactaagaacactactcgttcttacttacaaattagaaacgacgtacccgttagggaacggggacccgaacgggaccgaccgggtacccggttacccttaagtttaagtttgggttggttaaggtaaggttaggttttagttcggggtacgtaggttcgggttcgttgggtcgggaactaaggactcggaccggttcgggggaacccggtaacccggggg

SEQ ID NO: 319980 - DNA, 659 bp, Homo sapiens
  misc_feature: GZ8MTXP01A4U6O.19.67.G01.1.454.CMB.2.raw
  modified_base (403)..(403): a, c, t, g, unknown or other
  misc_feature (403)..(403): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtgggcggagggcttggtccaggcccgtggggccggttctcgtgagactgtcctgtcgaaccctcgtggggtctccgtcagcagcgactgtattcgccgtgggtccgccgaggcctccgagggaggacggccgggaggtgggtcgcgtaggttattttagtagggtgggaccgactagttcgtacggagaactccngtcgggagggccgtacttccgaccagtcctaccgtagacgttactttctcaagaaacactactcgtactcttacaaagttacgaacgtacgtccgtaggacggggtaccgaacggaccgaccgggtccgttaccttaagtttagtttaggtggtgtaaggttagttttaagttgggtcggtaagttcggggttcgttggggttggaacgtaacggtaacgtccggaacggtccgggggaaccgtaaaccccggggg

SEQ ID NO: 319981 - DNA, 574 bp, Homo sapiens
  misc_feature: GZ8MTXP01AZQ5V.19.67.G01.1.454.CMB.2.raw
  modified_base (399)..(399): a, c, t, g, unknown or other
  misc_feature (399)..(399): n is a, c, g, or t
  modified_base (424)..(424): a, c, t, g, unknown or other
  misc_feature (424)..(424): n is a, c, g, or t
  modified_base (427)..(427): a, c, t, g, unknown or other
  misc_feature (427)..(427): n is a, c, g, or t
  modified_base (534)..(534): a, c, t, g, unknown or other
  misc_feature (534)..(534): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaacgtgggtggagacgtgggcgggaggtcgttgggtccaggccgtggggcggtctcgtgagactgtcctgtcgaccctcgtgggtctccgcagcagcgactgtatcgccgtgggtcccgccgaggctaccgaggggaacgacgggccggaggtgggtcgcgtaaggttattttagacggtgggacgacgtattcgaacggancgtcgagtgggacggcctatcaccntcncagacgtacttcacagacacactcgtctacttacaagtgaacacgccgtaggacggccgaggaccgcggtcctcgttattgtgtgttgtagttagttagtggttcgngttcggtgtagggtcgacgagttactcgaacggtccgggg

SEQ ID NO: 319982 - DNA, 654 bp, Homo sapiens
  misc_feature: GZ8MTXP01EM22Z.19.67.G01.1.454.CMB.2.raw
  modified_base (247)..(247): a, c, t, g, unknown or other
  misc_feature (247)..(247): n is a, c, g, or t
  modified_base (316)..(316): a, c, t, g, unknown or other
  misc_feature (316)..(316): n is a, c, g, or t
  modified_base (330)..(330): a, c, t, g, unknown or other
  misc_feature (330)..(330): n is a, c, g, or t
  modified_base (439)..(439): a, c, t, g, unknown or other
  misc_feature (439)..(439): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctggcggggacatcgtgatcgacccagtacccagactcactggctgtgtctcgtgggcgagaccggccaacaatcaactgcacggtccagccaagtaactctttccnccacctaccaaagaaactaaaacttctagcctagaaccaacagacaccagacacgtcctacctaagtcncttactagtttacngggtctttccgtaacgcgtacgtaacgttccgggggccctaggaccccgtacggtccggggcacggtccgggtaactgggaaccagtacttccacttccgccaacctancgacgacgacgcctagacgacggcgtaagaacgtgtgtacgtacttagtttacgtactagtactaagtaactttaatttcttttaccgtaccgttcccgtccgggttacggtaccgttcgggaaccggtaaacggggaccggtaaagggttacgaaaactcggaaaacgttcgttacggtggcgtaaccgtacgaccttacgttaacgttcgtcg

SEQ ID NO: 319983 - DNA, 638 bp, Homo sapiens
  misc_feature: GZ8MTXP01BF2BR.19.67.G01.1.454.CMB.2.raw
  modified_base (571)..(571): a, c, t, g, unknown or other
  misc_feature (571)..(571): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtggcggaggcttggtccagcctggacggtctctgagactgtcctgtcgaaccctcgtggggtctccgtcagcagcgactgtattgccgtgggtcccgcgaggctccgaggggagacgggccggaggtgggtcgacgtaggtttattttagagggtggaacccgactagttcgtacggagtaacctccaagtcgggacgggtccctagttccacctatcctacccaagtacgttacttttcgacaagaaaccactacttgtaccttacttacaaattcgaaacgcgtccgtggaacggggcccgaagggaccgacgggtcccgttattaacgttagttggtgtaaggtaaggttagtttaggnggtacgtagttggttcgttgggtaacgagaagtacgtacggacgggtaacggggaacccgtaacggg

SEQ ID NO: 319984 - DNA, 920 bp, Homo sapiens
  misc_feature: GZ8MTXP01E2TB8.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgcaacgtggtggagacgtgggcggaggcttggtccaggcccgtggggccgtcctgagacgtcgtcgtcgtgtaccgtacccgtggtcgggtcctccgtcgagcgacgtcgtacgttgttagttccgtccggtccgggtccccgaccgacggtaccgaccgggaaggggaacgggacgggaccgggtaggggttccgggggtaccgtaggtttaaaggtttttagttttaagggtacgggggtacggtaacccgtaacgttacgtttaccggtaacgggaactaacccgtaccgtaagggtacggggaccgggtacctaacttacccgaacctacttacccgtaaccgtaaggtaccgtttactttaccaacgtaaacgtaaaccctacgtaacgtttccgttaccttaaccttaaacgtaaaacgttaacgaaaccgggtaccggttaacccggggtaaacgggggaccggggaacccggggtaaacccgggaaacccgggtaacccggggtttacccctttaacgttttaaaacgttttcgggtttacgggttagggttaaacgggttaaacgggtttttaagggttttaggggaaccgggttaccggggttaagggttccgggggttacgggttagggggttaaccggaaaccgtaagggtttaacccgaccggggttaaacccgggggtaaccgggggttaaccccgggttaaaaccccggggg

SEQ ID NO: 319985 - DNA, 735 bp, Homo sapiens
  misc_feature: GZ8MTXP01BASV5.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgagtgcaactggtggagactggcggaggcttggtccagcctgggcggtctctgagactgtcctgtcgaaccctcgtcggggtctccgtcagcagcgactgtatgcctgggtccgcaggctccgaggggaagaggccggagtgggtcgcgtaggttatttttagaggggttgggacccgactagttccgtaacgggagtaaaccttcccgaagttcggggacggggccgtactttccaccctattaccctcccaagtaacggtaacctttttcactaaacggaaaccctacgtaaccttcggtaccttacctttaaccgaaaattcgaaaaccggtacggtacccgttacgggaacgggggacccgaagggacccgtaacgggtccccggttacttaagtttaagttggggttgttaagggaaaggtttacgggttttaaacgttgggggtaccgtaagttcgggggttccgttagggggttaaggaaccgtaagggtaaaccttccggaaaccggggttccggggggaacccgtaaaccccgggggg

SEQ ID NO: 319986 - DNA, 854 bp, Homo sapiens
  misc_feature: GZ8MTXP01CFHJW.19.67.G01.1.454.CMB.2.raw
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgaccttgggttttcctgctgctaatttcgaggagtgtccagtgtgaggtgacaacgtggtggagacgtgggcggaggtcttggccagtccgtggggtcgtctcgtgagactgtcctgtcgtaaccctcgtggggtcctcgtcgagcagcgactgtacttcgccgtgggtccgccgaggccgtaccggaaggggaacggtcgggtacccggggtaggttcgggggtaccgacgttaagggttttagtttttaaggaccggggttacggggaacgtaacgtaacgtttaccgtaaaccggggaactaacccggttcccgtaaagggttacgggggaccggggtacccggtaactttacccgaaaccctacgttacccgtaccgaacggtaacgtttaccctttttacgaaccgtaaacggtaaacctaccttacgttacgttaccttaaccgttttaacgaaaactttcggaaaaccgtacggtaccccggttaaggggacccggggaaccccggtaagggtaaccccggtaaccgggtcccggttaacctttaacgtttagggtttaacgggttacggtttaacgggtaaacggtttaacggttttacgggtcgggttaaacggttgggttacggggtccgggtttaagggtaacggggtaaccgttaaggttacgttaacccgggttaaccgggttaacccgggggg

SEQ ID NO: 319987 - DNA, 708 bp, Homo sapiens
  misc_feature: GZ8MTXP01DSQYR.19.67.G01.1.454.CMB.2.raw
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgaccttgggttttcctgctgcaatttcaggaggtgtccagtgtgaggtgcaacgtggtggagacgtgggcggaggcttggccagccgtgggcgtctctgagactgtcctgtcgacccgtcgtgggtctccgtcagcagcgactgtattgccgtgggtcccgcaggctccgagggagaggccgggagtgggtcgcgtaggttattttagaggttggggaacgtacgtagtttaccgtaaacgggaacgtccgttaccgaaggttcggggaacggggtcccgtaagtttacccaaccctaacttcctaccgtaacggtacgttaaccgtttttcgtaactaacgaaacctaccgtacttacgttaccttaccttacaaaacgttacgaaactacggaccgtagggaccgggtaccggaacgggaaccgaccgggtcccgttacgtaacgtttaagtttggtaggttaggtaaacggttaggttttaacgggtcgggttacgttggttcgggtggttagggtaacgggaacgacggttacgtccggttaacgggtaaccggggg

SEQ ID NO: 319988 - DNA, 627 bp, Homo sapiens
  misc_feature: GZ8MTXP01AJCZH.19.67.G01.1.454.CMB.2.raw
  modified_base (392)..(392): a, c, t, g, unknown or other
  misc_feature (392)..(392): n is a, c, g, or t
tcagtactctcgtgcacgaccggtgctcgatttagagtatacatattgggtttggggtctgggagaggagcccagcactgggattccgaggtgtttccattcggtgctcagcactaaacacagaggactcaccatggagtttggctgacctgggttttccttgctgcaatttcaggaggtgtccagtgtgaggtgcaacgtggtggagacgtgggcggaggcttggtccagccgtgggcgtctctgagtactgtcctgtacgacccgtcgtcggggtctccgtcagcagcgactgtatcgccgtgggtcccgccgaggctaccggagggaaggacgggccggaggtgggtcgcgtaggttatttagagggtcgggacagtagtcgacggaanactcgaggtgggacgggccgattcactatcctacgagtacgtacttttacgcaacgaactactactcgtctactactaaactacgggaactacggtccgtacgggacgggcccggacggaccgtaccgggtccgtacgttacgtttagttggtgtaggttaggttagtttagtgggtcgttagttcgggttaggtggtggaacgagtacgttcggtaacggttcggggtaaccgg

SEQ ID NO: 319989 - DNA, 620 bp, Homo sapiens
  misc_feature: GZ8MTXP01DTF1P.19.67.G01.1.454.CMB.2.raw
  modified_base (482)..(482): a, c, t, g, unknown or other
  misc_feature (482)..(482): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgcaacgtggtggagacgtgggcggaggtcgttggtccaggccgtggggcggtctcgtgagtactcgtcctgtcgtacccgtcgtgggtctccgtcagcagcgactgtatgccgtggtccgccgaggctccgaaggggaacgagggccgggaggtcgggtcgcgtaggtttattttagagggtggaccgactagttcgaacgaagaacctcgaaggtcgggagggtccctattccgaccattcctacccgagtacgtactttcacaacgaacactcgttcgtctactaanaaactagaacgacgcgtaggacgggccgaacggaccgacggtccgtcttaattgttgtgtaaggaagttagtttagcgggtgtagttggttcgttgggtggacgaagtcgtcgacggtcggggaaccgtaacccgggg

SEQ ID NO: 319990 - DNA, 681 bp, Homo sapiens
  misc_feature: GZ8MTXP01B0OUS.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgcaactgggtggagacgtgggcggaggcttggtccaggccgtggggcgtctctgagactgtcctgtcgaccctgtgggtctccgtcagcagcgactgtagtcgccgtgggtcccgccgagggcctaccggaaggggaacggacggggccgggaggtcggggtcgcgtaggtttagttttagaggggtgggaccgacgtagttcgtaacggacgaacttccgaagtcgggacgggtaccctattccaaccgtactcctacgtaagtacgtaccttttcgactaacgaaacctactacttcgtcttacttaacaaagttcgaaacggacgtccggtagggacggggaccgaacgggtaccgaccggtccgttacgttaagtttagttgtggtaaggtaaggttagtttaggttggtacggtgttagggttcggttagggtaacggagaacggtacgtaccggacggttcgggggaacccgtaaccggggg

SEQ ID NO: 319991 - DNA, 820 bp, Homo sapiens
  misc_feature: GZ8MTXP01EYLK5.19.67.G01.1.454.CMB.2.raw
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaacgtgggtggagacgtgggcgggaggctttgggtccaggcccgtggggcggtctctgagctgtcctgtcgaaccctcgtggggtctccgcagcagcgactgtattcgcccgtgggtcccgccgaggcctacccgaaagggggaacggacgggacccggggaagggttgggggtacgtcggtaaagggtttaatttttttaaggtaacggggttagggggaaacgtaacgtaacgtttaccgtaaaaccggggaactaacccgttacccgaaaggttcgggggaaacggggtccccggtaaatttacccaaaccctaaactcctacccgaaggtacgtaacctttttcctaacaaacgtaaaaccaacctaaccgttcgttaccttaaccgtttaaccaaaagttacggaaaacctaacggaccccgttaggggaaaccggggaccccgggaaaggaaccccggtaccgggaccccggttacttaaagttttaagtttggttagtttagggaaaggtttaaggttttaacggtaggggttaaccggttagttcgggggttaacggttggggtaacgggtaaacggtaagggacttaaccggaacgggttaaccccgggggggg

SEQ ID NO: 319992 - DNA, 652 bp, Homo sapiens
  misc_feature: GZ8MTXP01AXYI6.19.67.G01.1.454.CMB.2.raw
  modified_base (595)..(595): a, c, t, g, unknown or other
  misc_feature (595)..(595): n is a, c, g, or t
  modified_base (615)..(615): a, c, t, g, unknown or other
  misc_feature (615)..(615): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtgggcgggaggcttggtccaggccgtggggcggtctctgagtactgtcctgtcgaaccctgtggggtctcgtcagcagcgactgtattcgccgtgggtcccgcgaggcctccgaggggaagacgggccggaggtgggtcgcgtaggtttattttagagggtggaacccgactattaccgtaacgggagtaaacctcccgaagttcggggaacggggccctagtttaccaacccgtaattccctaccgaagtaacggtacctttttacaccgtaagaaaccaacctacgttacgttaccttactttacgaaattacggaactacggcccgtaggacggaccgaggaccgacggacgttctaattatggtgttggaagttaggtttagngggacgtgttggcgttgggngacgaagtacgacgacgggtcggaacccggtaacggg

SEQ ID NO: 319993 - DNA, 593 bp, Homo sapiens
  misc_feature: GZ8MTXP01AVPCN.19.67.G01.1.454.CMB.2.raw
  modified_base (507)..(507): a, c, t, g, unknown or other
  misc_feature (507)..(507): n is a, c, g, or t
  modified_base (535)..(535): a, c, t, g, unknown or other
  misc_feature (535)..(535): n is a, c, g, or t
  modified_base (550)..(550): a, c, t, g, unknown or other
  misc_feature (550)..(550): n is a, c, g, or t
  modified_base (564)..(564): a, c, t, g, unknown or other
  misc_feature (564)..(564): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgcaacgtggtggagacgtgggcggaggcttggtccagccgtggggcggtctctgagactgtcctgtcgaccctcgtggggtctccgtcagcagcgactgtattgccgtgggtccgccgaggctccgaggggagagggccgggagtgggtcgcgtaggttattttagagggtcgggaccgacattcgtacggagaactccgaagtgggacgggccgattcacatctccgagacgtacttttcacagaacactactgtcttacttacaaatgaaacgacgtccgtagacgggaccgacggaccgacggggcccttnttattagttgtgtaagagttagtttagnggtacgagttcgggngttgggtaacgganaagcgcggacgtcggggccgtaaccgggg

SEQ ID NO: 319994 - DNA, 651 bp, Homo sapiens
  misc_feature: GZ8MTXP01AYMLL.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgcaacgtggtggagacgtgggcggaggcttggtccagccgtgggcggtctcgtgagactgtctgtcgaccctcgtgggtctccgtcagcagcgtactgtatcgccgtgggtcccgcgaggccgtccggaagggaaggacggccggaggtcgggtcgcgtaggttattttagaggtggaccgactagttcgtacggagaactccgaagtcggggacgggtcccgtagttccaaccagtcccgtacctaagtacgttaccttttacacaagtaaaccactacttcgttacttacttaacaaagttacgaaacgcggtaccgtagggaaccggggaccggaacggaccgaccggtaccgtattacgtttagttggtggtaagtaaggttaggtttagcgggtagtagttggcgttgggtaaggacgtaagacgtcggacggtccggggccgtaacccgggg

SEQ ID NO: 319995 - DNA, 655 bp, Homo sapiens
  misc_feature: GZ8MTXP01BAXCS.19.67.G01.1.454.CMB.2.raw
  modified_base (443)..(443): a, c, t, g, unknown or other
  misc_feature (443)..(443): n is a, c, g, or t
  modified_base (447)..(447): a, c, t, g, unknown or other
  misc_feature (447)..(447): n is a, c, g, or t
  modified_base (582)..(582): a, c, t, g, unknown or other
  misc_feature (582)..(582): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgcaacgtggtggagacgtgggcggaggcttgggtccaggccgtgggcggtctcgtggagtacgtcgtcctgtacgaacccgtcgtgggggtcctccgtcagcgagcgtatgtattcgccgtgggtcccgccgaggctccggaagggggaacggacgggccgggaggtcgggggtcgtagtaggtttattttaggagggtgggaaccactagttcgacggagaacctcgaagtgggacgggctatccgacntccncagtacgttaccttcacacgaaactactctgtctacttacaaatacgaacgcggtaccggtagggaaccgggccgaacgggacccgacggttaccgttctttaagtttagttggtgtaaggtagttacggtttgngggtacgtgttgggcgttagggcggtagtcgggtaaccgcgggttacgggtaacccgggaacgggtaacccgg

SEQ ID NO: 319996 - DNA, 645 bp, Homo sapiens
  misc_feature: GZ8MTXP01EGCBB.19.67.G01.1.454.CMB.2.raw
  modified_base (238)..(238): a, c, t, g, unknown or other
  misc_feature (238)..(238): n is a, c, g, or t
  modified_base (316)..(316): a, c, t, g, unknown or other
  misc_feature (316)..(316): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctgcgggacatcgtgatgacccagtacccagactcactggctgtgtctctgggcgagacggccacaatcaactgcaggtccagccagaactattttcnccacctacaaagaacaaaacttctagcctggtaccaacagacgaccaggacagcctactaagttcgactctatttacngggtctttcgtacgcgtacgtaacgttccgggggtccctggacccccgaggttccggggcacggtccggggtactggggaactagtactttccgactccgtacaacctatccagccaggcctggactaggcttagaagatgtggacttagtttactacgtgtacagtactaagtttctttttactacttcccgtccgggttcggtaccggtttcggaacccgtaacggggttacccgtaaggggttacggaaaacttccggaacgttaaccggttaaacttcgggtacgggtaaccttcggacccgttaccctaacgtttccgtttccg

SEQ ID NO: 319997 - DNA, 655 bp, Homo sapiens
  misc_feature: GZ8MTXP01BTSRL.19.67.G01.1.454.CMB.2.raw
  modified_base (588)..(588): a, c, t, g, unknown or other
  misc_feature (588)..(588): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtggcggaggcttggtccagccgtggggcggtctctgagactgtcctgtcgaccctcgtgggtctcgtcagcagcgactgtattcgccgtgggtcccgccgaggcctaccgaggggaaggagggccgggaggtcgggtcgcgtaggtttattttaggagggtggaccgactagttcgtacggagaacctccgaagtcgggacgggccgtacttccgacctatccctcgtaagtacgtactttctacaacgtaacactactcgtaccttacttacaaattacgaaacgtacgtcccgtagggaaccggggtaccgaacgggaccgaccgggtacccgtttacgttaagtttaagttggttaggtggtaaggttaggtttagnggtacgtagttcgggttcgttgggtaaggactaaggacgtcgacggtcggggaaccgtaaccggggg

SEQ ID NO: 319998 - DNA, 619 bp, Homo sapiens
  misc_feature: GZ8MTXP01D3ZD2.19.67.G01.1.454.CMB.2.raw
  modified_base (387)..(387): a, c, t, g, unknown or other
  misc_feature (387)..(387): n is a, c, g, or t
  modified_base (564)..(564): a, c, t, g, unknown or other
  misc_feature (564)..(564): n is a, c, g, or t
  modified_base (573)..(573): a, c, t, g, unknown or other
  misc_feature (573)..(573): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcgggaggcttggtccagccgtgggcggtctctgagactgtccctgtgaaccctcgtggggtctccgtcagcagcgactgtatgccgtgggtccgcaggctccgagggaaggaggccggaggtgggtcgcgtaggttattttagagggtgggacgactagttcgtaaacggganccgtccgaagtcgggacgggccgattccacctatctaccagtacgtacttttcacgaagtaacactactcgtaccttacttaaccaaaagttagaaaccgtacgacccgtaggacggggaccgaacgggaccgacggtccgttacttagttagttggtgttggtagttagtttaagngggttacgngttgggaacgtgggtaaggacgaggacgtcgaacggtaaccggggg

SEQ ID NO: 319999 - DNA, 632 bp, Homo sapiens
  misc_feature: GZ8MTXP01AMB3I.19.67.G01.1.454.CMB.2.raw
  modified_base (323)..(323): a, c, t, g, unknown or other
  misc_feature (323)..(323): n is a, c, g, or t
  modified_base (457)..(457): a, c, t, g, unknown or other
  misc_feature (457)..(457): n is a, c, g, or t
  modified_base (483)..(483): a, c, t, g, unknown or other
  misc_feature (483)..(483): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtgggcggaggtcttgggtccagccgtggggcgtctcgtgagactgtcctgtcgaccctgtggggtctccgtcagcagcgactgtattcgccgtggtccgcaggctcgagggagnggccggagtgggtcgacgtaggttattttagaggtcggaccgactattcgacggagaacctcgaagtgggacgggccgtacttccgaactactcctaccgaagtacgtacttttcacgaagaaaccactacgtntaccttacttaacaaactgaaaccgngtaccgtggacgggacccgtaggaccgacgggtccttacgtatttacgttggtgtaaggtagttaggtttagcgggtagtagttgggcgttaggggtaacgacgtaaggacgttacgaccgggtcgggggttaacccgtaaacccgggg

SEQ ID NO: 320000 - DNA, 629 bp, Homo sapiens
  misc_feature: GZ8MTXP01A9SNE.19.67.G01.1.454.CMB.2.raw
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagccgtgggcgtctctgagactgtcctgtgaaccctcgtggggtctccgcagcagcgactgtattgcctgggtccgccaggctccgaggggagagggccggaggtggggtcgctaggttatttttagacgggtggggacgactagttcgtaaacgggagaacctccgagtgggacgggccgtattcaccatctccagtacgtacttttcacaacgaactacaactgttcctacttaccaaagttcgaaactacggcccttagggacggggcccggaagggtaccgaacgggtcccggttacttaagttagttgggtagttggtaaggttagttttaaggtcgggcggttagttcgggtcgtgggtcggacctaggacttccggaacgggtaacccgggggg

SEQ ID NO: 320001 - DNA, 621 bp, Homo sapiens
  misc_feature: GZ8MTXP01BB2M5.19.67.G01.1.454.CMB.2.raw
  modified_base (562)..(562): a, c, t, g, unknown or other
  misc_feature (562)..(562): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttcctgctgcaatttcaggaggtgtccagtgtgaggtgcaacgtgggtggagacgtgggcggaggcttgggtccagccgtggggcggtctcgtgagactgtcctgtcgaaccctgtggggtctccgcagcagcgactgtattcgccgtgggtccgccaggcctaccgaagggggaagacgggccgggtaggtcgggggtcgacgtaggttatttttaggacgggtggacgtactagttccgaacgggaagctccgaagtggggacggccgtattcgaccatcctcgagtacgtacttttcacgaacgaacactacgtgttctacttacaaacgtgaaactgacgtggacgggccgaaggaccacggtccgtcttaagttgttggtggttggtaagttagtttagngggttcggttagttcggtaaggtgggtggacgtagacgtaacggttcggtaaccggggg

SEQ ID NO: 320002 - DNA, 619 bp, Homo sapiens
  misc_feature: GZ8MTXP01BC7WY.19.67.G01.1.454.CMB.2.raw
  modified_base (556)..(556): a, c, t, g, unknown or other
  misc_feature (556)..(556): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgcaacgtggtggagacgtgggcggaggcttggtccaggccgtggggcggttctcgtgagactgtcctgtcgaccctcgtggggtctccgtcagcagcgactgtattgccgtgggtcccgccgacggctccgaggggaaggaggccggaggtgggcgcgtaggttattttagaggtgggacgacagttcgtacggagaacctccgaagtgggagggccgactttacgaccctatcctccagtactacgtttctacaagaaaccactactcgtccttcttacgaaatagaaccgagccgtaggacggggaccgacgggaccgaccggtccgtacttattacgttgtggtgtaagttgtttaacgnggtacggtagttgggttcttggggtggagaagtcgtcgacgggtcgggaaccggtaaccgggg

SEQ ID NO: 320003 - DNA, 548 bp, Homo sapiens
  misc_feature: GZ8MTXP01C8NP2.19.67.G01.1.454.CMB.2.raw
  modified_base (361)..(361): a, c, t, g, unknown or other
  misc_feature (361)..(361): n is a, c, g, or t
  modified_base (370)..(370): a, c, t, g, unknown or other
  misc_feature (370)..(370): n is a, c, g, or t
  modified_base (379)..(379): a, c, t, g, unknown or other
  misc_feature (379)..(379): n is a, c, g, or t
  modified_base (393)..(393): a, c, t, g, unknown or other
  misc_feature (393)..(393): n is a, c, g, or t
  modified_base (417)..(417): a, c, t, g, unknown or other
  misc_feature (417)..(417): n is a, c, g, or t
  modified_base (445)..(445): a, c, t, g, unknown or other
  misc_feature (445)..(445): n is a, c, g, or t
  modified_base (457)..(457): a, c, t, g, unknown or other
  misc_feature (457)..(457): n is a, c, g, or t
  modified_base (478)..(478): a, c, t, g, unknown or other
  misc_feature (478)..(478): n is a, c, g, or t
  modified_base (517)..(517): a, c, t, g, unknown or other
  misc_feature (517)..(517): n is a, c, g, or t
tcagtactctcgtgcacgaccggtgctcgatttagagtatacatattgggtttggggggtagctcaggaagcagagcctggagcatctccactatggcctgggctccactacttctcaccctcctcgctcactgcacaggttcttgggccaactttatgctgactcagccccactctgtgtcggagtctccggggaagacggtaaccatcttttgcacccacaacagtggcaacattgccagctaattttgtgcagtggtaccagcagcgcccgggcagttcccccacatgtgatctatgaggataatacaaagccgtcgttacgggggtccctgacttcggttctcgtcggctcatcganaacgctccncaactctcnccctcctcacatcnctggactgaaacgactggagacgnggctgaactacctatgtctagtctttangaactggcccgngtctagtggtgtcgttcgggngggacggaccaaggccttacggcccgttacgtcgggacncggacccgagggcctccggcccccgttccgg

SEQ ID NO: 320004 - DNA, 720 bp, Homo sapiens
  misc_feature: GZ8MTXP01CGAAR.19.67.G01.1.454.CMB.2.raw
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtgggcggaggtcttgggtccaggcccgtggggcggtctcgtgagtactgtcctgtcgaccctcgtcgggtctccgcagcagcgactgtacttgccgtcggtccgccgacggctacccggaaggggaacggacgggcccgggaggtcgggggtcgcgtaaggttatttttaggtagggtggggacgtacgtactttcgaaacgggaacgtccgtccgaaagttcggggacgggcccgtaacttccacccgtactcctaccgagtacggtaccttttactacgtaacgaacctaaccgtacgttcgtacttaccttaacgtaaaacgtacgtaaaaccgtacggacccgtagggaaccggggacccggaacgggaacccgaccggggtacccggttacctttaacgtttaagtttggttaggttggtaaggttagttttaaggtcggttacggttacgttggggtcgtaggggtcgaacgtacgttacgtccggaacggttaaccggggg

SEQ ID NO: 320005 - DNA, 639 bp, Homo sapiens
  misc_feature: GZ8MTXP01CKRX9.19.67.G01.1.454.CMB.2.raw
  modified_base (574)..(574): a, c, t, g, unknown or other
  misc_feature (574)..(574): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgcaacgtggtggagacgtgggcggaggcttggtccagccgtggggcggtctcgtgagctgtcctgtcgaccctcgtgggtctcgtcagcagcgactgtatcgccgtcgggtccgccgaggccgtaccggaggggaacggacgggccgggaggtcgggtcgcgtaggtttagttttagagggtgggaccgtactacgttcgtacggacgtaactccgaagtgggacgggccgtattccacctactctacctagacgtactttcacgtaacgaactacgtacttcgtactacttaacaaagtcgaaacgcgtaccgtgggacgggaccggaacggaccgacggtcccgttacttagttagttgtggtgtaaggttgtttaagngggtacgagttcgggcgttggggaaggtacgaagtagtccggacggtcgggggccgtaaccgggg

SEQ ID NO: 320006 - DNA, 687 bp, Homo sapiens
  misc_feature: GZ8MTXP01COAGB.19.67.G01.1.454.CMB.2.raw
  modified_base (458)..(458): a, c, t, g, unknown or other
  misc_feature (458)..(458): n is a, c, g, or t
  modified_base (605)..(605): a, c, t, g, unknown or other
  misc_feature (605)..(605): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtgggcggaggcttggtccaggccgtggggcggtctcgtgagactgtcctggtcgacccgtcgtggggtctccgtcagcagcgactgtattgccgtgggtccgccgaggctccgaggggaagacgggccggaggtgggtcgcgtaggttattttaagaggtgggaccgacagttcgacgggacgaacctccgaagttggggacgggcccgtagttccaccgtaatccgtcccaggtagtaccgttttacnccgtaaagaaacctaccgtacttacgtcccttacttacctaaaagtacgaaacgtacggtccgtaggaacgggggacccgaacgggaccgtaccggggtacccttacgttagtttaagttggttggtaagtaaggttaggttttagnggtaccggtagttggggttcgttggggtaacggaacgtaaggaacgttcggaccggtttcgggggaacccgtaacccggggg

SEQ ID NO: 320007 - DNA, 622 bp, Homo sapiens
  misc_feature: GZ8MTXP01EGSX5.19.67.G01.1.454.CMB.2.raw
  modified_base (577)..(577): a, c, t, g, unknown or other
  misc_feature (577)..(577): n is a, c, g, or t
tcagtactctcgtgcacgaccggtgctcgatttagagtatacatattggggtttggggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtgggcggaggcttggtccagcctggggcggtctctgagactgtcctgtcgaaccctcgtggggtctccgtcagcagcgactgtattgccgtgggtccgccaggctccgaggggaagagggccgggaggtcgggtcgcgtaggttatttttagaggggtgggaccgactagttcgtacgggagaaccttcccaagtgggacggggcccgtattccaccattccctccagtacgtacttttcacaagtaaccactcttcgtctacttacaaaattcgaaacgacgcccgtaggacggggccgaaggaccgacggtccgtacttatttacgttgtgtaagaggttagtttagttcggacgtattcgggngttgggtgggacaaggtctcggacgtcgggggccgtaaaccgggg

SEQ ID NO: 320008 - DNA, 628 bp, Homo sapiens
  misc_feature: GZ8MTXP01CKO02.19.67.G01.1.454.CMB.2.raw
  modified_base (474)..(474): a, c, t, g, unknown or other
  misc_feature (474)..(474): n is a, c, g, or t
  modified_base (510)..(510): a, c, t, g, unknown or other
  misc_feature (510)..(510): n is a, c, g, or t
  modified_base (577)..(577): a, c, t, g, unknown or other
  misc_feature (577)..(577): n is a, c, g, or t
  modified_base (580)..(580): a, c, t, g, unknown or other
  misc_feature (580)..(580): n is a, c, g, or t
  modified_base (600)..(600): a, c, t, g, unknown or other
  misc_feature (600)..(600): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgcaacgtggtggagacgtgggcggaggcttggtccagccgtggggccggtctctgagactcgtcctggtaccgaacccctcgtggggtcctccgtcagcagcgactgtattcgccgtgggtcccgccgaggcctccgaggggaaggaggccgggaggtgggtcgcgtaggttatttttagagggttcgggaccgtatacgttcgtaacggagtaaaccttcccgaaggtgggaacggggcctagttcccaacctatcctaccagtacgtacttttcacganaaaccgactactcgtcctacttacaaattgaaacgngccgtaggacggggccgaggacgaccggtccgtacttagttattgtggtaaggtagttagtttacgnggngtagttgggcttgggtgacngacgtgacggtcggggccgtaaccgggg

SEQ ID NO: 320009 - DNA, 675 bp, Homo sapiens
  misc_feature: GZ8MTXP01EF1AJ.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtgggcggaggcgttggtccagcccgtggggcggtctctgagactgtcctgtcgacccgtcgtgggtctccgtcagcagcgactgtattcgccgtgggtcccgccgaggcctaccggaggggaaggacgggccgggaggtcgggtcgcgtaggtttagttttagaggggtggaccgactagttcgtaacggacgaacctccgaagtgggacgggtacccgtattccacctattccctaccgaagtacgttacttttacgacaagtaaacctactaacttcgtacttacctaactaaattacgaaacgacgtccgtacgggacgggaccgaaggaccgtaccggtaccgttacttaagtttagttggttggtaaggtaggttagtttaggttcggacggtagttcgggttcgttaggggtcgaacgaaggtaacgtccggacgggtcgggaacccggtaaaccggggg

SEQ ID NO: 320010 - DNA, 702 bp, Homo sapiens
  misc_feature: GZ8MTXP01BK2QO.19.67.G01.1.454.CMB.2.raw
  modified_base (311)..(311): a, c, t, g, unknown or other
  misc_feature (311)..(311): n is a, c, g, or t
  modified_base (352)..(352): a, c, t, g, unknown or other
  misc_feature (352)..(352): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagactgggcgggaggcttgggtccagccgtggggcgtctctgagactgtcctgtcgaccctcgtcggggtctccgtcagcagcgactgtattcgccgtcgggtcccncgacggctccgaaggggaacggacggccgggagtggggtcncgtaggtttattttagagggtgggaccgatagttcgtacgggagaacctccgaagttcggggacgggtcccgtaattcaccgtatccaccagtactactttttcacgaagaaaccactacttcgttacctactttaacaaacggttacgaactacggtcccgtagggaccgggggacccgaagggaacccgtaccgggtacccgttacttaaagtttagtttcggtagggttaaggaaacggtttaggttttaaacggttggggtaccggttaagggttcgggttcggttaggggtaagggaactaagggtacctacgggaacggggtccgggggaacccggtaacgggg

SEQ ID NO: 320011 - DNA, 664 bp, Homo sapiens
  misc_feature: GZ8MTXP01EIVAW.19.67.G01.1.454.CMB.2.raw
  modified_base (220)..(220): a, c, t, g, unknown or other
  misc_feature (220)..(220): n is a, c, g, or t
  modified_base (249)..(249): a, c, t, g, unknown or other
  misc_feature (249)..(249): n is a, c, g, or t
tcagtactctcgtgcacgaccggtgctcgatttagagtatacatattgggtttgggggtagctcaggaagcagagcctggagcatctccactatggcctgggctccactacttctcaccctcctcgctcactgcacaggttcttgggccaactttatgctgactcagccccactctgtgtcggagtcgtccggggaagacggtaaccatctttgcaccanaacagtgcaacattgccagctaagttttngtgacagtcgacagcgacgccggcccggactaccgtccccactagttcgtatactacgtagtaggaagtaaataactacgaaacggtcccgttcggtacgggtcctagtacgttcgttctccgtcgctacgacgtccgaacacgtcctaccctacctaaccttccgtcccgtccccttaccctacctacctacgttccgtacgtacggtactaaggaaacgtacgtagggaacggacggacgtactacgtaccttacgttacgtacgttactaacgttacttagtacgtaacgtaccggcgttcgtacgtaggttcgggtaacggtccggttacggggacgggaacggacgtacgttcgttccggttacccgtcgtacggtaaccgaccgacccgacggtcccgttcccgtcccg

SEQ ID NO: 320012 - DNA, 608 bp, Homo sapiens
  misc_feature: GZ8MTXP01D9UQ5.19.67.G01.1.454.CMB.2.raw
  modified_base (278)..(278): a, c, t, g, unknown or other
  misc_feature (278)..(278): n is a, c, g, or t
  modified_base (308)..(308): a, c, t, g, unknown or other
  misc_feature (308)..(308): n is a, c, g, or t
  modified_base (574)..(574): a, c, t, g, unknown or other
  misc_feature (574)..(574): n is a, c, g, or t
  modified_base (584)..(584): a, c, t, g, unknown or other
  misc_feature (584)..(584): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagtttggctgacctgggttttcctgctgcaatttcaggaggtgtccagtgtgaggtgcaacgtgggtggagactgggcggaggctttggccaggccgtgggcgtctctggagactgtcctgtcgaccctgtggggtctcgnagcagcgtactgtattcgccgtgggtcccncaggctaccgaagggggacgcgggccgggagtcggggtcacgtaggttatttttagacgggtggaacacgtagttcgtaaacgggatccgtcgagtgggaacgggcctaattccgactatctaccagtacgttactttctacagaacacgtactcgttacttactactaaagttacgaactacgccgtaggacgggccgaacggaccgcggtaccgttactagtttcgttggtgttggtagttagtttaagtggacgttgttcggngttgggaagnaggttactcggaacggtccggggg

SEQ ID NO: 320013 - DNA, 632 bp, Homo sapiens
  misc_feature: GZ8MTXP01CYRMA.19.67.G01.1.454.CMB.2.raw
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgaccttgggttttccttgctgcaatttcaggaggtgtccagtgtgaggtgcaacgtggtggagacgtgggcggaggcttggtccagccgtggggcggtctcgtgagactgtcctgtcgaccctgtgggtctcgcagcagcgactgtatgcccgtcgggtcccgccgaggcctaccggagggggaaggacgggccgggtaggtcgggggtcgcgtaaggtttagtttttagtagggtgggacgtacgtagttccgtaacgggagtaacgtccgaagtcggggacgggccgtattcacctactcctaccagtacgtacttttacacaagaaccactaccttgttaccttacttactaaagtacgaacgacgccgtaggacgggaccgaggacgccggtccgttcttattgttgtggttaggtagttagttacgtggttacggttgttcgggtgtagggtcgacgagttacgtcgaacgggtccgggg

SEQ ID NO: 320014 - DNA, 646 bp, Homo sapiens
  misc_feature: GZ8MTXP01EDS5U.19.67.G01.1.454.CMB.2.raw
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttcctgctgcaatttcaggaggtgtccagtgtgaggtgcaacgtgggtggagactgggcgggaggctttgggtccaggcccgttgggggccggttctcgtggagactgtccctgtcgaaccctcgtggggtctccgtcagcagcgactgtattgcctgggtccgcaggctccgagggagaggccggaggtgggtcgcgtaggttattttagtacggtgggacgacgtattacgtaacgggagtctccgagttggggacgggtcccgatttccgaacctattcctaccgtagacgttaccttttctacaacgtaaacacacttcgttaccttacttacaaagttcgaaactacgacccgtaggacggggcccggaagggacccgaccgggtcccgtacttagtttgttggtggttaggtaggttaggtttaacgtgggttgttaggttcgggtcgtggggtggacgaggttcgtcgcgggtaaccggggg

SEQ ID NO: 320015 - DNA, 661 bp, Homo sapiens
  misc_feature: GZ8MTXP01DTYVC.19.67.G01.1.454.CMB.2.raw
  modified_base (340)..(340): a, c, t, g, unknown or other
  misc_feature (340)..(340): n is a, c, g, or t
  modified_base (386)..(386): a, c, t, g, unknown or other
  misc_feature (386)..(386): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagtttggctgacctgggttttccttgctgcaatttcaggaggtgtccagtgtgaggtgcaacgtggtggagacgtgggcggaggcttggtccagccgtggggcggtctctggagtactgtcctgtgaaccctgtggggtctccgcagcagcgactgtatcgcctgggtccgcaggctccgagggagaggccggagtcgggtcncgtaggttatttttagagggtggggactacatttcgtaaacgggancgtcccaagtcgggaacggggtcccaattccaacccatcttaccaggtactacttttcgtacaagtaaaccactaacttctactacttacaaaattcggaaaccaggtacccgtagggaaccggggacccgaagggaaccctacgggtaccccgttacttaagtttaagttggttggttcggtaaagttaaggttttaaagggtcgggttacggttggttcgggtggttacgggtaacggtaacgtaggttacgttccggaacgggtaaccgggg

SEQ ID NO: 320016 - DNA, 533 bp, Homo sapiens
  misc_feature: GZ8MTXP01AYB1Z.19.67.G01.1.454.CMB.2.raw
  modified_base (295)..(295): a, c, t, g, unknown or other
  misc_feature (295)..(295): n is a, c, g, or t
  modified_base (451)..(451): a, c, t, g, unknown or other
  misc_feature (451)..(451): n is a, c, g, or t
  modified_base (462)..(462): a, c, t, g, unknown or other
  misc_feature (462)..(462): n is a, c, g, or t
  modified_base (511)..(511): a, c, t, g, unknown or other
  misc_feature (511)..(511): n is a, c, g, or t
tcagtactctcgtgcacgaccggtgctcgatttagagtatacatattgggtttggggggtagctcaggaagcagagcctggagcatctccactatggcctgggctccactacttctcaccctcctcgctcactgcacaggttcttgggccaactttatgctgactcagccccactctgtgtcggagtcgtccggggaagacggtaaccatcttttgcacccacaacagtgacaacattgccagctaattttgtgcagtggtaccagcagcgcccgggcacgttcccccacattgngatctatgaggataatacaaagaccgtcgtgggggtcccctgacttcggttctctcggctccatcgacaacgcctcctccaactctcgccctccctcaccatctctggactagaacgactggaggacgaggctgactactagtcgtctatctttangagcgcgcgtntgtcggtgtcgtcgggcggacggacgtagcgttcgccgttcgtaaggcncgccgacgccgtccgcccgtcg

SEQ ID NO: 320017 - DNA, 561 bp, Homo sapiens
  misc_feature: GZ8MTXP01C8031.19.67.G01.1.454.CMB.2.raw
  modified_base (425)..(425): a, c, t, g, unknown or other
  misc_feature (425)..(425): n is a, c, g, or t
  modified_base (511)..(511): a, c, t, g, unknown or other
  misc_feature (511)..(511): n is a, c, g, or t
  modified_base (535)..(535): a, c, t, g, unknown or other
  misc_feature (535)..(535): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtcgaaccctctggggtctccgtcagcagcgactgtattgcctgggtccgccaggctccgagggggaagaggccggagtgggtcgctaggtatttttagaggtgggaccgacattctacggagaacctccaagtgggagggccgattcgacctagtctccagtagtacttttcnctaagaacacactgtctcttacaaatgaaacacgcctaggacgggccgaggacacggccgtcttattattgtgtgagttagtttangggtcgattgggcttgggtggacngatcgacgttcggggccgtaacgggg

SEQ ID NO: 320018 - DNA, 643 bp, Homo sapiens
  misc_feature: GZ8MTXP01EF5N2.19.67.G01.1.454.CMB.2.raw
  modified_base (394)..(394): a, c, t, g, unknown or other
  misc_feature (394)..(394): n is a, c, g, or t
  modified_base (605)..(605): a, c, t, g, unknown or other
  misc_feature (605)..(605): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactgggtggagacgtgggcggaggcttggtccaggcccgtggggcggtctcgtgagactgtcctgtcgaaccctcgtggggtctccgtcagcagcgactgtatgccgtgggtccgccaggctccgagggaacgaggccggaggtcgggtcgcgtaggttattttagagggtgggaccgatattcgacggagaactccgngtgggagggccgtattccgaccgatcctaccagtacgtacttttcactaagaacactactcgttactcttaacaaaattcgaaacgtacgccgtaggacgggggacccgaacgggaccgaccgggtccgttacttaagtttatttggtgtaaggtaggttaaggtttaagttcggggtcgtaagttggggttccgttggggtcgggtaacnggtaacgtcgacgggttcgggggaacccgtaaccgggg

SEQ ID NO: 320019 - DNA, 863 bp, Homo sapiens
  misc_feature: GZ8MTXP01B6JOZ.19.67.G01.1.454.CMB.2.raw
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgaccttgggttttccttgctgcaatttcaggaggtgtccagtgtgaggtgcaacgtggtggagacgtgggcggaggcttggccaggccgtggggcgtctctgagactgtcctgtcgaccctcgtgggtctccgcagcagcgactgtagttcgccgtgggtcccgccgaggccgtaccgaaggggaaggacgggcccgggaggtcggggtcgacgtaggtttaagttttttaggtacggggttacggggaacgtaacgtaagtttaccgtaaaccggggtaacgtaaccgttacccgtaaggttacgggggaacgggggtaccccgtaacgtttacccaaaccccggtacttacccgtacccgtaaacgggttaaccggttaacccttttttacctaaacccgtaacgggtaaaaccctaaccgttaaccgttacgttaacccttaccgtttaacccgtaaaaatttacggaaaaccggtaacggtacccggttaaccggggaaccgggggtacccggggaaaccgggtaaacccggtaaccggggtaccccggtttaacgtttaacgttttaaggtttaacgggttagggttcgggttaaagggttaaacggttttttacgggtagggggttaccggttaggttagggggtccggttagggggttaaggggaaccgtagggttaacgtaacccggttaacggggtaacccgggggg

SEQ ID NO: 320020 - DNA, 679 bp, Homo sapiens
  misc_feature: GZ8MTXP01ETW0F.19.67.G01.1.454.CMB.2.raw
  modified_base (627)..(627): a, c, t, g, unknown or other
  misc_feature (627)..(627): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagtttggctgacctgggttttccttgctgcaatttcaggaggtgtccagtgtgaggtgcaactggtggagactgggcggaggcttggtccagccgtgggcggtctctgagactgtcctgtcgaccctcgtggggtcctccgcagcagcgactgtattcgccgtgggtcccgcgaggcctccggaaggggaaggacgggcccgggaggttcgggggtcgtacgtaaggtttatttttaggtaggggttcggggactacgtacgttacgtaaacgggacgtaaccgttccgaaaggtcggggacggggtacccgtaattccgaacccacttaccgtacccgtaaggtacgttaccttttactaaccgaacgtaaacctacctaacgttcgttaccttacttaaccaaaagttcgaaactacgtcccgtaggacgggaccgaggaccgacggtccgttactaagtttagttggtggttagtagttagtttagnggaggttgttcggtgtgggtggacgagttactaacgttcgggtaaccggggg

SEQ ID NO: 320021 - DNA, 607 bp, Homo sapiens
  misc_feature: GZ8MTXP01EEI6G.19.67.G01.1.454.CMB.2.raw
  modified_base (563)..(563): a, c, t, g, unknown or other
  misc_feature (563)..(563): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtgggcggaggcttggtccagcctggggcggtctctgagactgtcctgtcgaaccctcgtggggtctccgtcagcagcgactgtattgccgtgggtccgccgaggctccgaggggaagaggccgggaggtgggtcgcgtaggttatttttagagggtgggaccgactattcgacggagaacctccaagtgggacgggccgtattccaccgatcctaccagtacgtacttttcacaagaaaccactactgtctcttacaaatcgaaacgtgccgttggacggggccgaggaccgacggtccgttctattagttgtgtaagtagttagtttgttgggcgtagttggggcttaggggnggtacgaaggtactcggacggttcgggggcccgtaaaccggggg

SEQ ID NO: 320022 - DNA, 570 bp, Homo sapiens
  misc_feature: GZ8MTXP01BP6LI.19.67.G01.1.454.CMB.2.raw
  modified_base (493)..(493): a, c, t, g, unknown or other
  misc_feature (493)..(493): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtggcggaggcttggtccagccgtgggcggtctctgagactgtcctgtcgaccctgtggggtctccgtcagcagcgactgtattgccgtgggtccgccaggctccgaggggaagaggccggaggtgggtcgcgtaggttattttagagggtgggaccgactattcgtacggagaactccaagtgggaggggccgacgttcaccgatctccagagtactttcgacaacgaacacactgtctacttacaaatcgaaacgagccgtagacgggcgaggacacggccgtntattagttgtgtgagttgtttagggtcgagttggcgttgggtgacgaagagtcgacggtcggggccgtaaccggggg

SEQ ID NO: 320023 - DNA, 622 bp, Homo sapiens
  misc_feature: GZ8MTXP01ETL3X.19.67.G01.1.454.CMB.2.raw
  modified_base (457)..(457): a, c, t, g, unknown or other
  misc_feature (457)..(457): n is a, c, g, or t
  modified_base (533)..(533): a, c, t, g, unknown or other
  misc_feature (533)..(533): n is a, c, g, or t
  modified_base (562)..(562): a, c, t, g, unknown or other
  misc_feature (562)..(562): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagactgggcggaggcttggtccagccgtgggcgtctctgagactgtcctgtcgaccctcgtcggggtctccgtcagcagcgactgtattgccgtgggtcccgccgaggcctccgaggggaagacgggccgggaggtcggggtcgcgtaggtttatttttagtagggtcgggaccgactagttcgtacggacgaacctccgaagtcgggacgggcctattccacctattcctacccgagtacgttaccttttcncaacgaaccactactcgttctacttacaaatgaaacgagccgtagggacgggaccggaaggaccgaccggtccgtnttagttagttggtgtgtagttagtttagnggtacgtagttgggcgttgggtgacgaagtacgtcgacggtcggggaaccgtaaccgggg

SEQ ID NO: 320024 - DNA, 631 bp, Homo sapiens
  misc_feature: GZ8MTXP01D53II.19.67.G01.1.454.CMB.2.raw
  modified_base (235)..(235): a, c, t, g, unknown or other
  misc_feature (235)..(235): n is a, c, g, or t
  modified_base (240)..(240): a, c, t, g, unknown or other
  misc_feature (240)..(240): n is a, c, g, or t
  modified_base (283)..(283): a, c, t, g, unknown or other
  misc_feature (283)..(283): n is a, c, g, or t
  modified_base (624)..(624): a, c, t, g, unknown or other
  misc_feature (624)..(624): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctcgtgggcgagaccggccacaatcaactgcaggtccagccagaactntttcnccacctacaaagaactaaaacttctagcctaggtacaacaganaccaggacacgacctactaagtcgccttactaatttacgtgggtcctttacgtaacggcgtacggtaacgtttccgggggcccctaggacccccgtacgttccgggggcaggtccgggtactggggaacaggtacttttccgaccttcctccgaacctatccaagccacgccctaggactaaggggcttaggaaagtgtaggttagggacttaaggttttacttaactggtacctaggtaccttaaatttctttttactacttccgtcgttggtaccgtacggaacgtaaacgggcgtaagggttagaaatcgaagcgttactgacggtcagcttaccgtnttccgtg

SEQ ID NO: 320025 - DNA, 607 bp, Homo sapiens
  misc_feature: GZ8MTXP01ELNR8.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctggggcgtctctgagactgtcctgtcgaaccctcgtggggtctccgtcagcagcgactgtattgcctgggtccgccaggctccgaggggaagagggccgggaggtcgggtcgcgtaggttatttttagagggttgggaccgactattcgacggagaacctccaagtgggaggggcccgagtttccacctatcctacccgagtacgtacttttctacaagaaacctactaactcgtccttacttacaaaattgaacgagcccgtaggacgggcccgaaggaccaacgggtccgttactatttagttggtgtgtagttagtttagttgggcgtagttgggcgttagggtggacaagatcgacgtcggggccgtaacgggg

SEQ ID NO: 320026 - DNA, 643 bp, Homo sapiens
  misc_feature: GZ8MTXP01BHGXE.19.67.G01.1.454.CMB.2.raw
  modified_base (473)..(473): a, c, t, g, unknown or other
  misc_feature (473)..(473): n is a, c, g, or t
  modified_base (482)..(482): a, c, t, g, unknown or other
  misc_feature (482)..(482): n is a, c, g, or t
  modified_base (549)..(549): a, c, t, g, unknown or other
  misc_feature (549)..(549): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgcaacgtggtggagacgtgggcggaggtcttggtccaggccgtggggccggtctctgagtactgtctgtcgaaccctcgtggggtctccgtcagcagcgacgtgtagttcgccgtcgggtcccgccgaggctcccgaggggaacggagggccgggtaggtgggtcgcgtaggtttatttttagagggtgggaccatagttcgacggagaaccttccgaagtcggggacgggcccgtacgtttacacctacttcctacccgtagtaacggtactttttacncaagaaacncgtaactgtacttacgttacaaatcgaacgacgccgtaggacgggccgaggacaccgggtaccgttnttattacgttggtgtaagtagttagtttagttggcgtagttgggttgttaggaacaggtaatcgaggttcggggtaaccgaacgggtaaccccg

SEQ ID NO: 320027 - DNA, 624 bp, Homo sapiens
  misc_feature: GZ8MTXP01A8ADV.19.67.G01.1.454.CMB.2.raw
  modified_base (559)..(559): a, c, t, g, unknown or other
  misc_feature (559)..(559): n is a, c, g, or t
  modified_base (588)..(588): a, c, t, g, unknown or other
  misc_feature (588)..(588): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtgggcggaggcttggtccaggcccgtggggcggtctctgagactgtcctgtcgaaccctcgtggggtctccgtcagcagcgactgtatgccgtggtccgcgaggctccgagggagaggccggaggtgggcgcgtaggttattttagagggtgggaccgtatagttcgacggagaacctccgaaggtgggacgggccgattccacatcctaccagacgttactttctacaagaaaccactaacttcgtaccttacttaacaaattacgaaacacggtaccgtacgggacgggaccggaacggaccgacggtaccgttcgttaagttagttggtgtggtaagttagtttagngggagtaggttggcgttggggtaagacgngtacgtacgacgggtcggggaaccgtaacccggggg

SEQ ID NO: 320028 - DNA, 644 bp, Homo sapiens
  misc_feature: GZ8MTXP01ED6P3.19.67.G01.1.454.CMB.2.raw
  modified_base (579)..(579): a, c, t, g, unknown or other
  misc_feature (579)..(579): n is a, c, g, or t
  modified_base (602)..(602): a, c, t, g, unknown or other
  misc_feature (602)..(602): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgcaacgtgggtggagacgtgggcggagggcttgggtcccaggcccgtggggcggttctcgtgagactgtcctggtcgaaccctcgtggggtctccgtcagcagcgactgtattcgccgtgggtccgccaggctccgaggggaagacgggccgggaggtgggtcgctaggtttattttagagggtggggacacgtattcgacggagtaacctccaagtgggaacggggcccgtatttccgaccagttcctacccgaagtacgtacttttcacagaaaccactactgtctacttacaaattcgaaacgacgtccgtacgggacggggaccggaggaccgaccgggtaccgttcttaattagttgtggtaaggtagttaggtttaaagngggtacggaattgggcgttgggnggtacaaggactacggacggtcgggggccgtaaacccggggg

SEQ ID NO: 320029 - DNA, 602 bp, Homo sapiens
  misc_feature: GZ8MTXP01CNMTR.19.67.G01.1.454.CMB.2.raw
  modified_base (221)..(221): a, c, t, g, unknown or other
  misc_feature (221)..(221): n is a, c, g, or t
  modified_base (250)..(250): a, c, t, g, unknown or other
  misc_feature (250)..(250): n is a, c, g, or t
  modified_base (290)..(290): a, c, t, g, unknown or other
  misc_feature (290)..(290): n is a, c, g, or t
  modified_base (367)..(367): a, c, t, g, unknown or other
  misc_feature (367)..(367): n is a, c, g, or t
  modified_base (374)..(374): a, c, t, g, unknown or other
  misc_feature (374)..(374): n is a, c, g, or t
  modified_base (377)..(377): a, c, t, g, unknown or other
  misc_feature (377)..(377): n is a, c, g, or t
  modified_base (389)..(389): a, c, t, g, unknown or other
  misc_feature (389)..(389): n is a, c, g, or t
  modified_base (546)..(546): a, c, t, g, unknown or other
  misc_feature (546)..(546): n is a, c, g, or t
tcagtactctcgtgcacgaccggtgctcgatttagagtatacatattgggtttggggggtagctcaggaagcagagcctggagcatctccactatggcctgggctccactacttctcaccctcctcgctcactgcacaggttcttgggccaactttatgctgactcagccccactctgtgtcggagtctccggggaagacggtaaccatctttgcacccanaacagtggcaacattgccagctaatttgngcagtggtaccagcagccgccggcacgtcccccacattgngatctatgaggataatacaaacgccgtacgtcgggggtcctggacttcggttctcgtcggctcatcgacaagcctcnccaatcnccncctccctcactntccgtctggactagaacgactaggaacggacgaggctacggacttaactactcggttaccagttacttatgaacgttacggcccgcgggttaaccaggtttcggttcgggttccgttcggggacgggtaacgggaccaaacggtcgttacggttccnccggtttaaaggccgccggtacccgaacgggttccttcccgttcccccggttccgg

SEQ ID NO: 320030 - DNA, 847 bp, Homo sapiens
  misc_feature: GZ8MTXP01EFQC5.19.67.G01.1.454.CMB.2.raw
tcagtactctcgtgcacgaccggtgctcgatttagagtatacatattgggtttgggagggagaggagcccagcactgggattccgaggtgtttccattcggtgctcagcactgaacacagaggactcaccatggagttttggctgacctgggttttccttgctgcaatttcaggaggtgtccagtgtggaggtgcaacgtggtggagacgtggcggaggcttggtccagccgtgggcggtctctgagctgtcctgtcgacctgtgggtctccgtcagcagcgactgtatcgccgtcgggtccgccgacggccgtaccgaaggggaacggacgggccgggagggttgggggtccggacgtaagggtttaagtttttaggacggggttacggggaacgtaactagtttaccgtaaccgggtaacgtaacctcccgtaagggtcggggaacggggtacccgtaacgttacccgaaacccgtaacttccctacccgtaagtacggttaacctttttaccgtaacgtaaacggtaaaccctacgtaacccgttacgttacccctttaacttaaacctaaaacgttaaaccgggaaaaccgtaccggtaaccggtacgggggaacccggggtaacccgggaaaccggggtaacccggtaacccggggttacccgtttaaccgtttaaggttttacgttttggggttaacgggttaagggtttaaagggtttaaagggtttttacggtaacggggttcggttaagggtttcggggttacggttgggggtaaaccgttaacggaaggggtaccttacccggggtaaccggggttaaccgggggtaaaccccgggg

SEQ ID NO: 320031 - DNA, 681 bp, Homo sapiens
  misc_feature: GZ8MTXP01CF1RU.19.67.G01.1.454.CMB.2.raw
  modified_base (210)..(210): a, c, t, g, unknown or other
  misc_feature (210)..(210): n is a, c, g, or t
  modified_base (244)..(244): a, c, t, g, unknown or other
  misc_feature (244)..(244): n is a, c, g, or t
  modified_base (310)..(310): a, c, t, g, unknown or other
  misc_feature (310)..(310): n is a, c, g, or t
  modified_base (313)..(313): a, c, t, g, unknown or other
  misc_feature (313)..(313): n is a, c, g, or t
  modified_base (320)..(320): a, c, t, g, unknown or other
  misc_feature (320)..(320): n is a, c, g, or t
  modified_base (442)..(442): a, c, t, g, unknown or other
  misc_feature (442)..(442): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctggcggggacatcgtgatcgacccagtacccagactcactggctgtgtctcgtgggcgagacggccaanaatcaactgcaggtccagccaagaactatttccnccacctacaaagaaacctaaaacttctagcctagtaaccaagagacgaccagacagcctactagtnctnatttacnggtcttacgacgcgtacgtaacgttcccggggtaccctcggtaacccccggtacgttccggggggactacggggtccggggttaaccgtaggggaacctagtactttccacgtcctacaacntcgagcacgcctgccgtaagggtctaggaaagtgttcggtaggtacctttaagttttactaacgtcggttccaaagttcctttaaagttttctttttccgttaaccgtcccgttacggttacggggtacccgtttccgggaaaccggtaaacgggggttaccggtaagggggttaagtaaaacgtgaaaccgggttagaacgttggacggtctacgacccttacgtaacttccgttaag

SEQ ID NO: 320032 - DNA, 804 bp, Homo sapiens
  misc_feature: GZ8MTXP01DF12M.19.67.G01.1.454.CMB.2.raw
  modified_base (239)..(239): a, c, t, g, unknown or other
  misc_feature (239)..(239): n is a, c, g, or t
  modified_base (309)..(309): a, c, t, g, unknown or other
  misc_feature (309)..(309): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctcgtgggcgagacggccacaatcaactgcaggtccagccagaactatttcnccacctacaagaactaaaacttctaagcctaggtaacaacagaacgaccaggacagcctacctaagttcnctctaatttacgtgggtcctttcgtaacggcgtaccggttaaacgtttcccgggggtccctacggtaaccccccggacggttttaccccgggggggctaacggggtccccgggggtttccttacggggggaaccctaaaggggttaacccttttttccccgaaacccgtttcccttacccggtaaaccccgtaaatttccccgaaaggccctaaacggccccgttaggacccgtaagggccgttaaggaaacggtagttagggttggtaaccgttaggtttttaacgttaacccgttggttacccaaggttaaccttaaagttttacgtttttttttacctaaccgttttccccgtttaccgggttacggggtaacccggttttcccgggaaacccgtaaagggggttaacccgtagggggttaggtaaaacgttcgaaacgggttaccgaaaccgttgggttacgggccttcggaccacccgttcgttccgtcg

SEQ ID NO: 320033 - DNA, 669 bp, Homo sapiens
  misc_feature: GZ8MTXP01BZM51.19.67.G01.1.454.CMB.2.raw
  modified_base (400)..(400): a, c, t, g, unknown or other
  misc_feature (400)..(400): n is a, c, g, or t
  modified_base (408)..(408): a, c, t, g, unknown or other
  misc_feature (408)..(408): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtggaggtgcaacgtgggtggagacgtgggcggaggtcttggtccaggcccgtggggccggtctcgtgagactgtcctgtcgtaaccctcgtggggtctccgtcagcagcgactgtattcgccgtgggtcccgccgaggcgtccgaggggagagggccgggagtgggtcgcgtaggttattttagtaggtgggaccgtactagttcgtacgganaacctcgngtcgggacgggacctaagttccactactcctacctagacgttactttcacgaacgaaaccactacctgttccttacttaacaaagttgaaacgacgccgtaggacggggaccggacggaccgaccggtccgttacgttaacgtttagttaggtggttaagtaaggttaggttttaagcggggtacgtaaggttcgggttcggttaggggtggaccgtaaggtacgttccggacgggttccgggggaacccgtaaccggggg

SEQ ID NO: 320034 - DNA, 598 bp, Homo sapiens
  misc_feature: GZ8MTXP01C3WAX.19.67.G01.1.454.CMB.2.raw
  modified_base (414)..(414): a, c, t, g, unknown or other
  misc_feature (414)..(414): n is a, c, g, or t
  modified_base (431)..(431): a, c, t, g, unknown or other
  misc_feature (431)..(431): n is a, c, g, or t
tcagtactctcgtgcacgaccggtgctcgatttagagtatacatattgggtttggggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttgggtccagcctgggcggtctctgagactgtcctgtcgaaccctctggggtctccgtcagcagcgactgtattgccgtgggtcccgccagggctccgagggaagaggccggagtgggtcgctaggttatttttagagggtgggaccgacagttctacggagaacttcgaagtgggagggcccaattccaaccanctaccagagacttttcncaagaacactactgtactacttacaaaattgaacaacgacgtacgagggaccggaacggaccgacggaccggtcctattattgtgtgtagttagtttaagttggtacgagttggttcgttcgggttaagggtacgaaggatacttacgtcggggccgtaacccgggg

SEQ ID NO: 320035 - DNA, 739 bp, Homo sapiens
  misc_feature: GZ8MTXP01DWOJB.19.67.G01.1.454.CMB.2.raw
  modified_base (528)..(528): a, c, t, g, unknown or other
  misc_feature (528)..(528): n is a, c, g, or t
tcagtactctcgtgcacgaccggtgctcgatttagagtatacatattggggtttgggggagctacaacaggcaggcaggggcagcaagatggtgttgcagacccaggtcttcatttctctgttgctctggatctctggttcctggcgggacatcgtgatcgacccagtacccagactcactggctgtgtctcgtgggcgagaccggacaacaatcaactgacacggtccagaccaagtaacttacttttaccacccaaccctaccaaaacgtaaacctaaaacttctacgacctacggaacccaagaagaaccgaaccgaaggtaccacgtcccctaaccgtaaagttgaccttactaacgtttacgtcgggtcctttacgtacggccgtacgtaacggtttcccggggtaccctacggaccccgtacggttccggggacgacgggtccgggtacgtaggggaactaggttacctttccgaactctaaccactatccgagcacgctcgagtacggtactaggtaaagngttcgtagttacgtttaagtttaacgtacgttagtacctaagtactttaaacgttttacttttccgttaccgtcccggtttacggtaccggtaccgggttaccgggaaaccggtaaacggggttaaccgggttaagggttaaacgtaaacgtacgaaacgggttaaccgttaggttcgtcggaacctacgtacccacgttgtttccgtccg

SEQ ID NO: 320036 - DNA, 690 bp, Homo sapiens
  misc_feature: GZ8MTXP01ED2IC.19.67.G01.1.454.CMB.2.raw
tcagtactctcgtgcacgaccggtgctcgatttagagtatacatattgggtttggggtctgggagaggagcccagcactgggattccgaggtgtttccattcggtgctcagcactgaacacagaggactcacatggagttttggctgaccttgggttttccttgctgcaatttcaggaggtgtccagtgtgaggtgcaacgtgggtggagacgtgggcggaggtcgtttggtccaggccgtggggccggtctcgtgagtactgtcctgtcgaaccctcgtggggtctccgtcagcagcgactgtattcgccgtgggtcccgccgaggctaccgaggggaaggacgggccgggaggtcgggtcgcgtaggttattttagtacgggtgggacacgatttcgtaaacgggagtccgtccgaagttcggggaacgggtccgtacttacgaaccctatcccgtaccgagtaacgttaccttttcgtacgtaacgaaacctacctaccgttacgttaccttacctttaaccgaaaacgtacggaaaccgtacgtacccggtagggaccgggacccgggaacgggaacccgtaccgggtaccccgttagttaagtttcgttaaggttggttaggtaggttagtttacgtgggacgttgttaggcgtagggtcgacgagttactcgaacggtccgggg

SEQ ID NO: 320037 - DNA, 714 bp, Homo sapiens
  misc_feature: GZ8MTXP01E2QBJ.19.67.G01.1.454.CMB.2.raw
  modified_base (636)..(636): a, c, t, g, unknown or other
  misc_feature (636)..(636): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcgaggaggtgtccagtgtgaggtgcaacgtggtggagacgtgggcggaggtcttggtccaggtccgtggggcggttctcgtgacgtactgtcctggtacgtaacccgttcgtcggggtctccgtcagcagcgtactgttacgtcgccgtgggtcccgccgaggcctccgagggaaggacggccgggaggtcgggtcgacgtaggttagttttagaggggtcgggaaccgtacgtagttaccgtaaggacgaaaccgtccaaggttgggacggggtacccgagtttccaacctacgtacccgtacgaagttacgtaacttttacctacaaggtaaaccactaacgttcgttaccttacttaactaaacgttacgaaacgtacggccgtagggaccgggaccggaacgggaccgaaccggtccgtacgttagtttaagttggtaggttaaggtaggttagtttaagngggtacgtaaggttcgggttcggttagggtcggaacgtaagtacgtacgacggttaacggggcccgtaaacccggggg

SEQ ID NO: 320038 - DNA, 565 bp, Homo sapiens
  misc_feature: GZ8MTXP01BSLL8.19.67.G01.1.454.CMB.2.raw
  modified_base (179)..(179): a, c, t, g, unknown or other
  misc_feature (179)..(179): n is a, c, g, or t
  modified_base (244)..(244): a, c, t, g, unknown or other
  misc_feature (244)..(244): n is a, c, g, or t
  modified_base (320)..(320): a, c, t, g, unknown or other
  misc_feature (320)..(320): n is a, c, g, or t
  modified_base (435)..(435): a, c, t, g, unknown or other
  misc_feature (435)..(435): n is a, c, g, or t
  modified_base (457)..(457): a, c, t, g, unknown or other
  misc_feature (457)..(457): n is a, c, g, or t
  modified_base (558)..(558): a, c, t, g, unknown or other
  misc_feature (558)..(558): n is a, c, g, or t
  modified_base (560)..(560): a, c, t, g, unknown or other
  misc_feature (560)..(560): n is a, c, g, or t
  modified_base (562)..(562): a, c, t, g, unknown or other
  misc_feature (562)..(562): n is a, c, g, or t
  modified_base (564)..(564): a, c, t, g, unknown or other
  misc_feature (564)..(564): n is a, c, g, or t
tcagtactctcgtgcacgaccggtgctcgatttagagtatacatattgggcttggtccagcctgggcggtctctgagactgtcctgtgaaccctctggggtctccgtcagcagcgactgtattgcctgggtccgccaggctccagggaagaggccggagtgggtcgcaggtatttttanaggtgggacgacattctacggagactccatggagggccgattcaccatctccagagtacttttcncagaacacactgtctcttcaaatgaacagcctggagggccaggacacggccgtctattattgtgtgagtagtttanggcgatgggctgggtggacagatcgacgtggggcagggaccctggtaccaccgtctcctcagccctccacgagggcccagtcggtccttccccgtggccgccctgctccaggacnccaaccgtccgagacgcgaacncggccggccgtgggcctgccgtggtaccaagggtacctaccgttcccgaacgaggaacgttgcggacgggccgggcttcgggaacaaaggggccacgaagngngngng

SEQ ID NO: 320039 - DNA, 730 bp, Homo sapiens
  misc_feature: GZ8MTXP01EFOFE.19.67.G01.1.454.CMB.2.raw
  modified_base (565)..(565): a, c, t, g, unknown or other
  misc_feature (565)..(565): n is a, c, g, or t
  modified_base (659)..(659): a, c, t, g, unknown or other
  misc_feature (659)..(659): n is a, c, g, or t
tcagtactctcgtgcacgaccggtgctcgatttagagtatacatattgggtttggggggggagaggagcccagcactgggattccgaggtgtttccattcggtgctcagcactgaacacagaggactcaccatggagttttggctgaccttgggttttccttgctgctaatttcgaggaggtgtccagtgtgagggtgcaacgtgggtggagacgtgggcgggagggtcttggtcccagccgtggggcggtctcgtgagactgtcctgtcgaacccgtcgtgggtcctccgtcagcagcgtactgtattcggccgtcggggtcccgccgagggcctaccggaagggggaacggacgggccggggtaggttcgggggtcgtacggttaggggttttaatttttaaggaagggggttggggaaccctaacgtagtttccggtaacggggactaaacccgttaccgaagggtcgggggtacggggtacccgtactttaccaacctagttccctaccgaagtacgttacctttcgtacaacgtaaaccactactcgtacttacctaaanaaagtacgaaacgcgtcggtacggacggggacccgaacggacgaaccggtcccgttattagtttaagttggtggtaagtaaggttagtttaagngggtacgtagttgggttcgttggggtaacgacgtaagcgtacggacggtcgggggaaccgtaacccggggg

SEQ ID NO: 320040 - DNA, 768 bp, Homo sapiens
  misc_feature: GZ8MTXP01CNNU4.19.67.G01.1.454.CMB.2.raw
  modified_base (212)..(212): a, c, t, g, unknown or other
  misc_feature (212)..(212): n is a, c, g, or t
tcagtactctcgtgcacgaccggtgctcgatttagagtatacatattggggtttgggggagctacaacaggcaggcaggggcagcaagatggtgttgcagacccaggtcttcatttctctgttgctctggatctctggttcctggcggggacatcgtgatcgacccagtacccagactcactggctgtgtctcgtgggcgagaccggccaanaatcaactgacgacggtccagaccaagtaacttctttccaccacctacaaagaactaaaacttctacgcctagaaccaacagacgaccaggacacgtccctacctaagttcgcttctaacgtttacgtcgggtacttccgtacggcggacgttaacggttccggggccctacggtaaccccccggtcgggttaccgggggctacggggtcccgggggttacgtacgggtaacctaggttacctttccgacccttccgtaacccaaccgtacgttaccgacgtacgaaccgggtccctagggaccgtacgggtacgttaaggaaaggtgttacggttaggttacgtttaaaccgtttttagggttaccttaggtaccttaaggttaaccctttaattttttaaccttttccgttaaacccgttcccgtttaaccgggtcggttaacccggttcggaaaccgggtaacgggttaccgggtaagggttaacgtaaacgtcgttaaacggacgttacgtaagggtccgtaagtacccgcttaaaccttggttccttaacg

SEQ ID NO: 320041 - DNA, 827 bp, Homo sapiens
  misc_feature: GZ8MTXP01B5HCR.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagtttggctgacctgggttttcctgctgcaattcaggagtgtccagtgtgaggtgcaacgtggtggagacgtgggcggaggtcgttggtccagccgtggggcgtctctgagtactgtcctggtacgacccgtggtgggtctccgtcagcagcgtactgtacttcggccgtcgggtccgccgaggcctaccgagggggaaacggacgggccgggtaggtcgggggtcgtacgtaagggtttaatttttaggagggggtcgggaaccgtacgtagttaccgtacgggagtaaccttaccgaaggtcgggggaacggggcccgtatttacccgaaccctacgttacccgtacccgtaaggttaacgtttaccgtttttaccaacgtaaacggtaaacccttacgtaacctttcggttacctttaacttaactaaaacgttacggtaaaaccgggacggtacccgggttagggaacccgggggacccgaaacgggggaacccgtacccggggtacccggtttactttaacggttttacggtttacgggttagggtaagggttaaaggtttaggggttttaacggttcggggtaaacggttggttcgggggttaacggttcgggggttaaggaaccggtaaggttaaccggtcggttaaccggggtaaccggggggttaaccggttaaaccccggggg

SEQ ID NO: 320042 - DNA, 613 bp, Homo sapiens
  misc_feature: GZ8MTXP01AN33L.19.67.G01.1.454.CMB.2.raw
  modified_base (498)..(498): a, c, t, g, unknown or other
  misc_feature (498)..(498): n is a, c, g, or t
  modified_base (504)..(504): a, c, t, g, unknown or other
  misc_feature (504)..(504): n is a, c, g, or t
  modified_base (542)..(542): a, c, t, g, unknown or other
  misc_feature (542)..(542): n is a, c, g, or t
  modified_base (558)..(558): a, c, t, g, unknown or other
  misc_feature (558)..(558): n is a, c, g, or t
tcagtactctcgtgcacgaccggtgctcgatttagagtatacatattggggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtgggcggaggcttgggtccaggccctggggcggtctctgagactggtcctgtcgaacccctgtggggtctccggtcagcagcgactgtattgccgtgggtcccgccaggcctccgaggggaagacgggccggagtgggtcgcgtaggtttatttttaaggagggttgggacccgactagtttacgtacgggagtaaccttcccgaagtcggggacgggcccgattccgaccatcctaccagacgtacttttcacagaacactactcgtctacttacgaaattggaaacngtccgnggaacggggccgaggaccacggtccgtctagttattgngtgagttgtttacggnggtcgtgttggcgttgggtgacgtaagacgtcgacgggtcgggaaccgtaacggg

SEQ ID NO: 320043 - DNA, 743 bp, Homo sapiens
  misc_feature: GZ8MTXP01ALE1P.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctgggcgtctctgagactgtcctgtgaaccctctggggtctccgtcagcagcgactgtattcgcctgggtccgccaggcctccgaggggaagacgggccgggaggtggggtcgacgtaggttatttttagtagggtgggaccgactagttcgtacggagtaacctccgaagtgggacggggtccgacgtttccaccgatcctacccgagtacggtaacttttcgtacctaagaaaccactaacttcggtaccttactttaccaaaattcgggaaacctacgggacccgttagggaacgggggaccccggaacgggggtaacccgaaccgggggtcccccggtttaaccttaagttttaaaccgttttgggttacggtttgggtaaagggtttaaggttttttaaaccgggttcggggttacgggtacggttcggggttcggttacggggtaacgggtaacgtaaggtaccgttaccgggaccggggtaaccgggggaaccccgggtaaccggggg

SEQ ID NO: 320044 - DNA, 664 bp, Homo sapiens
  misc_feature: GZ8MTXP01APPBA.19.67.G01.1.454.CMB.2.raw
  modified_base (253)..(253): a, c, t, g, unknown or other
  misc_feature (253)..(253): n is a, c, g, or t
  modified_base (262)..(262): a, c, t, g, unknown or other
  misc_feature (262)..(262): n is a, c, g, or t
  modified_base (287)..(287): a, c, t, g, unknown or other
  misc_feature (287)..(287): n is a, c, g, or t
tcagtactctcgtgcacgaccggtgctcgatttagagtatacatattgggtttgggggggtagctcaggaagcagagcctggagcatctccactatggcctgggctccactacttctcaccctcctcgctcactgcacaggttcttgggccaactttatgctgactcagccccactctgtgtcggagtcgtccggggaagacggtaaccatctttgcacccacaacagtggcaacattgccagctaattttgngcagtgacngcagcgccggcacgtccccatatgngatctatgaaggataagtacaaacggtaccgtggtacggggtccctggtactcggttctcgtccggctcgactcgacaacgtccctccctaccaacctcgtccgccccttccctacaacctacttccgtacgtacgggactacggaaacgtaccgtaggacgggaaccggagtaccgtacgtaaccttacgttaacggtcgttaccgtaagttaccttagtcgtaacgtacggccccgggtcggttacctaggttcgggtcgggttccggttcggggacggggaacggttaaccgaacggtccgttaccggttcccgttaccggaaggtccgaacggtccccgaacgggttcccctccggttccccccgttaaccgg

SEQ ID NO: 320045 - DNA, 613 bp, Homo sapiens
  misc_feature: GZ8MTXP01ATR3M.19.67.G01.1.454.CMB.2.raw
  modified_base (254)..(254): a, c, t, g, unknown or other
  misc_feature (254)..(254): n is a, c, g, or t
  modified_base (282)..(282): a, c, t, g, unknown or other
  misc_feature (282)..(282): n is a, c, g, or t
  modified_base (310)..(310): a, c, t, g, unknown or other
  misc_feature (310)..(310): n is a, c, g, or t
  modified_base (323)..(323): a, c, t, g, unknown or other
  misc_feature (323)..(323): n is a, c, g, or t
  modified_base (604)..(604): a, c, t, g, unknown or other
  misc_feature (604)..(604): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctggcggggacatcgtgatcgacccagtacccagactcactggctgtgtctcgtgggcgagacggccacaatcaactgcagtccagccagtaactatttccaccacctacaaanaactaaaacttctagcctagtaaccaanagacgaccaggacacgcctactaagtcnctactatttacgnggtccttacgacgcgtacgtaacgttccggggtccctacggtaccccgtacggtccggggactacgggtcgggtaactagggaactagtactttcactcctacacctatcagtcacgcctagcaggtctagaagagttgtaggacttaggtttactactggtacaagtaccttaaatttcttttaccactccgttccggtaggtacccgttgggaaccgaagggttccgtaagggttacgtaaactccgaaagcgttaacgtggtacgctacgccttactnttcgttaac

SEQ ID NO: 320046 - DNA, 632 bp, Homo sapiens
  misc_feature: GZ8MTXP01BV2TN.19.67.G01.1.454.CMB.2.raw
  modified_base (395)..(395): a, c, t, g, unknown or other
  misc_feature (395)..(395): n is a, c, g, or t
  modified_base (564)..(564): a, c, t, g, unknown or other
  misc_feature (564)..(564): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtgggcggaggcttggtccaggccgtggggcggtctctgagactgtcctgtcgacccgtcgtcggggtctccgtcagcagcgactgtattcgccgtgggtcccgccgaggcctccgaggggaagagggccggaggtgggcgcgtaggttagtttttagagggtgggaccgactagttcgtacggganaaccgtccgaagtgggaacggggccgtattccaccatccctaccagtacgttactttcacagaacactactgtctactacaaatcgaaacgacgaccgtagggacgggaccgaacggaccgacggtaccgttacgttatttagttgtaggtaagtaaggttagtttagngggtcgtagttcgggttgttaggggtggacgtaagtacgtcgacgggttcggggccgtaacccggggg

SEQ ID NO: 320047 - DNA, 583 bp, Homo sapiens
  misc_feature: GZ8MTXP01ENJ09.19.67.G01.1.454.CMB.2.raw
  modified_base (366)..(366): a, c, t, g, unknown or other
  misc_feature (366)..(366): n is a, c, g, or t
  modified_base (554)..(554): a, c, t, g, unknown or other
  misc_feature (554)..(554): n is a, c, g, or t
  modified_base (565)..(565): a, c, t, g, unknown or other
  misc_feature (565)..(565): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagactgggcggaggcttggtccagcctggggcgtctcgtgagactgtcctgtgaaccctcgtggggtctccgtcagcagcgactgtattgcctgggtccgccaggctccgagggagaggccggagtgggtcgctaggttatttttagaggtgggacganattcgtaacggagtctccagtgggagggccgtagttcaccgatctaccagtacgtacttttcacagaaacacacttgtacctacttacaaagttgaaactagccctggaacggggcccggaaggaccgacggtccgttactaagtttattggttgttagtaagttagtttagtgggacgttgttgggntgggtcgtagnggactcgaacgtcggggg

SEQ ID NO: 320048 - DNA, 911 bp, Homo sapiens
  misc_feature: GZ8MTXP01B0DHI.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagtttggctgaccttgggttttccttgctgctaatttcaggaggtgtccagtgtgaggtgcaagtggtggagacgtgggcggaggtcgttggtccagccgtggggcgtctcgtgagtactcgtcctggtaccgaacccgtcgtcggggtcctccgtcagcaggcgtactgtacgttcgccgtcgggtcccgccgacggcctaccggagggggaacggacgggaccgggaggtgggggtccgcgttaggtttagtttttaggaggggttacgggaccgactagttacggtaacggtagaacccgttaccgaaggttacgggggaacggggtacccgtacgtttacccgaacccgtacgttaccccgttacccgtaaacggtaaccggtttaacccgttttttacctaaccgaaacgggttaaaaccccgtaacctttaaacccgtttcccggtttacctttacccttttaaacgaaaaacgttaaccggtaaaacccggtaacggggtacccggtttaacgggggaacccggggggtaacccggtaaacgggggaaaccccgtaccgggggttacccccgggtttaaccttttaaagtttaaaccggtttttgggttagggttaagggtaaacggttttaaagggggtttttaaagttcgggggtaccgggttaacggtttgggggttccggttaggggggttaacggaaccgtaaggtaacggttacccgggttacggggtaacccggggggttaacccggttaaaaccccgggggg

SEQ ID NO: 320049 - DNA, 845 bp, Homo sapiens
  misc_feature: GZ8MTXP01AVHHA.19.67.G01.1.454.CMB.2.raw
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgaccttgggtttttccttgctgcaatttcaggaggtgtccagtgtgaggtgcaacgtggtggagacgtgggcgggaggtcgttcggtccaggccgtcggggcggtctcgtgagtacgtcgtcctcgtacgtaccccgttcggtcgggggttcctcccggtcgaggccgacgccgtaccgttgttacgtttcggccccggttccggggtaccccggcccgtacggggccccgtacccggaaagggggaacggaccgggggtcccggggaagggttccgggggtcgtaccggttaaggggtttacgtttttaggtaacgggggttacgggacgtaactacgttaccgtaaaacgggacgtaaccgtcccgtaggtggggacgggccggtacttcccgaacctactcctaccgacgtacgttaccttttacgacaaccgtaactacctacttcgttaccttacctttaacaaacgttacggaaacgtacggtcccggtaagggaacccggggaccgtaacggggaacccgtacccgggttccgttacgtttaacgtttggttgggttaaggttaggggttaacgtttaaacgggttttagggtaccggggttacggttaacggttagggggttccgggttagggggttaacggaaccggtacggttaacggtcccggggttaacggggtaaccccgggggg

SEQ ID NO: 320050 - DNA, 722 bp, Homo sapiens
  misc_feature: GZ8MTXP01BA1OW.19.67.G01.1.454.CMB.2.raw
  modified_base (530)..(530): a, c, t, g, unknown or other
  misc_feature (530)..(530): n is a, c, g, or t
tcagtactctcgtgcacgaccggtgctcgatttagagtatacatattgggtttgggggagctacaacaggcaggcagggggcagcaagatggtgttgcagacccaggtcttcatttctctgttgctctggatctctggttcctggcggggacatcgtgatcgacccagtacccagactcactggctgtgtctcgtgggcgagaccggccaacaatcaactgcacggtccagaccaagtaactattttcccacccaaccctaccaaaagtaaaacctaaaaacttcttaacgcctacggtaaccaacgaaggaacgaacccgaaggaccacgtaccccttaccgtaaagttcgaccttacgtaagttttaccgtcggggtcctttaccgtaacggccggtacgtaacggtttccgggggcccctaggtacccccggtacggttccgggggctacggggccggggttaactaggggaacctaggtactttccacttcctacacctatccagccacgtcccgtgacgtacggntaaggaaagtgttcgggtaggtacctttaaggttttactaacgttcggtactagttaccttaaattttctttttacgtacttcccgttcggtcggtaccgttcggaaccggtaaacggggccgtaaggggttaccgaaagttccgaaaggcgttaacgttgggacgtccgtacgaccacgtaacttcgttcg

SEQ ID NO: 320051 - DNA, 651 bp, Homo sapiens
  misc_feature: GZ8MTXP01AXFLK.19.67.G01.1.454.CMB.2.raw
  modified_base (312)..(312): a, c, t, g, unknown or other
  misc_feature (312)..(312): n is a, c, g, or t
  modified_base (408)..(408): a, c, t, g, unknown or other
  misc_feature (408)..(408): n is a, c, g, or t
  modified_base (416)..(416): a, c, t, g, unknown or other
  misc_feature (416)..(416): n is a, c, g, or t
  modified_base (439)..(439): a, c, t, g, unknown or other
  misc_feature (439)..(439): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgcaacgtggtggagacgtgggcggaggcttggtccaggccgtggggcggtctctgagtctgtcctgtcgaacccgtgtcggggtctccgtcagcagcgactgtatggccgtgggtcccnccgaggcctaccggaagggggaacggacgggccgggtaggtcggggtcgtcgtaggtttatttttaggagggtgggacctatagttcgtaacgganaacctcgngtcggggacggccgtatccaccntcaccagtactactttcacaacgtaacactactgtactacttaacgaaatacgaacgcgtaccgtagggacggggaccgacggaccgacggtacccgttattaagtttagttggttagtaaggtaaggttaggtttaggcggtacggtagttgggttcgttggggtaacgagtaacgagtccggaacgggtcgggggaaccgtaacccgggg

SEQ ID NO: 320052 - DNA, 614 bp, Homo sapiens
  misc_feature: GZ8MTXP01CYKHJ.19.67.G01.1.454.CMB.2.raw
  modified_base (374)..(374): a, c, t, g, unknown or other
  misc_feature (374)..(374): n is a, c, g, or t
tcagtactctcgtgcacgaccggtgctcgatttagagtatacatattgggtttggggggtagctcaggaagcagagcctggagcatctccactatggcctgggctccactacttctcaccctcctcgctcactgcacaggttcttgggccaactttatgctgactcacgccccactctgtgtcggagtcgtccggggaagacggtaaccattcttttgcacccacaacagtgcaacattgccagctaatttgtgcagtggtaccagcagccgcccgggcacgttccccccactatgtgatctatgaaggataaatacaaacgccgtacgttcgggggtccctgtacttcggttctcgtcggctcatcgacaacncctcctccaactcctcgcccctccctcacctactctctaggactagaacgacgtggacgggacgagtctacgtacttaactacgtcggttactacgttacttaagtgacgtacggccgtcgtacgtgttcggttcggtcggttcgggacgggaacggaccgtaaacgtcgttaccggcccggttaccgtaacgggtacaaccggtcccgaacgggttcccttcccggcccccgtttccgg

SEQ ID NO: 320053 - DNA, 699 bp, Homo sapiens
  misc_feature: GZ8MTXP01CLG9W.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggcctctgagactgtcctgtcgaaccctcgtggggtctccgtcagcagcgactgtattgccgtgggtccgccaggctccgaggggaagaggccggaggtgggtcgcgtaggttattttagaggtgggacccgactagttctaacgggagaaccttccgaagtggggaacggggcccgtaattccgaccctaagtccctacccgtaagtacggtacctttttacacaacgaaactacctaacttcgttccttacttacaaaatacgaaacgtacggtacccgttagggaacgggggaccggaacgggacccgaaccgggtacccggttaccgttaagtttaagtttcgggttggttaaggtaaggttaggtttttaagggcgggttacggtaggttcgggttcggttaggggtaacggaacgtaacggtacgtaccggacgggtccgggggaacccggtaaccgggg

SEQ ID NO: 320054 - DNA, 601 bp, Homo sapiens
  misc_feature: GZ8MTXP01BB73L.19.67.G01.1.454.CMB.2.raw
  modified_base (512)..(512): a, c, t, g, unknown or other
  misc_feature (512)..(512): n is a, c, g, or t
  modified_base (538)..(538): a, c, t, g, unknown or other
  misc_feature (538)..(538): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgcaacgtggtggagacgtgggcggaggcgttggtccaggcccgtggggcggtctcgtgagactgtcctgtcgaaccctctggggtctcgtcagcagcgactgtatgcctggtccgccaggctccgagggaagaggccggagtgggtcgcgtaggttagttttagagggtgggaccgactattcgtacggagtaactccgaagtcgggaggggccctaagttccaccgtatccgtccagtacgtactttcacgagaacactactcgtcttactacaaattcggaaacagcccgtagacgggtcgaacggacacggccttntacgttatgtgtgtagttagtttagnggtacggtattcgggttgttacgggtggtacgtaagcgtcgacggtcggggccgtaaccgggg

SEQ ID NO: 320055 - DNA, 676 bp, Homo sapiens
  misc_feature: GZ8MTXP01AISY7.19.67.G01.1.454.CMB.2.raw
  modified_base (376)..(376): a, c, t, g, unknown or other
  misc_feature (376)..(376): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggagtgtccagtgtgaggtgcaactgggtggagacgtgggcggaggcttgggtccaggcctggggcggtctctgagactgtcctgtcgaccctcgtggggtctccgtcagcagcgactgtatcggccgtgggtcccgccaggcctccgaggggaagacggccggaggtcgggtcgcgtaggttatttagagggtgggaccgatnttcgtacggagaacctccgaagtcgggacgggcctattccacctatccaccgagtacgtacttttcacaacgtaacactacttgtccttacttaacgaaacttacggaaactacggtcccgtacgggacggggacccgaaaccggggtaccgacccgggtacccggtacttaagtttacgttaggttggtaaggtaacggttaggttttagttacgggtacggtagttggggttcgttacggggtaagggtaacgtaacggacgtaccggaccggttcgggggaacccgtaacccggggg

SEQ ID NO: 320056 - DNA, 606 bp, Homo sapiens
  misc_feature: GZ8MTXP01AH8DP.19.67.G01.1.454.CMB.2.raw
  modified_base (276)..(276): a, c, t, g, unknown or other
  misc_feature (276)..(276): n is a, c, g, or t
  modified_base (439)..(439): a, c, t, g, unknown or other
  misc_feature (439)..(439): n is a, c, g, or t
  modified_base (499)..(499): a, c, t, g, unknown or other
  misc_feature (499)..(499): n is a, c, g, or t
  modified_base (537)..(537): a, c, t, g, unknown or other
  misc_feature (537)..(537): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtgggcggaggtcttggtccaacgtgggcggtctctgagactgtctgtgaccctcgtgggtctccgtcngcagcgactgtattcgcctcgggtccgcccaggctccgaggggaaggacggccgggaggtgggtcgcgtaggttattttagtaggtgggacgacctagttacgtacggagtacgtacccagtgggacgggccgtattcgaccatctcccagtagtacttttcncaagaacactactgtactcttacaaagtgaaccaggccgtggacgggacccgaggtaccncggtcgttacttagttgttggtgtgaagtgttttaggnggcgtagtgggttcgttgggttaggaactgtaacgtcggacggggttccgggaaccgaaccgggtcccg

SEQ ID NO: 320057 - DNA, 535 bp, Homo sapiens
  misc_feature: GZ8MTXP01DGBNZ.19.67.G01.1.454.CMB.2.raw
  modified_base (250)..(250): a, c, t, g, unknown or other
  misc_feature (250)..(250): n is a, c, g, or t
  modified_base (293)..(293): a, c, t, g, unknown or other
  misc_feature (293)..(293): n is a, c, g, or t
  modified_base (433)..(433): a, c, t, g, unknown or other
  misc_feature (433)..(433): n is a, c, g, or t
tcagtactctcgtgcacgaccggtgctcgatttagagtatacatattgggtttgggggtagctcaggaagcagagcctggagcatctccactatggcctgggctccactacttctcaccctcctcgctcactgcacaggttcttgggccaactttatgctgactcagccccactctgtgtcggagtctccggggaagacggtaaccatcttttgcacccacaacagtggcaacattgccagcaattttgngcagtggtaccagcagcgcccgggcacgttccccccacattgngatctatgagataaatcaaagccgtctgggggtccctgatcggtctctggctcatcgacagcctccctccaactctcgccctccctcaccatctactgactagaagtactggaggacgagggctagactacgtactgttnaagttcttatgaatcgccgtcggtcagtggtcggtcgttcgggcgggagggaccaaggccttggacccgttcgtaaggtcaagcccgagcctcgccccgtcg

SEQ ID NO: 320058 - DNA, 706 bp, Homo sapiens
  misc_feature: GZ8MTXP01ENXZR.19.67.G01.1.454.CMB.2.raw
  modified_base (621)..(621): a, c, t, g, unknown or other
  misc_feature (621)..(621): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgcaacgtggtggagacgtgggcggaggcttgggtccaggcccgtggggcggttctcgtgagacgtcgtcctgtcgaaccctcgtcggggtctccgtcagcgagcgactgtattgccgtggtcccgcaggcctacggaaggggaagacgggccggtaggtcggggtcgacgttaggtttagtttttaggaggggtaggaccgactattcgacggacgtaacctcgaagtcgggacgggcctagttccacctatccctacgaagtacgttactttcacaagaaactctaacgtcgttccttactaactaaaacgtcgtaaacgcgtacccggtaggaaccgggggaccgaacgggtaccgaaccggggttccccttagttaaagtttacggttgggttaaggtaagggtaaagtttagggttttaagggngggtacgtaggttcgggttcggttacgggtaacgacgtaaggtacgtacgggttaccggggtccgggggaacccggtaaccgggg

SEQ ID NO: 320059 - DNA, 642 bp, Homo sapiens
  misc_feature: GZ8MTXP01B2LHP.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtgggcggaggtcttggtccagcccgtggggcggtctctgagactgtcctgtcgaaccctcgtggggtctccgtcagcagcgactgtatgcctgggtccgccgaggctccgaggggaagaggccgggaggtgggtcgcgtaggttactttttagtagggtgggaccgacattcgaacggagtaacctccaagtgggacgggccgtagttccgaccactccctcctaggtacgtacttttctaccaacgtaaacactacttcggtcttctttacgaaactcgaaaccgtagcccgttaggacggggcccgaacggaccgaccggtacccgtccttaagttagtttgtggttggtaaggttagtttaagttggtacggtagttgggcgttagggttggactaaggacttcgacggttcggggccgtaaacccgggg

SEQ ID NO: 320060 - DNA, 648 bp, Homo sapiens
  misc_feature: GZ8MTXP01B5UHE.19.67.G01.1.454.CMB.2.raw
  modified_base (406)..(406): a, c, t, g, unknown or other
  misc_feature (406)..(406): n is a, c, g, or t
  modified_base (579)..(579): a, c, t, g, unknown or other
  misc_feature (579)..(579): n is a, c, g, or t
  modified_base (595)..(595): a, c, t, g, unknown or other
  misc_feature (595)..(595): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgctaatttcaggaggtgtccagtgtgaggtgcaacgtggtggagacgtgggcggaggcttggtccagtccgtgggcggtctcgtgagtactgtctgtcgaccctcgtgggtctccgtcagcagcgactgtattcgccgtgggtcccgccgaggcctaccgaggggaagacgggccggaggtgggtcgcgtaggtttagttttagagggtcggaccgtactagttcgtacggagaacctccgngtacgggaggggcccgtattccacctatcctaccgagtacgttaccttttcacaagaaaccacgtactcgtccttacgttacaaattacgaactacgtccgtaggacggggaccggacggaccgtaccgggtccgttacttaagtttagttgttgtaaggtagttaggtttangggtctaaggttcggngttagggtcgtagaagtacgtaccgacgggtcggggttaaccgtaacccgggg

SEQ ID NO: 320061 - DNA, 612 bp, Homo sapiens
  misc_feature: GZ8MTXP01APE5C.19.67.G01.1.454.CMB.2.raw
  modified_base (546)..(546): a, c, t, g, unknown or other
  misc_feature (546)..(546): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctaacctgggttttccttgctgcaatttcaggaggtgtccagtgtgaggtgcaactggtggagactggcggaggcttggtccagccgtgggcggtctcgtgagactgtcctgtcgaaccctcgtgggtctccgtcagcagcgactgtattgccgtgggtccgccgaggctccgaggggaacgaggccggaggtgggtcgcgtaggttatttttagaggtgggacgtacattcgtacggagactccgagtgggacgggccgattccaccatcctaccagacgttacttttcacgaacgaacactacttgtaccttacgttacaaagtcgaaaccagggcccgtagggacgggacccgaaggaccgacggtccgttacttattacgttgtgtgaagttagtttagnggcgtagttcgggcgttgggttcggaacaggaactcgacggttcggggccgaacggggtaaccccg

SEQ ID NO: 320062 - DNA, 814 bp, Homo sapiens
  misc_feature: GZ8MTXP01AXW1T.19.67.G01.1.454.CMB.2.raw
  modified_base (439)..(439): a, c, t, g, unknown or other
  misc_feature (439)..(439): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggtttccttgctgcaatttcaggaggtgtccagtgtgaggtgcaacgtggtggagacgtgggcggagggtcttgggtccaggccgtggggcggtctcgtgagtactgtcctgtcgaccctgtggggtctccgtcagcagcgtactgtacgttcgccgtgggtaccccgccgagggcctaccggaagggggaacggacggggcccgggtaggttgggggtccgtacgtaagggttttatttttaacggaggggttcggggaaccctacgtagtttacgaaaccggggtanaaacccgttcgaaggtcgggggacgggtccctaacttccgaaccctagttccctaacccgaggtaaccgttacttttccgacgtaaacgaaacctacctacgttacgttaccttacttaaccaaaagttacggaaacggacgtcccggttagggaaccgggggaccgtaacggggaaccctaacccggggttcccggtttaaccttaacgttttacggtttacggttacggttaaggggttaaggttaaacggggttttttaggacgggggtaacggtaacggttgggggttccgttaacggggggtggtaaccgtaaggggttacgtacccgggttacggggttccgggggggaaccccgttaaacccgggggg

SEQ ID NO: 320063 - DNA, 545 bp, Homo sapiens
  misc_feature: GZ8MTXP01BK830.19.67.G01.1.454.CMB.2.raw
  modified_base (252)..(252): a, c, t, g, unknown or other
  misc_feature (252)..(252): n is a, c, g, or t
  modified_base (293)..(293): a, c, t, g, unknown or other
  misc_feature (293)..(293): n is a, c, g, or t
  modified_base (452)..(452): a, c, t, g, unknown or other
  misc_feature (452)..(452): n is a, c, g, or t
tcagtactctcgtgcacgaccggtgctcgatttagagtatacatattgggtttggggggtagctcaggaagcagagcctggagcatctccactatggcctgggctccactacttctcaccctcctcgctcactgcacaggttcttgggccaactttatgctgactcagcccccactctgtgtcggagtctccggggaagacggtaaccatcttttgcacccacaacagtggcaacattgccagcaattttgngcagtggtaccagcagcgcccgggcacgtcccccacattgngatctatgaggataatcaaagccgtcgtggggtccctgatcggttctcgtcggcctcatcgacaacgcctcctcccaactctcgccctccctcacccatcctcctgggacctagaacgacgtgacggacgaggctagactactacgtgtcagttcttangatcggccgtcgtctgtgtggtcgtcggggacgggacggaccgagcgttcgccgttcgtaagccgaacgcccgaggttcctcccgccccgtcg

SEQ ID NO: 320064 - DNA, 641 bp, Homo sapiens
  misc_feature: GZ8MTXP01BJPVF.19.67.G01.1.454.CMB.2.raw
  modified_base (278)..(278): a, c, t, g, unknown or other
  misc_feature (278)..(278): n is a, c, g, or t
  modified_base (289)..(289): a, c, t, g, unknown or other
  misc_feature (289)..(289): n is a, c, g, or t
  modified_base (326)..(326): a, c, t, g, unknown or other
  misc_feature (326)..(326): n is a, c, g, or t
  modified_base (386)..(386): a, c, t, g, unknown or other
  misc_feature (386)..(386): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctggcggggacatcgtgatcgacccagtacccagactcactggctgtgtctcgtgggcgagaccggccaacaatcaactgacaggtccagccaagtaactacttttccaccacctacaaagtaaactaaaacttctanctagaaccaanagacgacagacagcctactagtcgctactatttacgnggtcttaccgacgcgacgtaacgttccggggtcctacggaccccgtacggttccgggganacgggtccgggtacgtagggaactagtactttccacctcctaccgaactacgtcgacgcctacgcccttaggacgtaagggtctaaggaaagtgtcggttacggtactttaagtttacgtactgtaccagttacttaatttcttttctacgttccgtacggtcggtaccggttcggaacccggtaagggaccgtagggttacgtaaacgacgacgttacgttagtggcggtctgaccacttaagttccgttaacg

SEQ ID NO: 320065 - DNA, 602 bp, Homo sapiens
  misc_feature: GZ8MTXP01BOD5N.19.67.G01.1.454.CMB.2.raw
  modified_base (244)..(244): a, c, t, g, unknown or other
  misc_feature (244)..(244): n is a, c, g, or t
  modified_base (276)..(276): a, c, t, g, unknown or other
  misc_feature (276)..(276): n is a, c, g, or t
  modified_base (320)..(320): a, c, t, g, unknown or other
  misc_feature (320)..(320): n is a, c, g, or t
  modified_base (398)..(398): a, c, t, g, unknown or other
  misc_feature (398)..(398): n is a, c, g, or t
  modified_base (451)..(451): a, c, t, g, unknown or other
  misc_feature (451)..(451): n is a, c, g, or t
  modified_base (458)..(458): a, c, t, g, unknown or other
  misc_feature (458)..(458): n is a, c, g, or t
  modified_base (476)..(476): a, c, t, g, unknown or other
  misc_feature (476)..(476): n is a, c, g, or t
  modified_base (563)..(563): a, c, t, g, unknown or other
  misc_feature (563)..(563): n is a, c, g, or t
  modified_base (596)..(596): a, c, t, g, unknown or other
  misc_feature (596)..(596): n is a, c, g, or t
  modified_base (598)..(598): a, c, t, g, unknown or other
  misc_feature (598)..(598): n is a, c, g, or t
  modified_base (600)..(600): a, c, t, g, unknown or other
  misc_feature (600)..(600): n is a, c, g, or t
  modified_base (602)..(602): a, c, t, g, unknown or other
  misc_feature (602)..(602): n is a, c, g, or t
tcagtactctcgtgcacgaccggtgctcgatttagagtatacatattgggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagtacttttcncagaacacactgtctcttcaaatgaacagccnggagggccgaggacacggccgtctattatgtgtgagtagtttanggcgtagtgggcgtgggtggaacaggtactcgaaccggtcgggggaccacggggtaacccctggtacccacccgttcncctacacgcccctccaacgaacgggcccctacgtccggttccctttcccccgngggcccncccgttgcctccgaggcncacccgtcgagacgcaacgcgccggccctcggggcctcggccgtggtaccaacggtcctacccgttcccgacgaggacgttaccggnggacgggcgggttcgcggaacgacggcgacagngngngn

SEQ ID NO: 320066 - DNA, 587 bp, Homo sapiens
  misc_feature: GZ8MTXP01EANXI.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttgggtccagcctggggcggtctctgagactgtcctgtcgaacccctcgtgggggtctccgtcagcagcgactgtatgcctgggtcccgccaggctccgaggggaagaggccggagtgggtcgcgtaggttattttagagggtgggaccgactattcgtacggagaactccaagtgggacgggccgattccaccatctaccagtacgtacttttctacaagtaaacactactgtctcttacaaatgaacagccgtgacgggccgaggacacggccgtctattattggtgtaagtagttaggtttattgggacgtagttgggcttgggtggaacgaaggactcgacggttcgggggcccgtaaccggggg

SEQ ID NO: 320067 - DNA, 641 bp, Homo sapiens
  misc_feature: GZ8MTXP01AI4TC.19.67.G01.1.454.CMB.2.raw
  modified_base (562)..(562): a, c, t, g, unknown or other
  misc_feature (562)..(562): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtgggcgggaggcttgggtccaggccgtggggcggtctctgagactgtcctgtcgaaccctcgtggggtctccgtcagcagcgactgtatgccgtgggtcccgcgaggctccgaggggagagggccggaggtgggcgcgtagggtttattttagaggggtggaccgactagtttcgacggagaacctccgaagtgggacgggtccgattaccacatcctaccgaagtacgttacttttcacaagtaacactacttgtcttcttaacaaagttagaacgtacgccgtgggacggggaccgaaggaccgaccgggtccgtattagttagttggtgtggtaagttaggttttagggnggtacggtaggttcgggttcggttggggtaaggacgaaggtacgtacggttaccgggtcggggaacccggtaaccgggg

SEQ ID NO: 320068 - DNA, 698 bp, Homo sapiens
  misc_feature: GZ8MTXP01DVRDO.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaaacacagaggactcaccatggagttttggctgaccttgggttttccttgctgcaatttcaggaggtgtccagtgtgaggtgcaacgtggtggagacgtgggcggaggtcttggtccaggccgtggggcggtctcgtgagactgtcctgtcgaccctcgtcggggtctcgtcagcagcgtactgtagtcgccgtcgggtcccgccgacggctaccggaaggggaacggacgggccgggaggtcgggtacgcgtaggtttagttttagagggtgggacgactagttcgtacggacgtaacctacgaaggtggggacgggtaccgtacttaccacctacttctacccgaagtacgttactttactacaaagtaaacctacgtactcgttaccttacttaacgtaaaacgttcgaaacgtacggtaccgtacggggacggggacccgaagggacccgtacggtaccgttacgttaagtttaagttgggttagtaaggtaagttaggtttacgttggtacggtagttgggttcgttagggtaacggaacaaggtacgtcgaaccgggtcggggaacccgtaacccgggg

SEQ ID NO: 320069 - DNA, 642 bp, Homo sapiens
  misc_feature: GZ8MTXP01DNS4C.19.67.G01.1.454.CMB.2.raw
  modified_base (284)..(284): a, c, t, g, unknown or other
  misc_feature (284)..(284): n is a, c, g, or t
  modified_base (312)..(312): a, c, t, g, unknown or other
  misc_feature (312)..(312): n is a, c, g, or t
  modified_base (324)..(324): a, c, t, g, unknown or other
  misc_feature (324)..(324): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctggcggggacatcgtgatcgacccagtacccagactcactggctgtgtctcgtgggcgagacggccacaatcaactgcaggtccagccaagtaactatttccaccacctaccaaagaaactaaaacttctagccagaaccaanagacacaggacacgccctacgtaagtcnctctatttacgngggtcttcgtacgcgacgtaacgttccgggggtccctcggaaccccgtacggttccggggcacgggtccggggtacgtacggggaactaaggtactttcccaccttcctaccaaccatccgaaggccaacggccctaggaccgaaagggtctaaggaaacgtgtggtacggtactttaaggttttactacgtgtacctaagtaccttaaatttcttttactacgtcccgtacggtcggtacgttcggaacgaacgggacgaggttagaaacgtcaaggttcttaacgtggtcgcgtcgaccttactaacgttcgttcg

SEQ ID NO: 320070 - DNA, 658 bp, Homo sapiens
  misc_feature: GZ8MTXP01AI2G5.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgcaacgtggtggagacgtggcggaggcttggtccagccgtgggcgtctctgagactgtctgtcgaccctcgtggggtctccgtcagcagcgactgtacttgccgtgggtccgcaggctcgagggaagacgggcggaggtgggtcgcgtaggtttattttagtagggtcgggaccgtactagttcgtacggagtaacctcccaaggtcgggacgggtaccgtagttaccacctatccctaccgagtacgtacttttctactaacgaaacctactaacttcgttaccttaccttaacaaattacgaaacgtacggtccgtaggaacggggaccgaacgggacccgtacggcccgttacgttagtttacgttgttggtaacgtaagttacggtttagcgggtacgtagttcggttcgttgggtaacggacgtaagtagtaccgacggtcggggaacccgtaaccgggg

SEQ ID NO: 320071 - DNA, 746 bp, Homo sapiens
  misc_feature: GZ8MTXP01BVKEY.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtgggcggaggcttggtccagcccgtggggcggtctcgtgagactgtcctgtcgaaccctcgtcggggtctccgtcagcagcgactgtattcgccgtgggtccgccgaggctaccgaggggaacggagggccgggaggtcgggtcgcgtaggttatttttagagggtgggaccgactagttcgtaacgggagtaactccgaaggttcggggaacggggcccgtaagttcccaacccgtacttccctacccgaaggtaacggttactttttacctacgtaacggtaaaaccactaaccttcggttccttactttaacctaaaagtaccgtaaacgacggtacccgttagggaaccgggggacccggaaacggggaaccgtacccggggtacccggttaccttaagtttaagtttggttaggtaaggtaaggtttaggttttaaaggttgggtacggtaaggttcggggttcgttcgggggtaagggaccgtaaggacgttacggaaccgggttcgggggaacccggtaaacccgggggg

SEQ ID NO: 320072 - DNA, 665 bp, Homo sapiens
  misc_feature: GZ8MTXP01BOA4T.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtgggcggaggcttgggtccagccgtggggcggtctcgtgagactgtcctggtcgaacccgtctggggtctccgtcagcagcgactgtattgcctgggtccgccaggctccgaggggaagaggccggaggtgggtcgcgtaggttatttttagtagggttgggaccgactagttcgtaacggagaacgtccaagtgggaacggggcccgtattcgaccactctaccagtacgtactttcgtcaagaaccactactgtcctcttacaaatacgaacgacgtccgtaggacgggggacccgaagggaccgaccgggtacccgtacttaagtttaagtttcggttggtaaggtaaggttaggttttaaggttggggtaccggtaaggttggggttcgttaggggttcggaacgtaaggtaacgtcgttaacgggtcgggggttaacccgtaaacccggggg

SEQ ID NO: 320073 - DNA, 662 bp, Homo sapiens
  misc_feature: GZ8MTXP01AOKOX.19.67.G01.1.454.CMB.2.raw
  modified_base (602)..(602): a, c, t, g, unknown or other
  misc_feature (602)..(602): n is a, c, g, or t
  modified_base (623)..(623): a, c, t, g, unknown or other
  misc_feature (623)..(623): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctggggcggtctctgagactgtcctgtcgaccctcgtggggtctccgtcagcagcgactgtattcggcctgggtcccgccacgggtcctaccggaagggggaacggcgggacccgggtaggtcgggggtcgacgtagggtttaattttttagagggggtcgggaccgactagttcgtaacgggacgaaaccttcccgaagtgggacggggtcctattccacctatcctccaagtacgtacttttctcaagaaaccactactacttccttacttaactaaacgtgaaacggtacgtcccgtagggaccggggacccgacgggacgaccgggtcccgttacttagttatttggtgtaagtaggttagttttagggnggtacgtgttggttgttgggngacgaagtcgcggttacggtcggggaacccgtaacgggg

SEQ ID NO: 320074 - DNA, 576 bp, Homo sapiens
  misc_feature: GZ8MTXP01D7EW4.19.67.G01.1.454.CMB.2.raw
  modified_base (252)..(252): a, c, t, g, unknown or other
  misc_feature (252)..(252): n is a, c, g, or t
  modified_base (290)..(290): a, c, t, g, unknown or other
  misc_feature (290)..(290): n is a, c, g, or t
  modified_base (368)..(368): a, c, t, g, unknown or other
  misc_feature (368)..(368): n is a, c, g, or t
  modified_base (382)..(382): a, c, t, g, unknown or other
  misc_feature (382)..(382): n is a, c, g, or t
tcagtactctcgtgcacgaccggtgctcgatttagagtatacatattgggtttggggggtagctcaggaagcagagcctggagcatctccactatggcctgggctccactacttctcaccctcctcgctcactgcacaggttcttgggccaactttatgctgactcacgccccactctgtgtcggagtcgtccggggaagacggtaaccattctttgcacccacaacagtgcaacattgccagctaatttgngcagtggtaccagcagccgccggcacgtccccacatgngatctatgagataatacaaagccgtgtcgggtcctgacttcggtctcgtcgctcatcgacaacgctccacactcgtcnccctccctcacctntctacgtcggactgaaacgtacgaggacggacggacggtctacgaacttaccttaacgtcgttctacgttacttagtagtagtacgccggtcgtagtgttcggttcgggtcgttcggggcgggaacgggaccaacggtcgttcggttacccgttcgtaacgaccgcgcccgagggcctcccgccccgttaaccg

SEQ ID NO: 320075 - DNA, 580 bp, Homo sapiens
  misc_feature: GZ8MTXP01AZAL2.19.67.G01.1.454.CMB.2.raw
  modified_base (286)..(286): a, c, t, g, unknown or other
  misc_feature (286)..(286): n is a, c, g, or t
  modified_base (296)..(296): a, c, t, g, unknown or other
  misc_feature (296)..(296): n is a, c, g, or t
  modified_base (310)..(310): a, c, t, g, unknown or other
  misc_feature (310)..(310): n is a, c, g, or t
  modified_base (345)..(345): a, c, t, g, unknown or other
  misc_feature (345)..(345): n is a, c, g, or t
  modified_base (385)..(385): a, c, t, g, unknown or other
  misc_feature (385)..(385): n is a, c, g, or t
  modified_base (391)..(391): a, c, t, g, unknown or other
  misc_feature (391)..(391): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtgggcggaggcttgggtccagcctgggcggtcggtctggagacgtcgtcctagtacggaccctgtggggtctcggtnagcagcgtangtatgcctgggccnccaggctccgagggagacgggccggagtgggcganagggtttattttagaggtgggtacacgtattcgacggganactcgngtgggacggcctatcactctctacgtagtacgtacttactacacaacactactcgtctactactaactagacgacgacgacggacggacggacgacgacggtccgtacgttagttagtgtgtaaggtagttagttgttgtgtgttggttggttggtaaggagaagagtcgacggtcgggaacggaacgg

SEQ ID NO: 320076 - DNA, 579 bp, Homo sapiens
  misc_feature: GZ8MTXP01BQII6.19.67.G01.1.454.CMB.2.raw
  modified_base (294)..(294): a, c, t, g, unknown or other
  misc_feature (294)..(294): n is a, c, g, or t
tcagtactctcgtgcacgaccggtgctcgatttagagtatacatattgggtttggggggtagctcaggaagcagagcctggagcatctccactatggcctgggctccactacttctcaccctcctcgctcactgcacaggttcttgggccaactttatgctgactcagccccactctgtgtcggagtcgtccggggaagacggtaaccatcttttgcacccacaacagtggcaacattgccagctaattttgtgcagtggtaccagcagcgcccgggcacgtccccaccattgngatctatgagataatacaaagccgtcgtcggggtccctgtacttcggtctcgtcggctcagtcgacaacgcctcctccaactctcgccctccctcaccctatctctggactgaagctaggacggacgaggctgactacgtacgtgtctgttcttagtgtaactcggccggtcggtctagttcgggtcggttcgttcggggacgggacggggttaccagggtcgcggttacccgttcgtaacgggtccgaaccggcccgacgggccctccggttcccccgttcggg

SEQ ID NO: 320077 - DNA, 550 bp, Homo sapiens
  misc_feature: GZ8MTXP01E2C10.19.67.G01.1.454.CMB.2.raw
  modified_base (364)..(364): a, c, t, g, unknown or other
  misc_feature (364)..(364): n is a, c, g, or t
  modified_base (423)..(423): a, c, t, g, unknown or other
  misc_feature (423)..(423): n is a, c, g, or t
  modified_base (438)..(438): a, c, t, g, unknown or other
  misc_feature (438)..(438): n is a, c, g, or t
  modified_base (447)..(447): a, c, t, g, unknown or other
  misc_feature (447)..(447): n is a, c, g, or t
  modified_base (515)..(515): a, c, t, g, unknown or other
  misc_feature (515)..(515): n is a, c, g, or t
  modified_base (519)..(519): a, c, t, g, unknown or other
  misc_feature (519)..(519): n is a, c, g, or t
  modified_base (524)..(524): a, c, t, g, unknown or other
  misc_feature (524)..(524): n is a, c, g, or t
  modified_base (537)..(537): a, c, t, g, unknown or other
  misc_feature (537)..(537): n is a, c, g, or t
tcagtactctcgtgcacgaccggtgctcgatttagagtatacatattgggtttgggggggagaggagcccagcactgggattccgaggtgcttccattcggtgctcagcactgaacacagaggactcaccatggagtttgctgacctgggttttcctgctgcaatttcaggaggtgtccagtgtgaggtgcaacgtggtggagactgggcggaggcttggtccaggccgtggggcgtctcgtgagactgtcctgtcgaaccctcgtgggggtctccgtcagcagcgactgtatcgcctggtccgcaggctccgagggaagaggccggagtgggtcgctaggttattttagaggtcgggacgtanagttcgtacggaagactcgagtgggagggccgattcacatctacagacgtactttctanaacgaacacacgttntctacttanaaatcgaaacagccgtaggacgggccgaaggacgacggccgtatattatggtgtgagtagtttaacgnggangttgngtggagaagagancgtcgcgggaacg

SEQ ID NO: 320078 - DNA, 597 bp, Homo sapiens
  misc_feature: GZ8MTXP01B3SJG.19.67.G01.1.454.CMB.2.raw
  modified_base (545)..(545): a, c, t, g, unknown or other
  misc_feature (545)..(545): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggagtgtccagtgtgaggtgcaacgtggtggagacgtgggcggaggcttggtccagccgtgggcggtctctgagactgtcctgtcgaaccctcgtggggtctccgtcagcagcgactgtattgcctgggtccgccaggctccgaggggaagaggccgggaggtgggtcgcgtaggttagtttttagtagggtgggaaccgactagttcgtacgggagtaacctacccaagtgggagggcccgatttccaccatcctccagagtactttctacaagaacacactgtctcttacaaatgaaacagtcccgtaggacgggaccgaggaccgacggccgttacttagtttattgtgtaaggtagttagttttaagnggcgtagttggcgttagggtgacgaagctcgacggtcggggccgaaccgggg

SEQ ID NO: 320079 - DNA, 791 bp, Homo sapiens
  misc_feature: GZ8MTXP01CCAJL.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtgggtgggagtacggtgggcggaggtcgttcggtccgacggtccggtggggtccggttctcgtggacgtacgtcgtccgtggtacccgtacccgtcggtcgggtcctccgtcgacgcgacgacgtacgtgttacgtcgtcccggtcgggtcccgaccggacggtccgtaccggaagggggaacggaccgggggaccgggtagggttcggggtccgtacggttaaggtttttagttttaggagggggtacgggtaacccgtaacgttacgtttaccggtaacgggtacgtaacccgtaccgtaagggtacggggaccggggtacccgttacgttacccaacgttacgtaccctaccgtaaggtaccttttactttcaacggaaacgtaaaccacttacgttcgtaccttacgtaactaaagtacgaacgtacggtacccggaggggaccccgggaccggaaccggtaccgccggggtacccttacttaagtttacggttggtggtaagtaggtttagtttaggcggtaacgtgttcggttcgttaggggaagacgtaagtacgccggttacgggtcgggaaccgggtaacccgg

SEQ ID NO: 320080 - DNA, 635 bp, Homo sapiens
  misc_feature: GZ8MTXP01BHF4X.19.67.G01.1.454.CMB.2.raw
  modified_base (181)..(181): a, c, t, g, unknown or other
  misc_feature (181)..(181): n is a, c, g, or t
  modified_base (256)..(256): a, c, t, g, unknown or other
  misc_feature (256)..(256): n is a, c, g, or t
  modified_base (273)..(273): a, c, t, g, unknown or other
  misc_feature (273)..(273): n is a, c, g, or t
  modified_base (297)..(297): a, c, t, g, unknown or other
  misc_feature (297)..(297): n is a, c, g, or t
  modified_base (312)..(312): a, c, t, g, unknown or other
  misc_feature (312)..(312): n is a, c, g, or t
  modified_base (325)..(325): a, c, t, g, unknown or other
  misc_feature (325)..(325): n is a, c, g, or t
  modified_base (347)..(347): a, c, t, g, unknown or other
  misc_feature (347)..(347): n is a, c, g, or t
  modified_base (349)..(349): a, c, t, g, unknown or other
  misc_feature (349)..(349): n is a, c, g, or t
  modified_base (360)..(360): a, c, t, g, unknown or other
  misc_feature (360)..(360): n is a, c, g, or t
  modified_base (383)..(383): a, c, t, g, unknown or other
  misc_feature (383)..(383): n is a, c, g, or t
  modified_base (421)..(421): a, c, t, g, unknown or other
  misc_feature (421)..(421): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttcctgctgcaatttcaggaggtntccagtgtgaggtgcaagtggtggagacgtgggcggaggcttggtccagcctggggcgtctctgagctgtcctgngaccctgtgggtctcgnagcagcgactgtatgccgtggccncaggctcgagggagnggcggagtgggcntaggtattttagacgggtggananttcaacggganctcagtcggagggcctatcaacntccacgagtacgtcttttcgactagaacctacgacttnttaccttacttaacaaagttacggaaacgtcgtacccgtaaggggacgggaccgaacgggaaccgtaccgggtcccgtttacgtaagttttgttgggttaggttaggttaaaggttacggtttttaaaggggtcgggttacggttggttcggggtaacgttagggggtaacgtaacggtacggttaacgttaaccgggaacggggttccggggg

SEQ ID NO: 320081 - DNA, 553 bp, Homo sapiens
  misc_feature: GZ8MTXP01CXPN9.19.67.G01.1.454.CMB.2.raw
  modified_base (508)..(508): a, c, t, g, unknown or other
  misc_feature (508)..(508): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtcgaaccctctgggggtctccgtcagcagcgactgtattgcctgggtccgccaggctccgagggaagaggccggagtgggtcgcaggttatttttagaggtgggacgacattcgtacggagaaccttcgaatgggagggcccgattcaccatctaccagtagacttttctcagaaacacaacctgtcttacttcaaattgaacaagcctgacgggccgaggacaggccgtctattattgtgtgagttagtttacgnggcgattggcttaggtgggatggatcgacgtggggccgaacgggg

SEQ ID NO: 320082 - DNA, 689 bp, Homo sapiens
  misc_feature: GZ8MTXP01BJ2SO.19.67.G01.1.454.CMB.2.raw
  modified_base (620)..(620): a, c, t, g, unknown or other
  misc_feature (620)..(620): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtgggcggaggcttggtccaggccgtggggcggtctcgtgagactgtcctgtcgaccctcgtggggtctccgtcagcagcgactgtattcgccgtgggtcccgccaggcctccgaggggaaggacgggccgggaggtcggggtcgtcgtaggttatttttagagggttgggaaccgtactagttcgtaacgggacgtaaaccgtcccaagtcggggacggggacccgtagtttaccaaccgtacttcccgtacccgaagtaacggttaccttttcaccgaagaaacctactactgttaccttacttaaccaaattacgaaacgtaggtaccccgtagggacggggaccggacgggaccgaccggtaccggttacttagtttagttggttggtaaggtaagttaggtttaagngggtcggtaagttcgggcgttggggtggacgaaggtacgtcgacggtcgggggaaccgtaacccggggg

SEQ ID NO: 320083 - DNA, 624 bp, Homo sapiens
  misc_feature: GZ8MTXP01ALHA8.19.67.G01.1.454.CMB.2.raw
  modified_base (559)..(559): a, c, t, g, unknown or other
  misc_feature (559)..(559): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgcaactggtggagactgggcggaggcttggtccaggccgtggggcggtctcgtgagactgtcctgtcgaaccctcgtggggtctccgtcagcagcgactgtattgccgtgggtcccgccgaggccgtccgaaggggaaggacgggccggaggtgggtcgcgtaggttattttagagggtggaccgactattcgtacggagaactccgaagtgggagggccgattccgaccatcctaccagtacgtactttctacaagaacactactgtccttacttacaaatcgaaacgacgccgtagggacggggacccgacggaccgaccgggtaccgtcttaagtttagtgttggtggtaaggttagtttagngggtacgtaggttgggcgttgggtggacgaagtacgtcgacgggtcgggggcccgtaaccggggg

SEQ ID NO: 320084 - DNA, 577 bp, Homo sapiens
  misc_feature: GZ8MTXP01CJMUI.19.67.G01.1.454.CMB.2.raw
  modified_base (448)..(448): a, c, t, g, unknown or other
  misc_feature (448)..(448): n is a, c, g, or t
  modified_base (462)..(462): a, c, t, g, unknown or other
  misc_feature (462)..(462): n is a, c, g, or t
  modified_base (478)..(478): a, c, t, g, unknown or other
  misc_feature (478)..(478): n is a, c, g, or t
  modified_base (530)..(530): a, c, t, g, unknown or other
  misc_feature (530)..(530): n is a, c, g, or t
  modified_base (555)..(555): a, c, t, g, unknown or other
  misc_feature (555)..(555): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagccgtggggcggtctctgagactgtcctgtcgaccctgtggggtctccgtcagcagcgactgtattgccgtgggtccgccgaggcctccgaggggaaggaggccgggaggtggggtcgcgtaggttattttagtagggtggacccgtatagttcgtaacggagaaaccttcccgaagtggggagggtcccgtattccacctactctaccagtagtacttttnacagaaacacactntcttctacaatgaacncgcctggacggccgaggacgcggtcgtctattatgtgtgtagttagtttagnggtgtgttggcgttgggtgagaagngtcgacggtcgggccgaacggg

SEQ ID NO: 320085 - DNA, 721 bp, Homo sapiens
  misc_feature: GZ8MTXP01C5IS9.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtgggtggagacgtgggcggaggcttggtccagccgtggggcgtctcgtgagactgtcctgtcgaaccctcgtgggtctccgtcagcagcgactgtatcgccgtgggtcccgcgacggctccgaggggaaggaggccggagtcgggtcgcgtaggttatttttagagggtagggaccgtactagttcgtacgggagaacctccgaagtcgggacgggcccgtaatttccgacctacttacctaccgtagtaacggttaccttttccgtacgtaagaaacctactacgttacgtaccttaccttaactaaacttacggaaacgtacggtaccgttagggaaccggggtccggaaacgggaccgtaccggggtacccgtttaccgttaagtttaacgtttgggttaggttggtaaggtttaaggtttaaggttcgggtacggtaaggttgggttcggttggggtaacggtaacgtaacggtactcgggttaacccggttcgggggaaccccgttaaaccccggggg

SEQ ID NO: 320086 - DNA, 615 bp, Homo sapiens
  misc_feature: GZ8MTXP01CVN90.19.67.G01.1.454.CMB.2.raw
  modified_base (354)..(354): a, c, t, g, unknown or other
  misc_feature (354)..(354): n is a, c, g, or t
  modified_base (384)..(384): a, c, t, g, unknown or other
  misc_feature (384)..(384): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgcaacgtggtggagacgtggcggaggcttggtccagccgtgggcggtctcgtgagactgtcctgtcgaccctcgtggggtctccgtcagcagcgactgtatgcctgggtccgccaggctccgaggggagaggccggagtgggtcgcgtaggttattttagnggtggacgactattcgacggagaacctcgngtggggaacgggtcccgtaacttcgaaccctatcctaccagtacgtacttttcacaagaacactactgtaccttctaactaaatgaaacgtacgaccgtgggaacgggaccgaggacccgacgggtcccgttactattagttgtggtaagagttagtttagcgggtgtagttgggcgttaggggtgaacgtaaggactacggaaccgttcgggggcccgtaaacccggggg

SEQ ID NO: 320087 - DNA, 671 bp, Homo sapiens
  misc_feature: GZ8MTXP01ALBK7.19.67.G01.1.454.CMB.2.raw
  modified_base (310)..(310): a, c, t, g, unknown or other
  misc_feature (310)..(310): n is a, c, g, or t
  modified_base (532)..(532): a, c, t, g, unknown or other
  misc_feature (532)..(532): n is a, c, g, or t
  modified_base (604)..(604): a, c, t, g, unknown or other
  misc_feature (604)..(604): n is a, c, g, or t
  modified_base (635)..(635): a, c, t, g, unknown or other
  misc_feature (635)..(635): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgcaacgtggtggagacgtgggcggaggcttggtccagccgtgggcggtctcgtgagactgtcctgtcgaaccctcgtggggtctccgtcagcagcgactgtattgccgtgggtcccnccgaggcctaccgaggggaacgaggggcccgggagtgggggtcgacgtaggtttaagttttttagaggggtgggaaccctactagtttccgaacggggacgaaccgttcccgaaggttggggaacggggccgtacgtttccaccgtattccgttacccaaggtacgttaccttttactaccaagaaacctacacttgttccttacttacaaattcgaaacgnggacccgttggaacgggacccgagggaccacggtaccctagtatttagttggtagttggaagttagtttagngggtacgtaagttcgggcgttagggtgacgngtaacgtccgttacggtaacggggccctaacggggg

SEQ ID NO: 320088 - DNA, 628 bp, Homo sapiens
  misc_feature: GZ8MTXP01EEZII.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtgggcggaggcttggtccagccgtggggcggtctctgagactgtcctgtcgaaccctcgtggggtctccgtcagcagcgactgtatcgccgtgggtccgccgaggctccgagggggaagagggccgggaggtcgggtcgcgtaggtttattttagagggtgggaccgactagttcgtacggacgaactccgaagttgggacgggccgtagttccaccgtattcctcccagtacgttacttttctacaagaaacactactcgtacttacttacaaatgaacgacgtaccgtagggacgggaccgaaggaccgtaccgggccgttacgttatttagttggtgtaaggtagttagtttagttggcgtagttgggcgttgggtggtacaaggtatcggacgttcggggaaccgtaaccggggg

SEQ ID NO: 320089 - DNA, 625 bp, Homo sapiens
  misc_feature: GZ8MTXP01BN0EK.19.67.G01.1.454.CMB.2.raw
  modified_base (531)..(531): a, c, t, g, unknown or other
  misc_feature (531)..(531): n is a, c, g, or t
  modified_base (563)..(563): a, c, t, g, unknown or other
  misc_feature (563)..(563): n is a, c, g, or t
  modified_base (567)..(567): a, c, t, g, unknown or other
  misc_feature (567)..(567): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtgggcggaggcttggtccagccgtggggcggtctctgagactgtcctgtcgaaccctcgtggggtctccgtcagcagcgactgtattcgccgtgggtccgccaggctccgaggggaagacggccggaggtgggtcgcgtaggttatttttagagggtgggaccgactagttcgtacggagaaccttccgaagtgggacgggtccgtattccgaacctatcctacccaagtacgtacttttcacgaagaaaccactacttcgtaccttcttacaaattgaaacgaggtaccctggacgggaccgaaggaccgacggacccgttntaagttgttaggtgtggtaagttaggtttagngggngtagttggcgttgggtaaggacgaagtactcgaacggtcgggggaaccgtaaccgggg

SEQ ID NO: 320090 - DNA, 643 bp, Homo sapiens
  misc_feature: GZ8MTXP01A8TVG.19.67.G01.1.454.CMB.2.raw
  modified_base (339)..(339): a, c, t, g, unknown or other
  misc_feature (339)..(339): n is a, c, g, or t
  modified_base (565)..(565): a, c, t, g, unknown or other
  misc_feature (565)..(565): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgcaacgtgggtggagacgtgggcggaggtcttggtccagccgtggggcggtctcgtgagtactgtcctgtcgaccctcgtggggtctcgtcagcagcgactgtatgcctcgggtccgcaggctcgagggagaggcggagtgggcgngtaggttagttttagagggtgggaccgtacgtagttcgtacggagtaacctccgaagtgggacgggtccgattccgacctatcctccagtacgtactttcgacagaaccactacgttcgtacttctaactaaatcggaaactacggtccgtaggaccggggaccggtacggaccgtaaccgggtccgttcgtaatttaagttgtgtaaggtaggttaggttttagngggtaccgtaggttcggggttcttggggcggtacgaacgaacgttcggaacgggttcggggaacccgtaaaccggggg

SEQ ID NO: 320091 - DNA, 690 bp, Homo sapiens
  misc_feature: GZ8MTXP01BJKN8.19.67.G01.1.454.CMB.2.raw
  modified_base (344)..(344): a, c, t, g, unknown or other
  misc_feature (344)..(344): n is a, c, g, or t
  modified_base (368)..(368): a, c, t, g, unknown or other
  misc_feature (368)..(368): n is a, c, g, or t
  modified_base (374)..(374): a, c, t, g, unknown or other
  misc_feature (374)..(374): n is a, c, g, or t
tcagtactctcgtgcacgaccggtgctcgatttagagtatacatattgggtttggggggtagctcaggaagcagagcctggagcatctccactatggcctgggctccactacttctcaccctcctcgctcactgcacaggttcttgggccaactttatgctgactcagccccatctgtgtcggagtctccggggaagacggtaccatctttgcacccacaacagtggcaacattgccagctaattttgtgcagtggtaccagcacgcgcccgggcacgttcccccactatgtgatctatgaggataatcaaaggtaccgtcgtcgggggtcctgacttcggttntcgtcgctcatcgacaacgctccncactcncgccctccctcaccacgttctcgttacggaccttggaaacgtaccgtgggaacgggaacggcgggttactcggtaaactttacctaacgttggttacctaacggtttactttaatcggtaaacgttacgggacccccgggtggttaccgtaacggtttggggttacgggggtttaacccggttcggggggttaccggggtaaaccgggggacccgtaaacgggtcccgttacgggttaccccggttaccggtaacggggtaccaacgggtacccccgaagggggttccctccccgggttaacccccgttcccgggg

SEQ ID NO: 320092 - DNA, 781 bp, Homo sapiens
  misc_feature: GZ8MTXP01EZF8F.19.67.G01.1.454.CMB.2.raw
  modified_base (189)..(189): a, c, t, g, unknown or other
  misc_feature (189)..(189): n is a, c, g, or t
  modified_base (193)..(193): a, c, t, g, unknown or other
  misc_feature (193)..(193): n is a, c, g, or t
  modified_base (213)..(213): a, c, t, g, unknown or other
  misc_feature (213)..(213): n is a, c, g, or t
  modified_base (221)..(221): a, c, t, g, unknown or other
  misc_feature (221)..(221): n is a, c, g, or t
  modified_base (318)..(318): a, c, t, g, unknown or other
  misc_feature (318)..(318): n is a, c, g, or t
  modified_base (432)..(432): a, c, t, g, unknown or other
  misc_feature (432)..(432): n is a, c, g, or t
  modified_base (532)..(532): a, c, t, g, unknown or other
  misc_feature (532)..(532): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctcggttttccttgctgcaatttcaggaggtgtccagtnaagnggtgcaactggtgcagtggnggcgtcgnttggtccgacgccgtgggtcggtctcgtgagactcgtctgtcgaccctcgtgggtcgtccgtcacgcagcgactgtattcgtccgtcggtccgccgncgacggacgtacgagggacggacggtcgggtacggtcggtcggtaccgttaggtttagtttaggtacgggtacggtaacgtactaacgtacgtaccgtacgtacgtaccgacgntaggtaccgggacccggtaacgttacccgtacccaacgtaccgaacccgttaacgtaacgttaaccgtttaaccctaaccgaaccgtaaccgtaacccgnaaccttaccgttaaccgttaaccgtttaaaccgtaaaaccgtaaccggtaaaccggtaaccgggtacccgggtaaccgggtaaccgggggtaaccccggggtaaacccgggtaacccggttaaacccgggttacccggtttaaccggtttaaacggtttccttgggttacgggttaagggttaacgggtaaacgggtttaaacggttacgggtacgggttacggttaacggggttaaccggtaacgggg

SEQ ID NO: 320093 - DNA, 739 bp, Homo sapiens
  misc_feature: GZ8MTXP01CPR1O.19.67.G01.1.454.CMB.2.raw
  modified_base (306)..(306): a, c, t, g, unknown or other
  misc_feature (306)..(306): n is a, c, g, or t
  modified_base (330)..(330): a, c, t, g, unknown or other
  misc_feature (330)..(330): n is a, c, g, or t
  modified_base (416)..(416): a, c, t, g, unknown or other
  misc_feature (416)..(416): n is a, c, g, or t
  modified_base (640)..(640): a, c, t, g, unknown or other
  misc_feature (640)..(640): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagtttggctgaccttgggttttccttgctgctaatttcgaggaggtgtccagtgtgaggtgcaacgtggtggagacgtggcggaggcttggccagccgtggggcgtctcgtgagactgtcctgtcgaccctgtggggtctcgtcagcagcgatgtattcgccgtgggtcccnccgaggcctccggaggggaacggnggccgggaggttcggggtcgcgtaaggtttatttttaggagggtagggaaccctatacgtttcgtaacgggacgtaaccgtaccgngtcggggaacgggtcccgtattacccaacctattaccgtacccgtaaggtactttacgttttcacaagtaaacctacgtaacgttcttaccttacttaacaaagttacgaaaccggtacggtacccgttagggaaccggggacccgaaacgggacccggtaacggttaccccggttattaagtttaagttgggtcggttaaggtaaaggttaggttttaacggngggttaaccggtaggtttcggggcgtttagggggtaacgggaactaacgggttacttccgggacgggttaaccgggggaacccggttaaaccccggggg

SEQ ID NO: 320094 - DNA, 712 bp, Homo sapiens
  misc_feature: GZ8MTXP01DMO2Y.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgcaacgtggtggagacgtgggcggaggtcttggtccagccgtggggcgtctcgtgagtctgtcctgtcgaaccctcgtcgggtctcgtcagcagcgactgtatgccgtgggtccgcgaggctccgaggggaaggaggccgggtaggtgggtcgtcgtaggtttagttttagtaggggtagggtaacccgactaagtttcgtaacgggacgtaaaccttccgtaaggtcggggaacgggacccgtaacgttccaacccgtatccctaccgaagtaacggttacttttccgtacaacgaaacctactaacttcgtaccttaccttaacaaaacttacgaaaccgtacggtacccggtaggaacgggggacccgacggggtaaccgtaccgggtacccgttcgttaatttagttggttggtaaggtagttaggtttaagcgggtacgtggttaggttcgggttagggtaagggaacaacggtaagttccggacggggtcggggaacccggtaaacccggggg

SEQ ID NO: 320095 - DNA, 632 bp, Homo sapiens
  misc_feature: GZ8MTXP01ADBPS.19.67.G01.1.454.CMB.2.raw
  modified_base (223)..(223): a, c, t, g, unknown or other
  misc_feature (223)..(223): n is a, c, g, or t
  modified_base (251)..(251): a, c, t, g, unknown or other
  misc_feature (251)..(251): n is a, c, g, or t
  modified_base (394)..(394): a, c, t, g, unknown or other
  misc_feature (394)..(394): n is a, c, g, or t
  modified_base (434)..(434): a, c, t, g, unknown or other
  misc_feature (434)..(434): n is a, c, g, or t
tcagtactctcgtgcacgaccggtgctcgatttagagtatacatattgggtttggggggtagctcaggaagcagagcctggagcatctccactatggcctgggctccactacttctcaccctcctcgctcactgcacaggttcttgggccaactttatgctgactcagccccactctgtgtcggagtcgtccggggaagacggtaaccattctttgcacccanaacagtgcaacattgcagctaattttgngcagtggtaccagcagccgcccgggctaccgttcccccactattgtgaatctatgaaggaataatacgaaacgtccgtcgtcgggggtccctgtattcggttctcgtcggctcatcgacaacgtcctcctaccaacttctccncccttcccacacctattcctcgtggaactaggaagtacgnggaacggacgacggtctaacgtaccttaactacggtgtacgtacgttcttaagtgtaacgcggtcccggtcggttactgttcgggtcgggttccggtccgggaacgggggtaccggaacgtaacgtccgttacggttacccgttcggtaaccggtacgaaccgacccgaacgggcccttaacccggcccccgttccgg

SEQ ID NO: 320096 - DNA, 720 bp, Homo sapiens
  misc_feature: GZ8MTXP01DPN7W.19.67.G01.1.454.CMB.2.raw
  modified_base (648)..(648): a, c, t, g, unknown or other
  misc_feature (648)..(648): n is a, c, g, or t
  modified_base (683)..(683): a, c, t, g, unknown or other
  misc_feature (683)..(683): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgctaatttcaggaggtgtccagtgtgaggtgcaacgtggtggagacgtgggcggaggcttggtccagccgtgggcggtctcgtgagactgtcctgtcgaccctgtgggtctcgtcagcagcgactgtatcgccgtgggtcccgccgaggcctaccggaagggggaaggacggggccgggaggttcgggggtacgtacggttaaggttttaagttttttaaggagggggtacggggtaacccgtaacgtacgtttaccggtaacgggacgtaaacccgttcccgaagggtcggggaaccggggtccctaaacttcccgaaccctatcccgtaccgtagtaacgttaccttttacgacgtaaacgaacctactacttcgttacttacttaacaaagtacgaaacgtacggtccgtagggaaccggggaccgaacggaccgtaccggtaccgttacttaagttagtgtggtaagtagttagtttagnggtacgtagttcgggttcgttgggtaacggtaacnggtacgtcggaccgggtcggggaacccgtaaccgggg

SEQ ID NO: 320097 - DNA, 680 bp, Homo sapiens
  misc_feature: GZ8MTXP01CQ5PX.19.67.G01.1.454.CMB.2.raw
  modified_base (612)..(612): a, c, t, g, unknown or other
  misc_feature (612)..(612): n is a, c, g, or t
  modified_base (627)..(627): a, c, t, g, unknown or other
  misc_feature (627)..(627): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtgggcgggaggcttggtccagccgtggggcggtctctgagactgtcctgtcgaaccctcgtggggtctcgtcagcagcgactgtattcgccgtgggtcccgccaggctccgagggaagaggccggaggtgggtcgcgtaggttattttagtaggtgggaccgtactagttcgtacggacgaactccgaagtgggacgggtacccgtagttccaaccgtatccgtacccgtaagaacgttacttttaccgacctaaacggaaacctaacctacttacggttaccttactttaacaaaagttacgaaaccgtaacggtacccgtagggaacggggaccggaacgggaaccgacgggtacccggttaccttaagttaagttggtggttaaggtaagttaggtttagngggacgtagttgggngttgggttaaggaacgtggtaacgtcgacggttcgggggccgtaaaccggggg

SEQ ID NO: 320098 - DNA, 641 bp, Homo sapiens
  misc_feature: GZ8MTXP01DHCJW.19.67.G01.1.454.CMB.2.raw
  modified_base (583)..(583): a, c, t, g, unknown or other
  misc_feature (583)..(583): n is a, c, g, or t
  modified_base (611)..(611): a, c, t, g, unknown or other
  misc_feature (611)..(611): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgcaacgtggtggagacgtgggcggaggcttggtccagccgtggggccggtctcgtgagactgtcctgtcgaacccgtcgtgggtctccgtcagcagcgactgtattcgccgtgggtcccgaccgaggcctaccgaagggggaaggacgggccgggtaggtcgggtcgcgtaggtttagtttttagagggtggaccgactagttcgtacggagaacctcgaagtggggacgggccgtataccaccactcctaccagtacgttactttacacaacgaacactacttgtaccttacttaacaaattacgaaacgaacgtccgtacgggacgggaccgaacggaccgacggtaccgttacttagtttagttgtggtaagtaagttagtttacgnggtcgtagttggttcgttaggtgaacgngtacgtcgacggtcgggccgtaacccgggg

SEQ ID NO: 320099 - DNA, 780 bp, Homo sapiens
  misc_feature: GZ8MTXP01AX80C.19.67.G01.1.454.CMB.2.raw
  modified_base (292)..(292): a, c, t, g, unknown or other
  misc_feature (292)..(292): n is a, c, g, or t
  modified_base (321)..(321): a, c, t, g, unknown or other
  misc_feature (321)..(321): n is a, c, g, or t
  modified_base (380)..(380): a, c, t, g, unknown or other
  misc_feature (380)..(380): n is a, c, g, or t
  modified_base (420)..(420): a, c, t, g, unknown or other
  misc_feature (420)..(420): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgcaacgtgggtggagacgtgggccgggaggtcttggtccaggtccgtggggcggtactcgtgagtactgtcctgtcgaacccgtgtcggggtctccgtnagcagcgactgtatcgccgtagggtcccncgaggcctaccggaaggggagacggccgggtagtcgggtcgacgtaggtttattttagnggtagggacccacgtgttccgtacgggagtaaacctccgngtaggggacggggtaccctattccaaaccattcccgtaccgtaacgtacggttacctttttaccaacgtaaaggaaccaactacttacggttaccttaccgtttaacaaaacgttcggaaacggttaacggccccggttaggggaacccgggggtaccggaaacgggacccgtaaaccgggttccccggttaactttaacggtttaatttacggggttggtaacgggtaaggtttacgggtttaaacggttgggtaacccggtaggttcgggggttcgttcgggggttaaggggaaccttaaggaaaccggtccggttaccggggtaaccgggggttaacccggtaaaacccccgggggg

SEQ ID NO: 320100 - DNA, 863 bp, Homo sapiens
  misc_feature: GZ8MTXP01AHK98.19.67.G01.1.454.CMB.2.raw
  modified_base (758)..(758): a, c, t, g, unknown or other
  misc_feature (758)..(758): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggtagttttggctgaccttgggttttccttgctgctaatttcaggaggtgtccagtgtgaggtgcaacgtgggtggagacgtgggcgggaggtcgttcggtccacggccgttggggcggttctcgtgagtactcgtcctggtaccgacccgtcgtcggggtctccgtcacgcagcgtacgtgtacgttcgcccggtcgggtcccgccgacgggtccgtaccggaagggggaacggcgggggcccggggtaggggttcgggggtcgtacgttaagggttttacgtttttaaggtacgggggttacggggaaccgtaccgttagtttaccggtaaaccggggtacgtaaacccttccggaagggttcggggaaccgggggtacccgttactttacccggaaacctacgttccccgtaccgtaaacggtaacggtttaccttttccgtaaccgaaacggtaaacctaccgtacgtttcgttaccttaccttaaacgaaacgttacggaaacgtaccggtacccggttacgggaaccggggtacccggaacgggaacccggtaaccgggttaccccgttagtttaaccgtttagttaggttggttaaggtaacggttaggttttaacggnggggtaccggtaagggttcggggttcgggttacggggtaacggtacggtaacggtacgtaccgggttaccggggttaaccgggggaacccggtaaaccccggggg

SEQ ID NO: 320101 - DNA, 889 bp, Homo sapiens
  misc_feature: GZ8MTXP01A0GFO.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtgggcggaggcgttggtccagccgtgggcgtctctgagtactgtcctgtcgacctcgtgggtctcgtcagcagcgactgtattcgccgtcgggtcccgccgacggcctaccggaagggggaaacggacgggggcccggggtaggttcgggggtaccgtacggttaaggggttttaagttttttaaggagggggttacggggtaacccgtaacgtagttttaccggtaacggggaacgtaaacccgttacccgaaggttacgggggaacggggtacccggttaaacttcccgaaccccgtacgttaccccgtacccgtaaacggtaacggtttaccctttttaccgtaaaccgtaaacggtaaaaccctaaccgttaaccgtttacggttaacccttaaccgtttaaacgtaaaaacgttacggaaaacccggtaacgggtacccggttaaggggaacccgggggtaaccgaacggggtaacccggaacccgggttacccggtttaacgtttaaagtttaaccggtttgggttaacgggttaaggtaaagggtttaacgggtttttaaaggttcggggtaccgggttaagttcgggggttccggttaggggttaacgggtaacgtaaggtacggttaccgttaaccgggggtcgggggttaaccccgggtaaacccggggg

SEQ ID NO: 320102 - DNA, 892 bp, Homo sapiens
  misc_feature: GZ8MTXP01BM58M.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgcaacgtggtggagacgtgggcggaggtcttggtccaggccgtggggcggtctcgtgagctcgtcctggtcgacccgtcgtcggggtctccgtcagcagcgactgtacttcggccgtgggtccccgccgacgggccgtaccggaagggggaacggacgggggccgggtagggtcgggggtacggtacgttagggtttaagttttttaaggtaggggttacggggtaacccgtacgttacgtttacccggtaacggggtaacgtaaacccgttacccgaagggttacggggaaaccgggggtcccgtaacgttacccgaaacccgtaacttacccgtacccgtaaaggttaaccggtttaaccctttttaccgtaaccgaaacggtaaaacccctaaccgttaaccgtttacggttaccctttaccgtttaaacctaaaaacgtttaccggaaaaccggtacgggtacccggttaacgggggaaccgggggtacccgggaaaccggggtaacccggtaccggggttaacccgttacgtttaaacgttttaaggttcgggttaggttaagggtaaggtttaaaggttttaagggttcggggtaccggtaagggttcgggttccgggttaggggttaaggaaccggtaaggttacgtaccggaccggggttaaccgggggaaccccggttaaaacccggggg

SEQ ID NO: 320103 - DNA, 645 bp, Homo sapiens
  misc_feature: GZ8MTXP01CHCY4.19.67.G01.1.454.CMB.2.raw
  modified_base (249)..(249): a, c, t, g, unknown or other
  misc_feature (249)..(249): n is a, c, g, or t
  modified_base (293)..(293): a, c, t, g, unknown or other
  misc_feature (293)..(293): n is a, c, g, or t
tcagtactctcgtgcacgaccggtgctcgatttagagtatacatattgggtttggggggtagctcaggaagcagagcctggagcatctccactatggcctgggctccactacttctcaccctcctcgctcactgcacaggttcttgggccaactttatgctgactcagccccactctgtgtcggagtctccggggaagacggtaaccatctttgcaccacaacagtgcaacattgccagctaattttgngcagtggtaccagcagcgcccgggcacgttcccccactattcgngatctatgaaggtataaatacaaacgaccgtcgtacgggggtccctgacttcggttctcgtcggacctcatcgacaacgtcctccacctaacctctcgccctccctcacctactcgtctagggtactaggaaacgctaggaacggacgaggtctacgacttaacctctggttactagttacttagtcgaagttacgccggcgttactagttcggttcgggttccggttacggggacggggtacgggaacccgtaaacgggtcgttaccgggttcccgttaccggttaacgggtcccgtaacccgggaccccgaacggggttccccttccccgggccccccggtttccccggg

SEQ ID NO: 320104 - DNA, 639 bp, Homo sapiens
  misc_feature: GZ8MTXP01CALSI.19.67.G01.1.454.CMB.2.raw
  modified_base (400)..(400): a, c, t, g, unknown or other
  misc_feature (400)..(400): n is a, c, g, or t
  modified_base (449)..(449): a, c, t, g, unknown or other
  misc_feature (449)..(449): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgctaatttcaggaggtgtccagtgtgaggtgcaacgtggtggagacgtgggcggaggcttggtccaggccgtgggcggtctcgtgagactgtcctgtcgaacccgtcgtcggggtctccgtcagcagcgactgtattcgccgtggtccgccgaggctccgaggggaagacggcggaggtgggtcgcgtaggttattttagagggtgggaccatagttcgtaacggagaacctccgngtgggagggccgtatccactatcctccagtagtacttttcacagaaacncaacttcgtctcttacaaatcgaaacagcccgtggaacggggccgaacgggaccgacgggtacccgttacttaagtttagtttgggtggttggtaagttaggtttaagttcgggtaggtagttgggttcgttggggtggaccgtaaggtactcgggttaccggttcgggggaacccgttaaacccggggg

SEQ ID NO: 320105 - DNA, 846 bp, Homo sapiens
  misc_feature: GZ8MTXP01BG2Z4.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgctaatttcgaggaggtgtccaggtgtgaggtgcaacgtggtggagacgtgggcggaggcttggtccaggccgtgggcggtctctgagactgtcctgtcgacccgtcgtcggggtctccgtcagcagcgactgtattcgccgtcgggtcccgccgaggcctaccggaaggggaacggacgggtccgggaggtcgggggtacggtacgttaagggtttaagttttttaaggaggggttacggggaacccgtaacgttacgtttaccggtaaacggggtacgtaaacccgttcccgaagggtcgggggtaaccggggcccgtaactttacccgaacccgtagttacccctacccgtaaaggtaacggtttaaccctttttaccgaaccgtaaacgtaaaccctaccttaccgttacggttccttaaccttaacctaaaagttaccggaaacggtacggtacccggttacggggaaccgggggacccggaaagggacccgtaaccgggtacccgttacgttagtttaagtttgggttaagggtggttaaacgggttagggttttacggttacggggtacggttaagggttcggggttacggttaggggttaacgggaaaccggtaaggtaacggttacccgggaaaccggggttccggggggaaccccggttaaaccccgggggg

SEQ ID NO: 320106 - DNA, 766 bp, Homo sapiens
  misc_feature: GZ8MTXP01ED591.19.67.G01.1.454.CMB.2.raw
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctggcgggacatcgtgatcgacccagtacccagactcactggctgtgtctcgtgggcgagaccgaccaacaatcaactgcacggtccagaccaagtaacttacttttccaccacctaccaaaagtaaacctaaaaactttctaacgccctaggtaaccaaacgacgaacgaccgaaggaccacgtccctactaagttcacttacttacgttttacgtcgggtacctttacgaccggcgtaccggttaacggttcccgggggtcccctacggaaccccccggtcggttccgggggctaggggtccggggttacgtacgggaactagttacgtttcccaccttcctaccaacctataccgacgcctacgccctaggaccgtagggtactaaggaacgtagttcgggtacggtactttaaggtttttacttacgttggtacaagttactttaaacgtttttacttttttccgtaacgttcccgttaccgggtacggttaccggttccgggaaccggtaaacggggttaccggtaagggggttaaacgaaaccgttaccggaaacggaaccggttacggtttggtacgggtccttaggaccccttaaccgttaacgtttccggtttaacg

SEQ ID NO: 320107 - DNA, 764 bp, Homo sapiens
  misc_feature: GZ8MTXP01C4TKD.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtggcggaggcttggtccagcctgggcggtctctgagactgtcctgtcgaaccctcgtggggtctccgtcagcagcgactgtattgccgtgggtccgccaggctccgaggggaagagggccgggaggtggggtcgcgtaggttatttttagagggtgggaccgacattcgtaacggagtaaacccgtccaagtgggacggggcccggtactttccgaacccatccctccgaagtaacggtaacttttcttacaacggtaaactacctaacgtttctaccttacttacctaaaagttcgaaaaccggtaacggtccccgttaagggaccggggggtaccccggtaaacggggacccgtaaccgggggtaccccggttaacctttaaacggttttaagtttaggttggggttaaggtaaggttaagggttttttaggttaggggtaccgggtaaggttaccgggggttcggtttgggggtttaacggggaaaccgtaagggtaaccggttacggttaacccggggttaacggggggccccggttaaaaccccgggggg

SEQ ID NO: 320108 - DNA, 687 bp, Homo sapiens
  misc_feature: GZ8MTXP01DHYUS.19.67.G01.1.454.CMB.2.raw
  modified_base (374)..(374): a, c, t, g, unknown or other
  misc_feature (374)..(374): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtggaggtgcaacgtggtggagacgtgggcggaggcttggtccaggccgtgggcggtctcgtgagactgtcctgtcgaacccgtcgtgggtctccgtcagcagcgactgtattcggccgtcgggtcccgcgacggcctaccggaggggaagacggggccggaggtgggtcgacgtaggtttattttagnggtagggaacccacgtagttcgaacggacgaacctccgaaggtcgggacgggccctagttccaaccgtactcctccgaagtacttaccgtttctacctaaagaaacactacttacgttaccttacttaacaaagttacgaaacggacggtcccgtagggaaccggggccgaaacgggaccgtaaccgggacccgtttaacgttagttttaaggttggttaggttaaggtaaggttagttttaggaggcgtagttgggttcgttgggtggaacgaaggacgttacggacgggtcgggttaaccgtaacccgggg

SEQ ID NO: 320109 - DNA, 571 bp, Homo sapiens
  misc_feature: GZ8MTXP01E46DC.19.67.G01.1.454.CMB.2.raw
  modified_base (228)..(228): a, c, t, g, unknown or other
  misc_feature (228)..(228): n is a, c, g, or t
  modified_base (312)..(312): a, c, t, g, unknown or other
  misc_feature (312)..(312): n is a, c, g, or t
  modified_base (374)..(374): a, c, t, g, unknown or other
  misc_feature (374)..(374): n is a, c, g, or t
  modified_base (391)..(391): a, c, t, g, unknown or other
  misc_feature (391)..(391): n is a, c, g, or t
tcagtactctcgtgcacgaccggtgctcgatttagagtatacatattgggtttggggggtagctcaggaagcagagcctggagcatctccactatggcctgggctccactacttctcaccctcctcgctcactgcacaggttcttgggccaactttatgctgactcacgccccactctgtgtcggagtcgtccggggaagacggtaaccattcttttgcacccacaanagtggcaacattgccagctaattttgtgcagtggtaccagcagcgcccgggcacgttcccccactatgtgatctatgagataanacaaagaccgtgtcggggtcctgacgttcggttctcgtcggcctcatcgacaacgcctcccncaactctcgccctcccncacccatctcgtggactagaacgacgtaggaggacgagcgtactactactacgttgtactagttctatgtaagtaccggccgtacggtctagtggtggtaacgttcgggacgggacggacgaacgtcgttacgccgttccgtaaggctaacgcccgaacggcctaacccgccccgtccgg

SEQ ID NO: 320110 - DNA, 632 bp, Homo sapiens
  misc_feature: GZ8MTXP01C7A8Q.19.67.G01.1.454.CMB.2.raw
  modified_base (512)..(512): a, c, t, g, unknown or other
  misc_feature (512)..(512): n is a, c, g, or t
  modified_base (574)..(574): a, c, t, g, unknown or other
  misc_feature (574)..(574): n is a, c, g, or t
  modified_base (599)..(599): a, c, t, g, unknown or other
  misc_feature (599)..(599): n is a, c, g, or t
tcagtactctcgtgcacgaccggtgctcgatttagagtatacatattggggtttgggggggagaggagcccagcactgggattccgaggtgtttccattcggtgcccagcactgaacacagaggactcaccatggagttttggctgaccttgggtttttccttgctgcaatttcgaggaggtgtccagtgtgaggtgcaagtggtggagacgtggcgggaggcttggtccaggccgtgggcgtctctgagactgtcctgtacgaccctcgtgggtctccgtcagcagcgactgtatcggccgtcggtccgccgaggccgtaccgaaggggaacggacgggccggaggtgggtcgacgtaggtttagtttttagagggtgggaacgtacgtagttcgtaacggatacctaacccgagttcgggggaacgggtccggtaacttaccaaccgacttcacccgagttacgtacttttctacaagtaacactactgtcctacttacaaactgaaacncggtacgtggacggaccgtaggaccgacggtccgtattagttagtgtgtgtaagttgttagngagagtggcgttggttagaacgagntcgacgggttcggaacgttaaccgggtaacccg

SEQ ID NO: 320111 - DNA, 726 bp, Homo sapiens
  misc_feature: GZ8MTXP01BIEBS.19.67.G01.1.454.CMB.2.raw
  modified_base (657)..(657): a, c, t, g, unknown or other
  misc_feature (657)..(657): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgctaatttcaggaggtgtccagtgtgaggtgcaacgtggtggagacgtgggcggaggcttgggtccaggccgtgggcgtctcgtgagactgtcctgtcgaccctcgtcgggtctccgtcagcagcgtactgtagttcgtccgtcgggtacccgccgtaggccgtaccggaaggggaacggacggggccgggtaggtcggggtcgtacgttaaggtttagtttttaaggtagggtacgggtaaccgtacgtaagttcgtaacggaacgtaacctaccgtaaggtcggggacgggtacccgtaacgttccgcccgtacttcctaccgtacgtaacggttactttcgttacgaacgaaacctacctaacgttcgttacttaccttaacgtaaacgtacgaaacggtacgtacccggtagggaccggggaccggaaccgggtaccgtaccgggtacccgtttactaagtttagttggtggtaaggtagttagttagngggtacgtagttgggttcgttgggtaagacgtaacggtaactcggacggtcggggaaccgtaaccgggg

SEQ ID NO: 320112 - DNA, 814 bp, Homo sapiens
  misc_feature: GZ8MTXP01AOZTE.19.67.G01.1.454.CMB.2.raw
  modified_base (236)..(236): a, c, t, g, unknown or other
  misc_feature (236)..(236): n is a, c, g, or t
  modified_base (242)..(242): a, c, t, g, unknown or other
  misc_feature (242)..(242): n is a, c, g, or t
  modified_base (282)..(282): a, c, t, g, unknown or other
  misc_feature (282)..(282): n is a, c, g, or t
  modified_base (326)..(326): a, c, t, g, unknown or other
  misc_feature (326)..(326): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctggcggggacatcgtgatgacccagtacccagactcactggctgtgtctcgtgggcgagacggccaacaatcaactgcaggtccagccagaactntttccnccacctacaaagaactaaaacttctagccaggtaaccaanagagaccaggacagtccctactaaagttgactactactttacgngggtcctttccgaacgcgacgtaaacgttccgggggtccccttcggaaaccccggtacggttcccgggggactaacggggtccggggtttaacccgtagggggaacctaaagggttacttttacccgaaccttccgtaaccaaccccgtaaattccgaaaggcccgtaaacgggccccttggacggaaaccggggttacgtaaggtaaacggttcgttacgggtaacggttaacgtttaaacggttttaaccggttaacgttacgggtaaaccgtaaacggtttaactttaaaacgttttttaccgtttttaccgttaacccggtttccccgggttaccgggttaaaccggggttacccggttaaccggggaaacccgggtaaacggggttaccggtaaaggggttaacgtaaaacgtaccggaaacggttaccggttaacgttcgggtacggtaaccgttcgacccttaaccgtcgttcccgttaag

SEQ ID NO: 320113 - DNA, 697 bp, Homo sapiens
  misc_feature: GZ8MTXP01CJWQJ.19.67.G01.1.454.CMB.2.raw
  modified_base (282)..(282): a, c, t, g, unknown or other
  misc_feature (282)..(282): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgcaacgtggtggagacgtgggccggaggtctttggtccagccgtggggcggtctctgagactgtcctgtcgaccctgtgggtctccgtnagcagcgactgtattcgccgtgggtcccgccaggctccgaggggaagacggccggaggtgggtcgcgtaggtttagtttttagagggttgggaaccgtacgtagtttacgtacggacgaaccttccgaagtcgggacgggcccgtattccgaacctatcctccaagtacgtacttttcacgtaacgaacctacaacttgtcctacttaacaaattcgaaacgtcggtacccgtacgggaacggggaccccgaaggacccgtaacccgggtcccgttgttaacgttttaagtttggtggttaaggttaaggttacgtttttagggacgggtacggtacggttcgggttcggttacggggtaacgacggtaacggtcgtacgggttaccgggttcccgggggaacccgtaaccgggg

SEQ ID NO: 320114 - DNA, 617 bp, Homo sapiens
  misc_feature: GZ8MTXP01BMNHP.19.67.G01.1.454.CMB.2.raw
  modified_base (552)..(552): a, c, t, g, unknown or other
  misc_feature (552)..(552): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtgggcgggaggcttggtccaggccgtggggcggtctcgtgagtactgtcctgtcgaccctcgtgggtctcgtcagcagcgactgtagttcgccgtgggtccgccgaggccgtccgaggggaacgagggccgggaggtcgggtcgcgtaggtttattttagagggtgggaccgactattacgacggacgaactccgaagtgggacgggccgtacttccaccatctcctagagttactttcacacgaaccactactgttcctacttacaaatcgaacgacgtccgtagggcgggaccgaaggaccgaccggtctcgtatttagttggtgtaagtagttagtttgnggtacgtagttggcgttgggaacgtagaacggtagtcggacgggtcggggaacccgtaaccgggg

SEQ ID NO: 320115 - DNA, 787 bp, Homo sapiens
  misc_feature: GZ8MTXP01ASCNZ.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagtttggctgacctgggttttccttgctgcaatttcaggaggtgtccagtgtgaggtgcaacgtggtggagacgtggcggaggtcttggtccagccgtggggcgtctctgagtactgtctgtcgaccctgtggggtctcgtcagcacgcgtactgtactcggccgtcgggtccccgcgaggcctaccgggaaggggaacggacgggccgggtaggtcggggtcgacgttaggtttacgtttttaggaggggttggaccccgtactatttcggaacggacgtaaaccctccgaaggtacgggggaccgggtacccgtacttaccgaccctaatcccgtacccgtaaggttaagttacccttttacaccgaaaggtaaaccaaccttacggtactttaccttaacttaacgaaaacgttaccggaaaccggtaacggtccccggttaaggggaaccccgggggacctaaacgggggaaccctaacccgggggtaccctttaagtttacgtttaaggttcggtttgggaacggttaaaggtttaccggttttaacggggttacgggtaccggttaaggttcgggttcggttaggggtaacggaacgtaacgggtaccgtacgggaccggggtaaccggggaaccccggtaaccggg

SEQ ID NO: 320116 - DNA, 666 bp, Homo sapiens
  misc_feature: GZ8MTXP01C41QJ.19.67.G01.1.454.CMB.2.raw
  modified_base (250)..(250): a, c, t, g, unknown or other
  misc_feature (250)..(250): n is a, c, g, or t
  modified_base (289)..(289): a, c, t, g, unknown or other
  misc_feature (289)..(289): n is a, c, g, or t
tcagtactctcgtgcacgaccggtgctcgatttagagtatacatattgggtttggggggtagctcaggaagcagagcctggagcatctccactatggcctgggctccactacttctcaccctcctcgctcactgcacaggttcttgggccaactttatgctgactcacgccccactctgtgtcggagtctccggggaagacggtaaccatctttgcaccacaacagtgcaacattgccagctaattttgngcagtggtaccagcagcgccgggcacgttccccacatgngatctatgagataatacaaagaccgtcgtcgggggtccctgagttcggttctcgtcggctacgatccgacaacgcctccctaccaactctcgccctaccctcaccatcgtctggactagaaagacgtagacgggacgacggtactagaaccttaccttacggttacggttacctaaaggtttcctttaaagtgtaaacgttacggcccggtcggggttacctaggttgggtttcggggttaaacccggtttcgggggaccggggtaaaccggggaccgaaacgggtccggttaaccggttacccggttacccggttaacggggtacccaacgggacccccgaaggggttcccttccccggccccccggtttcccggg

SEQ ID NO: 320117 - DNA, 715 bp, Homo sapiens
  misc_feature: GZ8MTXP01DE2EU.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgcaacgtgggtggagacgtgggcgggaggtcttggtccaggccgtggggcggtctcgtgagactgtcctgtcgaccctgtcggggtctccgtcagcagcgtactgtattcgccgtgggtcccgccgaggcctaccggaaggggaaggtacggggccgggaggtcggggtcgacgtaggtttatttttagagggtgggaacccgactatcggtaacggagaacctccgtaaggtcggggacggggtccgtaacttacccaaccacgttcccgtaccgtaagttacggttaccttttacacgtaaacgaaaccacttaccgtacgttaccttactaacctaaaataccgaaacgtaccggtaccgttagggaccggggtacccggacggaaccgaccgggtacccgttacgtttaatttagtggttggttaaggtaagttggttttaaagcgggttagagttgggcgttgggtaaggaacgtaagacgtacggacggttcgggggaacccgttaaacccggggg

SEQ ID NO: 320118 - DNA, 577 bp, Homo sapiens
  misc_feature: GZ8MTXP01DCMXD.19.67.G01.1.454.CMB.2.raw
  modified_base (284)..(284): a, c, t, g, unknown or other
  misc_feature (284)..(284): n is a, c, g, or t
  modified_base (321)..(321): a, c, t, g, unknown or other
  misc_feature (321)..(321): n is a, c, g, or t
  modified_base (328)..(328): a, c, t, g, unknown or other
  misc_feature (328)..(328): n is a, c, g, or t
  modified_base (336)..(336): a, c, t, g, unknown or other
  misc_feature (336)..(336): n is a, c, g, or t
  modified_base (377)..(377): a, c, t, g, unknown or other
  misc_feature (377)..(377): n is a, c, g, or t
  modified_base (558)..(558): a, c, t, g, unknown or other
  misc_feature (558)..(558): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttcctgctgcaatttcaggaggtgtccagtgtgaggtgcaacgtggtggagactgggcggaggtcttggtccaggccgtgggcggtctcgtgagctgtcctgtcgtaaccctgtggggtcctccgtnagcagcgatgtatgccgtggccgcaggctcgaggagnggccggngtggtcgntaggttagttttagaggtaggacgtactagttcaaacgggncgtcgagtaggacggccgtagtcacactcgtaccgagtacgtactttctacacgtaacacgtactcgtactacttacgaaatcgtaacgacgtccgtgggacggccgaaggaccgacggtccgttatagttagtgtggttgaagttagttagtggcgttagttgggaacgttgggaacganaggagtcgaacggtcgggg

SEQ ID NO: 320119 - DNA, 677 bp, Homo sapiens
  misc_feature: GZ8MTXP01EXJCZ.19.67.G01.1.454.CMB.2.raw
  modified_base (255)..(255): a, c, t, g, unknown or other
  misc_feature (255)..(255): n is a, c, g, or t
  modified_base (298)..(298): a, c, t, g, unknown or other
  misc_feature (298)..(298): n is a, c, g, or t
  modified_base (393)..(393): a, c, t, g, unknown or other
  misc_feature (393)..(393): n is a, c, g, or t
tcagtactctcgtgcacgaccggtgctcgatttagagtatacatattgggtttgggggggtagctcaggaagcagagcctggagcatctccactatggcctgggctccactacttctcaccctcctcgctcactgcacaggttcttgggcctaactttatgctgactcacgccccatctgtgtcggagtcgtccggggaagacggtaacattctttgccaccacaacagtgacaactattgccagactaatttgncagtcgtacagcagccgcccgggacaccgtccccactagttgngactctatggaggtaataactaacgaaacggtcgtcgtcggggtcctagtcttcggtctcgtcgcctcatcgacaacgctccctacactcgtccnccttaccactacctagtcctggtagactagaacgtagtcggacggacgtaggcctaacgtacctaaacgttccggtagttacgtacgtttacctttaaagcggtaacgttcgggcccggtttaaccgggtcgttcgggttcgggttcggggttccgggtaccggggacgggggtaaaccggttaaccgtaaaccggttaccgttacccggttacccggttaccggtaaccgggaccggtaacccggacccgggtacgttccccggtccccggttccccggtcgg

SEQ ID NO: 320120 - DNA, 760 bp, Homo sapiens
  misc_feature: GZ8MTXP01AZZ0P.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtgggcggaggcgttggtccaggccgtgggcgtctctgagactgtcctgtcgaccctgtggggtctccgtcagcagcgactgtattcgccgtgggtcccgccgacggcctccggaggggaaggcgggccgggaggtggggtcgtacgtaggtttacgttttttaggaggggtcgggtaaccgactagtttacgaacgggacgtaaaccgtcccgaagttcgggggaacggggtcccgtaaactttccgaacctacttcccgtaacccgtaaggtaaccggttaacctttttcccgaacaaacggtaaaccctacctaacttccggttaccttaccgtttaaaccaaaagttcgggaaaacctacggtacccggttaggggaaccgggggacccgaaggggacccgtaacccggggtcccgttacttagtttaattgggtggtaagtaagggttaggtttttaagggcggggtacggtaggttcggggttcggttagggggtaaggacgtaaggtacgtacggttaccggggtccggggaacccgtaaccgggg

SEQ ID NO: 320121 - DNA, 645 bp, Homo sapiens
  misc_feature: GZ8MTXP01BFZAI.19.67.G01.1.454.CMB.2.raw
  modified_base (606)..(606): a, c, t, g, unknown or other
  misc_feature (606)..(606): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtgggcggaggcttgggtccaggccgtggggcggtctcgtgagactgtcctgtcgaccctcgtggggtctccgcagcagcgactgtattcgccgtgggtcccgccgaggcctaccggagggggaacgacgggcccgggaggtcgggggtcgtacgtaagggtttattttttaggacggggttcgggacgtactagtttccgaaacgggacgtaactcccgaaggtcggggacgggccctagttcccacctactcctaccgagtacgttacttttcacgaacgtaaccactacctgtaccttacttacaaacgttcgaaacgacgcccgtggaacgggcccgaggaccgaccggtccgtattattacgtggttgttagtagttacgtttagcgggngttgttgggtgtgggtcgacaggactcgaacggtcgggg

SEQ ID NO: 320122 - DNA, 717 bp, Homo sapiens
  misc_feature: GZ8MTXP01EXE6J.19.67.G01.1.454.CMB.2.raw
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctggcggggacatcgtgatcgacccagtacccagactcactggctgtgtctcgtgggcgagaccggaccaacaatcaactgacacggtaccagaccaagtaacttacttttccacccaacctaccaaaagtaaacctaaaacttcttaacgccctaggtaaccaacagaacgaccgaggacactccctactaagttcactactgttacgtggtcctttaccgacgaccggtacgttaaccggttcccgggggtaccctacggaccccccggtaggttcccgggggatagggtcccgggggtaacgtacgggaacgtacgttactttcccaccttccctacgaaccctgtacgacgtccgtaacgcccgtggcgtaacgcgttagaaagtgtacggtgtacttaagtttacttacgttcgtacgacttacctttaatttacgtttttacctacgttcccgtacggttacggtaccggttcgggaaaccgtacgggggttaccgaaggggttagtaaacgtccaaaggttaccgttaacggttggaccggttcgaccgtaccaacttctttcgttcccg

SEQ ID NO: 320123 - DNA, 856 bp, Homo sapiens
  misc_feature: GZ8MTXP01ADWC9.19.67.G01.1.454.CMB.2.raw
  modified_base (322)..(322): a, c, t, g, unknown or other
  misc_feature (322)..(322): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagtttggctgacctgggttttccttgctgcaatttcaggaggtgtcagtgtgaggtgcaacgtggtggagacgtgggcggaggcttggtccaggccgtggggcgtctcgtgagtactgtcctgtcgacctcgtggggtctcgtcagcagcgactgtatcgccgtgggtccgcaggctccgagggaagnggccggaggtgggtcgcgtaggttagtttttaagagggtcggggaccgtactagtttacgtaacgggagtaacctaccgaaggttcggggacggggtcccggtaatttcccgaacctacttacccgtacccgtaaggtaccggttaacctttttccgaacctaaacggtaaaccctaccgttaccttacggtttacccttaccgttttaaacaaaacgtttacggaaaaccggtaacgggtaccccggttacggggaaccgggggtaaccccggaaaggggtaacccgaaccccgggggtttacccggtttaaccgtttaacgtttttaaacggtttcggggttacgggtttaacggggtaaaacgggttttaaacggggttttttaaacgggggttacgggggttaccgggttaacggggtttcggggttacggggtttacgggggtaacgggtaaaccggtaacgggttaaccggttacccggggttaaccgggggttaacccgggggttaaccccggggtaaacccggggg

SEQ ID NO: 320124 - DNA, 671 bp, Homo sapiens
  misc_feature: GZ8MTXP01BAU7Z.19.67.G01.1.454.CMB.2.raw
  modified_base (399)..(399): a, c, t, g, unknown or other
  misc_feature (399)..(399): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtgggcggaggcttgggtccagccgtggggcggtctctgagactgtcctgtcgaaccccgtcgtggggtctccgtcagcagcgactgtatcgccgtgggtcccgccaggctccgaggggaagagggccgggaggtgggtcgcgtaggttattttagagggtggacgactagttcgtaacggagaacctcgngtgggacgggccattccacgatcctacagtacgttactttcacgaagaacaccgacttcgtaccttacttaccaaattcgaaacgacggccgttagggacggggtccggaaacgggacccgtaccggggtaccggtttcctaagtttatttagggtggttaagtaggttaggttttaagttcggggtacgtaggttggggttccgttagggggttcggaaccgtaaggtaacgttccggaacgggttaacgggggaaccgtaaacccggggg

SEQ ID NO: 320125 - DNA, 591 bp, Homo sapiens
  misc_feature: GZ8MTXP01BFOX4.19.67.G01.1.454.CMB.2.raw
  modified_base (333)..(333): a, c, t, g, unknown or other
  misc_feature (333)..(333): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtgggcggaggcttggtccagccgtggggcggtctctgagactgtcctgtcgaccctcgtggggtctccgcagcagcgactgtatcgccgtcgggtcccgccgaggcctccgaaggggacgngggccgggaggtcgggtcgcgtaggttattttagagggtgggacgactagttcgaacggacgctcgagtgggacggcatcactatctacagtagtactttcacacgaacactactcgtctacttacaaagtcgaaacgacgccgtaggacgggaccgacggaccgccggtccgttacttaagttagttggtgttggtagttaggttagtgggcgttgttgggcgttgggtggacgagttacgtccgaacggtccgggg

SEQ ID NO: 320126 - DNA, 622 bp, Homo sapiens
  misc_feature: GZ8MTXP01BEY2D.19.67.G01.1.454.CMB.2.raw
  modified_base (206)..(206): a, c, t, g, unknown or other
  misc_feature (206)..(206): n is a, c, g, or t
  modified_base (270)..(270): a, c, t, g, unknown or other
  misc_feature (270)..(270): n is a, c, g, or t
  modified_base (278)..(278): a, c, t, g, unknown or other
  misc_feature (278)..(278): n is a, c, g, or t
  modified_base (303)..(303): a, c, t, g, unknown or other
  misc_feature (303)..(303): n is a, c, g, or t
  modified_base (367)..(367): a, c, t, g, unknown or other
  misc_feature (367)..(367): n is a, c, g, or t
  modified_base (602)..(602): a, c, t, g, unknown or other
  misc_feature (602)..(602): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctgcgggacatcgtgatcgacccagtacccagactcactggctgtgtctcgtgggcagacgccaanaatcaactgcacggtccagccaagtaactatttccaccacctacaaagaaactaaacttctacncagacaanagagaccagacacgcctactagtcnctctagttacgtggtcttcgacgcgacgtaacgttccgggtcctagaccccgtaggtccggggnacgggtcggtacgtagggaactagtaacttttccacccgttcaccacctacgtaccagtccgaacgtccctagacccgagggtcctaaggaagtgttggacgttacgttaagtttatacgtgttacaagttaccttaaatttcgttttactcgtccgtcggtacgtaccgttacggcgggtaaacggttcgaaggggttaagaaacgtcggaacgttacgttacggttggcgtcnccaccgttacttcgttcgtg

SEQ ID NO: 320127 - DNA, 927 bp, Homo sapiens
  misc_feature: GZ8MTXP01ADK4V.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagtttggctgacctgggttttcctgctgcaatttcaggaggtgtccagtgtgaggtgcaacgtggtggagacgtgggcgggaggcttggtccagccgtggggcggtctctgagtactgtcctgtcgaaccctgtggggtctccgtcagcagcgactgtattcggccgtgggtcccgccacggctacccggaagggggaacggacgggcccgggtaggtcggggtcgacgtaagggtttaagttttttaaggtaggggtaggggaaccccgtacgtagtttccgtaaacggggacgtaacccgttacccgaaggttcgggggaaacgggggtccctaaacgttttcccggaaaccctacgtttaccccgttacccgaaagggttaaccggttaacccgttttttaccaacccgttaaacgggaaaacccctaaaccggtaccctttacggtacccctttacccgttttaaaaacgtaaaacgttacggaaaacccgggtacggggtacccgggtaacgggggaacccgggggtaacccggtaaaccgggggaaccccggtaaccgggggtttaccccgtttaacgttttaaacggttttaacgggtttacgggttagggttaacggggttaaagggtttaacgggttttaacgggacgggggttaaccgggttaacgggttcgggggttccgggtttaacggggggttaacggtaaaccggtaacggggttaccggttacccggggttaacccgggggttaacccggggggaaacccccgggtaaacccggggg

SEQ ID NO: 320128 - DNA, 853 bp, Homo sapiens
  misc_feature: GZ8MTXP01CBQJI.19.67.G01.1.454.CMB.2.raw
  modified_base (278)..(278): a, c, t, g, unknown or other
  misc_feature (278)..(278): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgcaacgtgggtggagacgtgggcggaggcttggtccagccgtgggcgtctctgagactgtcctgtcgacctcgtgggtctccgtnagcagcgactgtatcgccgtggtcccgcgaggctccgagggggaacgagggccggtaggtcggggtcgacgtaggtttaattttttaggaggggttacggggaacccgtacgtagttaccgtaacgggacgtaacccttacccgaaggttcggggaacggggtacccgtacgtttacccaaacccgtatacccgttacccgaaggttaacggttaccctttttacaaccgtaaacggtaaaccctaacctaaccgttcgttacccttaccttaaaccgaaaagtttacggaaaccggtacggtacccggttacggggaaccgggggaaccccggtaaacgggggaacccgtacccgggggtaccccgttttaacgtttaacggttttaaacggttttgggtttagggtaacgggtttaaagggttttaacgggtttttaaacggttggggggttaaccgtacgggtttacgggggttccggttagggggtttaacccggggaaacgtaagggttaacgtaccggggttaacccggggttaaccggggggaaccccgggtttaaaaccccgggggg

SEQ ID NO: 320129 - DNA, 558 bp, Homo sapiens
  misc_feature: GZ8MTXP01DR0IR.19.67.G01.1.454.CMB.2.raw
  modified_base (245)..(245): a, c, t, g, unknown or other
  misc_feature (245)..(245): n is a, c, g, or t
  modified_base (278)..(278): a, c, t, g, unknown or other
  misc_feature (278)..(278): n is a, c, g, or t
  modified_base (301)..(301): a, c, t, g, unknown or other
  misc_feature (301)..(301): n is a, c, g, or t
  modified_base (323)..(323): a, c, t, g, unknown or other
  misc_feature (323)..(323): n is a, c, g, or t
  modified_base (375)..(375): a, c, t, g, unknown or other
  misc_feature (375)..(375): n is a, c, g, or t
  modified_base (412)..(412): a, c, t, g, unknown or other
  misc_feature (412)..(412): n is a, c, g, or t
  modified_base (552)..(552): a, c, t, g, unknown or other
  misc_feature (552)..(552): n is a, c, g, or t
  modified_base (555)..(556): a, c, t, g, unknown or other
  misc_feature (555)..(556): n is a, c, g, or t
  modified_base (558)..(558): a, c, t, g, unknown or other
  misc_feature (558)..(558): n is a, c, g, or t
tcagtactctcgtgcacgaccggtgctcgatttagagtatacatattgggcttggtccagcctgggcggtctctgagactgtcctgtgaaccctctggggtctccgtcagcagcgactgtattgcctgggtccgccaggctccagggaagaggccggagtgggtcgcaggtattttttataggtgggacgacatttctacggagactccatggaggccgattcaccatctccagagtacttttcncagaacactactgtctcttcaaatgaacagccnggagggccgaggacacggccgtntattattgtgtgagtagtttangggcatggctgggtgacagatcacgtggggcagggaccctggtaccacgtcnctcacgcctccaacgaaggcccatcgtccttccccgnggccgccctgcctccgaggacgccaccgtcgagacgggacacgagcccggccctggggctcggcccgtggtaccaacggtacctaccgttcccgagagacgttcgtggacggcgggcgttacggaacgaacgggctcganagnngn

SEQ ID NO: 320130 - DNA, 721 bp, Homo sapiens
  misc_feature: GZ8MTXP01BE9UP.19.67.G01.1.454.CMB.2.raw
  modified_base (644)..(644): a, c, t, g, unknown or other
  misc_feature (644)..(644): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggtagttttggctgaccttgggttttccttgctgctaatttcaggaggtgtccagtgtgaggtgcaacgtggtggagacgtggacggaggtcttggtccagccgtgggcgtctctgagactgtcctgtcgaccctgtgggtctcgtcagcagcgactgtactcggccgtgggtcccgccgacggtccgtaccggaagggggaacggacgggggcccgggtagggtcggggtcgtcgttaagggtttaagttttttaaggaggggtaggggtacccaacgtacgtttacgtaacggaacgtaaccttccgaaggtacggggaacggggcccgtagtttcccgaacctattccctaccgaaggtacgttaccttttacgaccgtaaacgaaacctaactccgttacgttccttacttaactaaagtacgtaacgacggccgtaggacggggccgaacggaccgtacggtccgttactttagttagttggtggtaaggtaagttagtttacgggnggtacgtaggttcggttcggttagggtaaggacgtaacggtagtccggttacggggtaaccggggaaccgtaacggg

SEQ ID NO: 320131 - DNA, 574 bp, Homo sapiens
  misc_feature: GZ8MTXP01DC6PQ.19.67.G01.1.454.CMB.2.raw
  modified_base (221)..(221): a, c, t, g, unknown or other
  misc_feature (221)..(221): n is a, c, g, or t
  modified_base (225)..(225): a, c, t, g, unknown or other
  misc_feature (225)..(225): n is a, c, g, or t
  modified_base (233)..(233): a, c, t, g, unknown or other
  misc_feature (233)..(233): n is a, c, g, or t
  modified_base (236)..(236): a, c, t, g, unknown or other
  misc_feature (236)..(236): n is a, c, g, or t
  modified_base (248)..(248): a, c, t, g, unknown or other
  misc_feature (248)..(248): n is a, c, g, or t
  modified_base (407)..(407): a, c, t, g, unknown or other
  misc_feature (407)..(407): n is a, c, g, or t
  modified_base (462)..(462): a, c, t, g, unknown or other
  misc_feature (462)..(462): n is a, c, g, or t
  modified_base (474)..(474): a, c, t, g, unknown or other
  misc_feature (474)..(474): n is a, c, g, or t
  modified_base (503)..(503): a, c, t, g, unknown or other
  misc_feature (503)..(503): n is a, c, g, or t
tcagtactctcgtgcacgaccggtgctcgatttagagtatacatattgggtttgggggggtagctcaggaagcagagcctggagcatctccactatggcctgggctccactacttctcaccctcctcgctcactgcacaggttcttgggcctaactttatgctgactcacgcccactctgtgtcggagtcgtcggggaagacggtaacatctttgcaccanaacngtgacaanatncagctaatttgngcagtgtacagcagccggcccgggctaccgtccccactatgtgatctatggaagtaataatacaaacgtaccgtcggtcgggtcctgtacgttcggttctcgtcggtcctctagtcgacaacgtcctccctacctaactctcgtcccctcctcaacctnttcctcgtaacggactagaagacgtgggaacggacgtaggctacgactactcgtntacgtatcgtangatacgccgctgagtgtcggtcgtcgggnggacgactaacgtcgaccgttcgttccgttaagccgaaccgcccgtacgggcctccccggcccgttaaccg

SEQ ID NO: 320132 - DNA, 696 bp, Homo sapiens
  misc_feature: GZ8MTXP01DE4K6.19.67.G01.1.454.CMB.2.raw
  modified_base (225)..(225): a, c, t, g, unknown or other
  misc_feature (225)..(225): n is a, c, g, or t
  modified_base (236)..(236): a, c, t, g, unknown or other
  misc_feature (236)..(236): n is a, c, g, or t
  modified_base (238)..(238): a, c, t, g, unknown or other
  misc_feature (238)..(238): n is a, c, g, or t
  modified_base (241)..(241): a, c, t, g, unknown or other
  misc_feature (241)..(241): n is a, c, g, or t
  modified_base (248)..(248): a, c, t, g, unknown or other
  misc_feature (248)..(248): n is a, c, g, or t
  modified_base (256)..(256): a, c, t, g, unknown or other
  misc_feature (256)..(256): n is a, c, g, or t
  modified_base (281)..(281): a, c, t, g, unknown or other
  misc_feature (281)..(281): n is a, c, g, or t
  modified_base (285)..(285): a, c, t, g, unknown or other
  misc_feature (285)..(285): n is a, c, g, or t
  modified_base (289)..(289): a, c, t, g, unknown or other
  misc_feature (289)..(289): n is a, c, g, or t
tcagtactctcgtgcacgaccggtgctcgatttagagtatacatattgggtttgggggggtagctcaggaagcagagcctggagcatctccactatggcctgggctccactacttctcaccctcctcgctcactgcacaggttcttgggcctaactttatgctgactcacgcccactctgtgtcggagtcgtaccggggaagacggtaaccattctttgcaccanaacagtgcaantncantatttgncagtgacngcgcgccgccgctacctacccactntgtntatntagtagaagtaataacgaacgaacgtcggtcggtcggtctagtcgttcgtctcgtccgctcactccgactacctcctccctacctaccttcctccctcccctaccctactacctcgttccgtacgtacgacgtaggaaacgtacggtacgggaacggacggacgtactaacgtaccgttaacgttacggtacgttacgttagttacgttagtacggtacgtaccggtacgtcggttacgtacggttcggggttcgggttcggggtaacggggacgggtaaacggttaaccggtacgttccgggttacccggttaaccccgggttaccgggttaaccggtaacccggtaacccgggtaaccccgggtaccgggttccccgttaacccccgggttccccggttaaccgg

SEQ ID NO: 320133 - DNA, 704 bp, Homo sapiens
  misc_feature: GZ8MTXP01BPVHW.19.67.G01.1.454.CMB.2.raw
  modified_base (284)..(284): a, c, t, g, unknown or other
  misc_feature (284)..(284): n is a, c, g, or t
  modified_base (286)..(286): a, c, t, g, unknown or other
  misc_feature (286)..(286): n is a, c, g, or t
  modified_base (311)..(311): a, c, t, g, unknown or other
  misc_feature (311)..(311): n is a, c, g, or t
tcagtactctcgtgcacgaccggtgctcgatttagagtatacatattggggtttgggggggagaggagcccagcactgggattccgaggtgtttccattcggtgctcagcactgaacacagaggactcaccatggagttttggctgaccttgggttttccttgctgctaatttcaggaggtgtccagtgtgaggtgcaacgtgggtaggagacgtgggcggaggcttggccaggcctggggcggtctcgtgagtactgtcctgtcgaaccctgtgggtctcgtnancagcgactgtatcgccgtgggtccnccgaggccgtaccggagggaacggagggccgggtaggtcggggtacgtcgtaaggtttattttaaggagggtcgggaaccgtactagttacggtaacggacgaaccgtaccaaggtcggggaaacgggtcctacgtttccaaccgtactcctacccgtagtacgttactttacacaagaaacctactacgttcgtacctacgttaacaaagttcgaaacgtacggtaccggtacggaaccggggacgaacggggaccgtaccgggtaccgttaccgttaagtttaacgttggttggtaagtaaggttagtttaaggcggtacgtaaggttcggttacggttggtaacggaacgtaagttcgacggttacgggtccgggaacccgtaaccgggg

SEQ ID NO: 320134 - DNA, 589 bp, Homo sapiens
  misc_feature: GZ8MTXP01CV16J.19.67.G01.1.454.CMB.2.raw
  modified_base (414)..(414): a, c, t, g, unknown or other
  misc_feature (414)..(414): n is a, c, g, or t
  modified_base (418)..(418): a, c, t, g, unknown or other
  misc_feature (418)..(418): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagtttgctgacctgggttttcctgctgcaatttcaggagtgtccagtgtgaggtgcaactggtgagactggcggagcttggtccagcctgggcgtctctgagtactgtcctagtgaaccctgtggggtctccggtcagcagcgactgtattgccctgggtacccgccagggcctaccgaagggggaagacggccggagtgggtcgacgtaggttatttttagaggtggggacctacagtttcacgggataactaccaagtcggagggccatcaccatccnctanagtacttttcacagaacactactagtctactactaaatagaacgaacgaccgtgacgggaccgacggacgacgaccgtctattagttgtgtgtagttagttaagttggtgtagttcggttcgttcggtaaggacgaacgtacgtacgacggtaacgggaaccggtaaccgg

SEQ ID NO: 320135 - DNA, 662 bp, Homo sapiens
  misc_feature: GZ8MTXP01ACL1I.19.67.G01.1.454.CMB.2.raw
  modified_base (409)..(409): a, c, t, g, unknown or other
  misc_feature (409)..(409): n is a, c, g, or t
  modified_base (424)..(424): a, c, t, g, unknown or other
  misc_feature (424)..(424): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctggcggggacatcgtgatcgacccagtacccagactcacgtggctgtgtctcgtgggcgagaccgaccacaatcaactgcacggtccagccaagtaactacttttccacccaacctaccaaagtaaacctaaaacttctacgcctaggtaaccaagagacgaccaggacacgccttacgtaagttcgactactatttacgtgggtaccttaccgtacggcgtacggtaacgttccggggtaccctggaacccccgtcggttccggggntacggcgggtaacgngggaacagtactttcactctacaccatcagcacgccgtagaccgagggaccaagtgtcggtagtacttagtttacgtacgtgtacagttactttaactttactttcgtaccttacccggtcggtacggtaccggttaccggaacccgtaacgggacggttaagggttaacgaaacgtacgaacgggttacgttacgttggtaacggcttaacggcctaacgttcttcgttcttaaccg

SEQ ID NO: 320136 - DNA, 646 bp, Homo sapiens
  misc_feature: GZ8MTXP01DTYME.19.67.G01.1.454.CMB.2.raw
  modified_base (584)..(584): a, c, t, g, unknown or other
  misc_feature (584)..(584): n is a, c, g, or t
  modified_base (598)..(598): a, c, t, g, unknown or other
  misc_feature (598)..(598): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgcaacgtggtggagacgtgggcggaggcttggtccagccgtggggcggtctcgtgagactgtcctgtcgacccgtgtcgggtctcgtcagcagcgatgtatcgccgtggccgcgaggctacgagggaaggcggccggaggtcgggtcgacgtaggtttattttagagggtagggtttaaccagtagttacgtacggacgaacttccgaaggtcgggtacgggacccgtacttaccgaccgtactccgtacgtagtacgttactttactacgaacgtaaactactacttcgtacttacttaacaaatacgaacggagtcccgtaggacgggaccggacggaccgacggtaccgttagttagttaagttggtgtaaggtaaggttagtttagnggtacgtagttggngttgggaacgagaagtacgtcggttacggtcgggaaccggtaaccggg

SEQ ID NO: 320137 - DNA, 775 bp, Homo sapiens
  misc_feature: GZ8MTXP01DHXO0.19.67.G01.1.454.CMB.2.raw
  modified_base (212)..(212): a, c, t, g, unknown or other
  misc_feature (212)..(212): n is a, c, g, or t
  modified_base (244)..(244): a, c, t, g, unknown or other
  misc_feature (244)..(244): n is a, c, g, or t
  modified_base (305)..(305): a, c, t, g, unknown or other
  misc_feature (305)..(305): n is a, c, g, or t
  modified_base (318)..(318): a, c, t, g, unknown or other
  misc_feature (318)..(318): n is a, c, g, or t
  modified_base (331)..(331): a, c, t, g, unknown or other
  misc_feature (331)..(331): n is a, c, g, or t
tcagtactctcgtgcacgaccggtgctcgatttagagtatacatattggggtttgggggagctacaacaggcaggcaggggcagcaagatggtgttgcagacccaggtcttcatttctctgttgctctggatctctggttcctggcggggacatcgtgatcgacccagtacccagactcactggctgtgtctcgtgggcgagaccggccaanaatcaactgacaggtccagaccaagtaacttntttccacctacctaccaaagaaactaaaacttctagcctagaaccaagagacgaccagacncgcctactaagtnctactatttacgnggtcttaccacggcgtacgtaacggttcccggggccctacggacccccggtacggttccgggggagtcgggtccgggggttacgtacggggaacctaggttaccttttacccgacccttacctacgaaaccctacgtaccgacggtaccaacggttcccgaggaacccggtagggtacctaagggtaaaccggtgtcgggttacgtaactttaaaggtttttactacgttacggtaaccgttaagttaaccttttaaacgtttttcctttttaccgttaccccgttacccgggtttacccgggtacgggttaccccgggttacgggaaacccgggtaaacggggttcggtaaacggggttaaagtaaacctacggaaaccgggttacttaccggtttggaacccgggcttaaccggacccgttaacccgtttgttcccgttccg

SEQ ID NO: 320138 - DNA, 723 bp, Homo sapiens
  misc_feature: GZ8MTXP01BD6II.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgctaatttcaggaggtgtccagtgtgaggtgcaacgtggtggagacgtgggcggaggcttggtccaggccgtgggcgtctctgagtactgtcctgtcgtaacccgtcgtggggtctccgtcagcagcgtactgtattcgccgtcggtccgccgaggcctaccggaaggggaaggcgggccgggtaggtcgggtcgtacgttaggtttaatttttaggtaggggtacgggtaaccgtaacgtagtttacgtaacgggacgtaaaccttcccgtaaggtcgggggaaccggggtacccgtactttacccgaacccgtacttacccgtacccgtaagtacggttaaccttttcaacaacgtaaacctacctaacgttcgttacctacttaacaaaagttcgaaacgacggtacccgtagggaccgggaccggaacggaccgtaccggtaccgttattacgttagttggtgtaagggtaagttaggtttagcgggtcgtaagttgggttcgttgggtaagacgtaaggtacgtcggaacggtcgggggaacccgtaaccgggg

SEQ ID NO: 320139 - DNA, 717 bp, Homo sapiens
  misc_feature: GZ8MTXP01DVBC1.19.67.G01.1.454.CMB.2.raw
  modified_base (325)..(325): a, c, t, g, unknown or other
  misc_feature (325)..(325): n is a, c, g, or t
  modified_base (344)..(344): a, c, t, g, unknown or other
  misc_feature (344)..(344): n is a, c, g, or t
  modified_base (384)..(384): a, c, t, g, unknown or other
  misc_feature (384)..(384): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcgaggaggtgtccagtgtgaggtgcaacgtggtggagacgtgggcggaggtcttggtccaggccgtggggcgtctcgtgagacttgtcctgtcgaacccgtgtcggggtctccgtcagcaagcgtactgttattcggccgtacgggtccgacgnggcctacgaaggggaacgngggccggaggtcgggtcgtacgtaggtttacgttttaggnggggtcggtaacgactagttcgacggacgaaccttcgaaggtcgggaacggggtccctaattcccaacgtactccgtaccgtaagtacgtttaactttccacgtaaacgaaactactaacttcgtacttacgtaaactaaaagttccggaaacgtaacggtaccggttacgggaaccggggaccggaacgggaccggtaccggggttacccgtttatttaacgttagtttggtaggttaaggtaacgtttagggttaggttacgggaacgttgttacgggttgttagggtaagacgtaagtagcggttacgggtcggggaacccgtaaccggg

SEQ ID NO: 320140 - DNA, 671 bp, Homo sapiens
  misc_feature: GZ8MTXP01ENGDA.19.67.G01.1.454.CMB.2.raw
  modified_base (225)..(225): a, c, t, g, unknown or other
  misc_feature (225)..(225): n is a, c, g, or t
tcagtactctcgtgcacgaccggtgctcgatttagagtatacatattgggtttgggggggtagctcaggaagcagagcctggagcatctccactatggcctgggctccactacttctcaccctcctcgctcactgcacaggttcttgggcctaaactttatgctgactcacgccccactctgtgtcggagtcgtccgggaagacggtaacattctttgcacccanaacagtgacaacattgccagctaatttgtgcaggtcggtaaccaggcacgccggccccggctaccgttcccccactattggtgactctaagtggaaggtaataaactaacgtaaacggtacccggtccggttcggggtccctgtacttccggttctcgtcgcctcagtacgactaacgtccctccctaccaaaccttcctccgtcccctccctacacctatcctcgtggacgtcgaaacgtacgtacgggaaggacggacggtcgaagtaccttaacttacggttgtacgtagtttacttaagtcggacgtacggtccgtcggttactagttcggtcggtcggttaccggggacggggtacgggaaccgacggtccgttacggttcccgttacggtaaccggcaaccggtaacccggcggttccgtccccgttccccggttaaccg

SEQ ID NO: 320141 - DNA, 658 bp, Homo sapiens
  misc_feature: GZ8MTXP01BG96M.19.67.G01.1.454.CMB.2.raw
  modified_base (316)..(316): a, c, t, g, unknown or other
  misc_feature (316)..(316): n is a, c, g, or t
  modified_base (335)..(335): a, c, t, g, unknown or other
  misc_feature (335)..(335): n is a, c, g, or t
  modified_base (352)..(352): a, c, t, g, unknown or other
  misc_feature (352)..(352): n is a, c, g, or t
  modified_base (409)..(409): a, c, t, g, unknown or other
  misc_feature (409)..(409): n is a, c, g, or t
  modified_base (586)..(586): a, c, t, g, unknown or other
  misc_feature (586)..(586): n is a, c, g, or t
  modified_base (594)..(594): a, c, t, g, unknown or other
  misc_feature (594)..(594): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggagtgtccagtgtgaggtgcaacgtggtggagacgtgggcggaggcttgggtccaggccgtggggcggtctcgtgagtactggtcctggtcgaacccctgtcggggtctccggtcagcagcgactgtattcgccgtgggtccnccgaggctccgagggaagnggccggagtcggggtcncgtaggttatttttagagggtaggggaccactaagtttccgaacgggataacctccngtggggacggggccctaattccaccctaagtccctaccgaagacgttaacttttcacagaaaccctacgtacttcgtactcttacaaagttcgaacgtaagcccgttagggacggggaccgaggggtaccaccgggggtccttacttagttagttggtggtaagtagttaggtttanccggggtnaagttgggccgttaggggtcggaaatggggtaactcgaccgggttcggggccgtaaacccgggg

SEQ ID NO: 320142 - DNA, 738 bp, Homo sapiens
  misc_feature: GZ8MTXP01BPX69.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggagtgtccagtgtgaggtgcaacgtggtggagacgtggcggaggcttggtccagccgtgggcgtctctgagactgtcctgtcgaccctcgtcggggtctccgtcagcagcgtactgtacttcgccgtcgggtcccgccgaggcctaccgaaggggaacgcgggaccggaggtgggtcgacgtaggttattttagagggtcgggaccgtactagttcgtacggagtaaaccctccgtaaggtgggaccggggtaccctaacgttacccaacccgtactaccctacccgaacggttacgttaccgttttaccacgaaacgtaaaccctacttaccgttcgttaccttacgttaacaaaagttacgaaacgtacggcccgttaagggacgggtacccggaaggtacccgtaccgggtaccgttaccttagtttacgttggttggtaagggttaaggttaggttttaggttagggtaccggtaaggttcgggttcgttagggggtaacgtaaccggtaagtaccggttacgaaacccgggttcgggggaacccgtaaaaccccgggggg

SEQ ID NO: 320143 - DNA, 733 bp, Homo sapiens
  misc_feature: GZ8MTXP01AVRSM.19.67.G01.1.454.CMB.2.raw
  modified_base (278)..(278): a, c, t, g, unknown or other
  misc_feature (278)..(278): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttcctgctgcaatttcaggagtgtccagtgtgaggtgcaacgtgggtggagacgtgggcggaggcttggccaggccgtggggcgtctcgtgagctgtcctgtcgaccctgtgggtctccgnagcagcgtactgtatcgccgtgggtcccgcaggcctccggaaggggagtacggccgggaggtggggtcgacgtaggttatttttacgagggttgggacgtactagttcgtaaacgggagtaaccttcgaggtacggggacgggtaccgtatttccgaaccctaatccgtaccgtaagtacgttacctttttacgaacctaaacgaacctaacgtaccttcgttaccttactttaacaaaaggttacgaaaacgtcgacccggtaggaaccggggtacccggaagggtaaccgaccgggtacccggtttacttaaacgtttaaggttggttcggttaggtaaagggtttaaccgttttaaagggttaccggggttacgggttacggttcgggtaacgggtacgggtaacggaacggtacggttaccggttaaccggttaaccgggggtaaccgggg

SEQ ID NO: 320144 - DNA, 674 bp, Homo sapiens
  misc_feature: GZ8MTXP01CDLR8.19.67.G01.1.454.CMB.2.raw
  modified_base (419)..(419): a, c, t, g, unknown or other
  misc_feature (419)..(419): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtggaggtgcaacgtggtggagacgtgggcggaggcttggtccaggccgtggggccggtctcgtgagactgtcctgtcgaccctgtgggtctcgtcagcagcgactgtattcgccgtcgggtccgccgtaggcctaccggagggggaacggacgggccgggaggttggggtcgcggtaggtttatttttaggagggtagggaaccgtactagtttcgacggacgaacctaccgnggtgggacgggctactcacctatcctaccagtacttacgttttcacgagaaaccactacttcgtccttacttacaaatgaaccgcgtcgtagggacggggaccgtaaggacccgtaggggtaccctttgttaagtttacgtttgggtggttaaggtagtttagggtttaacgttcgggtacggtagttcgggttcgttaggggtcgggtacaagggtacttcgggaccggtccgggggaacccgtaacccggggg

SEQ ID NO: 320145 - DNA, 601 bp, Homo sapiens
  misc_feature: GZ8MTXP01DLKUB.19.67.G01.1.454.CMB.2.raw
  modified_base (333)..(333): a, c, t, g, unknown or other
  misc_feature (333)..(333): n is a, c, g, or t
  modified_base (539)..(539): a, c, t, g, unknown or other
  misc_feature (539)..(539): n is a, c, g, or t
  modified_base (548)..(548): a, c, t, g, unknown or other
  misc_feature (548)..(548): n is a, c, g, or t
  modified_base (554)..(554): a, c, t, g, unknown or other
  misc_feature (554)..(554): n is a, c, g, or t
tcagtactctcgtgcacgaccggtgctcgatttagagtatacatattggggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtgggcggaggcttgggtccaggccctggggcggtctctgagactgtcctgtcgaaccctcgtggggtctccgtcagcagcgactgtatgccgtggtccgcaggctaccgagggaagaggccggngtgggtcgcgaggttatttttagacgggtggaccgactattctaacggagtaaacctccaagtgggagggccgaattcaaccatcctaccagtacgtaacttttcactaacgaaacaacactgtcttacttacaaaatgaaacaacgcccgtaggaacggggaccgaaggaccgtacggacccggtctatttaagtgtggtgaagngttttaagnggtcgngttggcgttggtaaggacgaagatcgacgtcggggaaccgtaacggg

SEQ ID NO: 320146 - DNA, 609 bp, Homo sapiens
  misc_feature: GZ8MTXP01DUSXI.19.67.G01.1.454.CMB.2.raw
  modified_base (254)..(254): a, c, t, g, unknown or other
  misc_feature (254)..(254): n is a, c, g, or t
  modified_base (267)..(267): a, c, t, g, unknown or other
  misc_feature (267)..(267): n is a, c, g, or t
  modified_base (296)..(296): a, c, t, g, unknown or other
  misc_feature (296)..(296): n is a, c, g, or t
  modified_base (371)..(371): a, c, t, g, unknown or other
  misc_feature (371)..(371): n is a, c, g, or t
  modified_base (377)..(377): a, c, t, g, unknown or other
  misc_feature (377)..(377): n is a, c, g, or t
  modified_base (385)..(385): a, c, t, g, unknown or other
  misc_feature (385)..(385): n is a, c, g, or t
  modified_base (400)..(400): a, c, t, g, unknown or other
  misc_feature (400)..(400): n is a, c, g, or t
  modified_base (408)..(408): a, c, t, g, unknown or other
  misc_feature (408)..(408): n is a, c, g, or t
  modified_base (423)..(423): a, c, t, g, unknown or other
  misc_feature (423)..(423): n is a, c, g, or t
  modified_base (567)..(567): a, c, t, g, unknown or other
  misc_feature (567)..(567): n is a, c, g, or t
tcagtactctcgtgcacgaccggtgctcgatttagagtatacatattgggtttggggggtagctcaggaagcagagcctggagcatctccactatggcctgggctccactacttctcaccctcctcgctcactgcacaggttcttgggccaactttatgctgactcagccccatcctgtgtcggagtcgtccggggaagacggtaaccatcttttgccacccacaacagtggcaacattgccagctaattttgngacagtcggtacngcagccgccggcacgtccccacattgtgntctatgagataacacaagacgtcgtgggtcctgtactcggttctcgtgcctcatcgacaacgctcctcactctcncctccncactgtcngtgactggaatacgngacgacgnggctgaacttacgtntacggttctaacggtttctttaaagcgtaacgtacggtcccgtagggttcctaaggttcgggttcgggttccgttacccgggggagggaaacccgggttaaccaaacggtcccgttacggttacccgttacgttaacgggaccnccggtaacccgaggttccccgttcccgttcccccgtttccgg

SEQ ID NO: 320147 - DNA, 670 bp, Homo sapiens
  misc_feature: GZ8MTXP01EVD1T.19.67.G01.1.454.CMB.2.raw
  modified_base (505)..(505): a, c, t, g, unknown or other
  misc_feature (505)..(505): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgcaacgtggtggagacgtgggcgggaggcttgggtccagtccgtggggcggtctctgagtactgtcctggtacgtaaccccgtgtcgggtctccgtcagcagcgactgtacttcgcccgtgggtcccgccgaggtcctaccggaaggggaacggacgggccgggtaggtcgggtcgtacgtaggtttagttttagaggggtggaccgactagttcgtaggacgaactacgaaggtcgggacgggtccgtattaccgaccgtatcctaccagtacgttactttcacaacgaacactcgtacttcttacgttanaaaactcgaacgagtccgtaggacgggcgaacggacgacggtccgttacgttagtttagttgtaggtaagtaagttaagggtttagttcggtacgtaaggttcggcggttagggtggaacgtaaggtacgtcggttaaccgggtcgggggaacccgtaaccgggg

SEQ ID NO: 320148 - DNA, 705 bp, Homo sapiens
  misc_feature: GZ8MTXP01DIKTY.19.67.G01.1.454.CMB.2.raw
  modified_base (303)..(303): a, c, t, g, unknown or other
  misc_feature (303)..(303): n is a, c, g, or t
  modified_base (416)..(416): a, c, t, g, unknown or other
  misc_feature (416)..(416): n is a, c, g, or t
  modified_base (484)..(484): a, c, t, g, unknown or other
  misc_feature (484)..(484): n is a, c, g, or t
  modified_base (632)..(632): a, c, t, g, unknown or other
  misc_feature (632)..(632): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgcaacgtggtggagacgtgggcggaggcttggtccagccgtggggccggtctcgtgacgtacgttcgtacctggtaccgtaaacccgttcgtcgggggttcttcccgtanaggcaaggccgagttagtacgttcggcccgtcgggtacccgccgaggtccgtaccggaagggggaacggagggccgggaggttcgggggtcgacggtaggtttatttttaggngggtacggaccgtacattcgtacggacgtaacctacgaagtcggggacggacccgtattcccaccgtntcccgtaccgagtacgttacttttcacgaacgaaactactacttggtaccttacttacaaaattccgaaacgtacgtccgtagggacgggccgaacggccgtacggtaccttagttaagttgttacggtgtaagtgttagttttaggnggccgttaagttcgggttgttacggggttaagaataacggacttcgacgggtcgggaacccgtaaacccgggg

SEQ ID NO: 320149 - DNA, 767 bp, Homo sapiens
  misc_feature: GZ8MTXP01EVN31.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgcaacgtggtggagacgtgggcggaggtcttggtccaggccgtgggcggtctcgtgagtactgtcctgtcgaaccctcgtggggtctccgtcagcagcgacttgtattcgccgtcgggtcccgccgacggccgtaccggagggggaacggagggccggaggtcgggtcgtcgtaggtttattttagaggggtcggaccgtactagttacgtacgggacgtaaaccttccgaagtcggggaacgggtcccgtaactttcccgaacccgtaacgttcccgttacccgtaacggtaacggttttaaacccgttttcctaaccgaaacgttaaaaccccaaccgtttaaccgtttacgttcctttaacctttaaccctaaaagttaaccggaaaccggtacggttacccggtacgggacgggggtaccccgaaggggaacccgaccggggttacccgttacgtttaagtttacgtttggtggttaaggtaggtttaaggttttagttcgggacgttaggttcggttgttagggtggaacgaagtacgacgttacgtaaccgggggcgttaacccgggg

SEQ ID NO: 320150 - DNA, 672 bp, Homo sapiens
  misc_feature: GZ8MTXP01AS1OE.19.67.G01.1.454.CMB.2.raw
  modified_base (342)..(342): a, c, t, g, unknown or other
  misc_feature (342)..(342): n is a, c, g, or t
  modified_base (462)..(462): a, c, t, g, unknown or other
  misc_feature (462)..(462): n is a, c, g, or t
tcagtactctcgtgcacgaccggtgctcgatttagagtatacatattggggtttggggggagctacaacaggcaggcaggggcagcaagatggtgttgcagacccaggtcttcatttctctgttgctctggatctctggttcctggcggggacatcgtgatcgacccagtacccagactcactggctgtgtctcgtgggcgagaccggccaacaatcaacgtcgcacggtccaagccaagtaacttacttttccaccacctaccaaacgtaaacctaaaacttctacgccaggtaccaacagacacaggacacgtcctactagttcgacttctaatttacgnggtcttccacggcgacgtacgttccggggtccctaggaccccgtacggtccgggggcagggcccggggtaactcggggaactaggtacctttcaacctctaccacatcacgtcacgccgngacgaggacgtaggagtacgtggtagtactttagttacgtactacggtactacgttactttaattttctttaccgttaccgttcccggttccgggtacggtaccggttacgggaaccggtaacgggttaccggaaggggttaacgtaaaccgtacggaacggttaccgttacgttcggaccgtctaccgaccgttacctcgttccgttcg

SEQ ID NO: 320151 - DNA, 615 bp, Homo sapiens
  misc_feature: GZ8MTXP01C3WZ7.19.67.G01.1.454.CMB.2.raw
  modified_base (258)..(258): a, c, t, g, unknown or other
  misc_feature (258)..(258): n is a, c, g, or t
  modified_base (269)..(269): a, c, t, g, unknown or other
  misc_feature (269)..(269): n is a, c, g, or t
  modified_base (298)..(298): a, c, t, g, unknown or other
  misc_feature (298)..(298): n is a, c, g, or t
  modified_base (304)..(304): a, c, t, g, unknown or other
  misc_feature (304)..(304): n is a, c, g, or t
  modified_base (350)..(350): a, c, t, g, unknown or other
  misc_feature (350)..(350): n is a, c, g, or t
tcagtactctcgtgcacgaccggtgctcgatttagagtatacatattgggtttgggggggtagctcaggaagcagagcctggagcatctccactatggcctgggctccactacttctcaccctcctcgctcactgcacaggttcttgggcctaactttatgctgactcacgccccactctgtgtcggagtcgtcggggaagacggtaaccattctttcgcacccacaacagtgacaacattgaccagtctaatttcgngcagtcgtacngcacgcgcccggcacgtccccactatgtnatctanggaagataatacgaaacgtccgtcgtcgggtcctgtacgtcggttntcgtccgcctctagtccgactaactcctcctacaacctctaccgccctcccacacctactctcgtacggactaggaacgacgtagggacgacggtacggctagtaaccttacgtacggttcgtacgttagttacttagtagaacgtcggccgtcggtatgtcgggttcgtcggtcggggacggtacggacgtaacggtcgttaaccgggttcgttaccggtggacccgaacggcccgacggttcccgtcccgttcccccggttgg

SEQ ID NO: 320152 - DNA, 627 bp, Homo sapiens
  misc_feature: GZ8MTXP01CJZ2Y.19.67.G01.1.454.CMB.2.raw
  modified_base (222)..(222): a, c, t, g, unknown or other
  misc_feature (222)..(222): n is a, c, g, or t
  modified_base (255)..(255): a, c, t, g, unknown or other
  misc_feature (255)..(255): n is a, c, g, or t
  modified_base (278)..(278): a, c, t, g, unknown or other
  misc_feature (278)..(278): n is a, c, g, or t
  modified_base (294)..(294): a, c, t, g, unknown or other
  misc_feature (294)..(294): n is a, c, g, or t
  modified_base (431)..(431): a, c, t, g, unknown or other
  misc_feature (431)..(431): n is a, c, g, or t
tcagtactctcgtgcacgaccggtgctcgatttagagtatacatattgggtttggggggtagctcaggaagcagagcctggagcatctccactatggcctgggctccactacttctcaccctcctcgctcactgcacaggttcttgggccaactttatgctgactcagccccactctgtgtcggagtcgtccggggaagacggtaaccatctttgcacccanaacagtggcaaacattgccagactaatttttgngcagtgtaccagcagcgcccggnacgtcccccactatgngatctatgagataatacaaaagcccgtgtcggggccctgtatccggttctcgtcgctcatcgacaacgctccctacaacgtctgcccctaccctcaccactcgtctcggacagaagacgtggacggacgaggtactnacttaacctattgtacctagtcgtttaaatgtaacgtacggtaccggtcgtacgtaggttcgggttcgggttaaccgggttcggggacgggtaaccgggaacccgtaaacggtaccgttacggttaccccgttaccgtaacggtacccgtaaccggtacccggaccggttcccgttccccggttcccccggttccg

SEQ ID NO: 320153 - DNA, 779 bp, Homo sapiens
  misc_feature: GZ8MTXP01A2Z9Z.19.67.G01.1.454.CMB.2.raw
  modified_base (257)..(257): a, c, t, g, unknown or other
  misc_feature (257)..(257): n is a, c, g, or t
  modified_base (430)..(430): a, c, t, g, unknown or other
  misc_feature (430)..(430): n is a, c, g, or t
tcagtactctcgtgcacgaccggtgctcgatttagagtatacatattgggtttggggggtagctcaggaagcagagcctggagcatctccactatggcctgggctccactacttctcaccctcctcgctcactgcacaggttcttgggccaactttatgctgactcacgcccactctgtgtcggagtccgtccggggaagacggtaaccattctttcgcaacccacaacagtggacaacattgccagtctaatttgngcagtcggtacagcaggcgcccgggactaccgttcccccaacgtagttgtagtactctagtggaacggtaataaatacgaaaacgtccggttcgtcgggggttaccctagtaacgttcggttctacgtcggaccttacaagtccgaactcgcccttcccgtactaaccttccnccgtccccttacccctactaacccgtattccgtacgtcgggtaactacggtaaacggtaccgtagggaacgggaaccgtagggtacctaaaggtaccgttaaccttaagggttcccggtattaacgttaccgtttaaatccggggtaaataacccggtaccgggtcgttaaaccgtcggtttggggttcgggttccgtttacggggggaccgggtaaacggggttaaaccccgaaaggttccgttacccggggacccgtttaaccccggaaagggggttccccaaaccgggggttaacccctaaccggggggaccctttccccgggttccccccgggtttaacccgggg

SEQ ID NO: 320154 - DNA, 620 bp, Homo sapiens
  misc_feature: GZ8MTXP01CPO60.19.67.G01.1.454.CMB.2.raw
  modified_base (561)..(561): a, c, t, g, unknown or other
  misc_feature (561)..(561): n is a, c, g, or t
  modified_base (575)..(575): a, c, t, g, unknown or other
  misc_feature (575)..(575): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtgggcggaggcttggtccagccgtggggcggtctctgagactgtcctgtcgaaccctctggggtctccgtcagcagcgactgtattgccgtgggtccgccgaggcctccgagggggaaggagggccgggaggtcggggtcgcgtaggttatttttagagggtgggaccgacagttcgtaacgggagaacttcccgaagttgggacgggccgtattccgaacctatcctcccagtacgtacttttctacaagtaaacactaactgtacctactttacaaattcgaaacgaagtccgtaggacgggccgaaggaccgacggtccgtacttattagttgtgtgtagttagtttacgnggtacgagttcggngttagggtggactggacttcgacgttcgggggccgtaaccggggg

SEQ ID NO: 320155 - DNA, 673 bp, Homo sapiens
  misc_feature: GZ8MTXP01BPOPV.19.67.G01.1.454.CMB.2.raw
  modified_base (282)..(282): a, c, t, g, unknown or other
  misc_feature (282)..(282): n is a, c, g, or t
  modified_base (414)..(414): a, c, t, g, unknown or other
  misc_feature (414)..(414): n is a, c, g, or t
  modified_base (448)..(448): a, c, t, g, unknown or other
  misc_feature (448)..(448): n is a, c, g, or t
tcagtactctcgtgcacgaccggtgctcgatttagagtatacatattggggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgcaacgtgggtggagacgtgggcggaggcttgggtccagcctgggcggtctctgagctgtcctgtcgaaccctgtggggtactccgtnagcagcgactgtattcgccgtgggtccgccaggcctaccgaggggaaggacggccgggagtcgggggtcgcgtaggtttattttaggacgggttaggggaaccccacgtacttacgtaacgggagtaaaccnccgtaaggtcgggacggggcctacttccaacctntccctcagactaactttcatagaactacacttgtctacttacaaatgaaactacgccgtggacgggccgaagggaccgacggggtacccttcgtaattattgggtgtaacgtaagggttaaacgtttgttacgggacgtaacgttcggggttacgttaggggaagggtaaaccgaacggtaacgtaccgggttacggggtaaccgggggaacccggtaaccgggg

SEQ ID NO: 320156 - DNA, 754 bp, Homo sapiens
  misc_feature: GZ8MTXP01EDJK6.19.67.G01.1.454.CMB.2.raw
  modified_base (312)..(312): a, c, t, g, unknown or other
  misc_feature (312)..(312): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgcaacgtgggtggagacgtgggcggaggcttggtccagccgtgggcggtctctgagactgtcctggtacgaaccctcgtggggtctccgtcagcagcgactgtatcgccgtgggtcccncgaggctaccgaggggaagaggccggaggtgggtcgcgtaggttattttagaggggtggaccgtactagttacgtaacgggagtaacctccgaaggtcggggaacggggtcccggtaactttccgaaaccctagttacccgtacccgaaggtacgttaccctttttacaccgaaaggtaaacctaacctaacgttcggttaccttaccttaacctaaaagttccggaaaaccgacgggtaccccgttaaggggaaccgggggaccccggaaggggaaacccgtacggggttaccccggttacttaaagttttaacggttggttgggttaaggtaacgggttaaggttttaacgttggggtccggttaagttggggttcgttagggggtaacggacgtaaggtacgttacggaacgggttcgggggaacccgtaaaccggggg

SEQ ID NO: 320157 - DNA, 779 bp, Homo sapiens
  misc_feature: GZ8MTXP01C9FBI.19.67.G01.1.454.CMB.2.raw
  modified_base (316)..(316): a, c, t, g, unknown or other
  misc_feature (316)..(316): n is a, c, g, or t
  modified_base (693)..(693): a, c, t, g, unknown or other
  misc_feature (693)..(693): n is a, c, g, or t
tcagtactctcgtgcacgaccggtgctcgatttagagtatacatattgggtttggggggggagaggagcccagcactgggattccgaggtgtttccattcggtgctcagcactgaacacagaggactcaccatggagtttggctgacctgggttttccttgctgcaatttcaggaggtgtccagtgtgaggtgcaacgtgggtggagtacgtgggcgggaggtcttgggtccaggtccgtggggcggtctctgagactgtcctgtcgaacccgtgtcggggtctcgtcagcagcactgtattcgccgtgggtcccncgaggctaccggagggggaacgacgggccggaggtcggggtcgacgtaggtttatttttaagaggggtggtaaccgactagtttcgaacgggacgtaaacttcccaaggtcggggaacggggtccctaaactttcccgaaaaccctacgttacccgtacccgtaaagggaccgttttaaacccgttttttcaaccgaaacggtaaaacctaacccttaacgttcggttacctttaccgtaacaaaaacgttcgaaaaccggtacgggtaccccggttaagggaaccgggggcccgtaaacggggaccgtacccggggttacccggtttacttaaagtttaccgttgggttaggtaaccggtaagtttacgggtttanccggggttacgaaggtttcggggcgttagggtaaccggaagtaacgtactacgggttaaccggtcgggggaacccgtaaccggggg

SEQ ID NO: 320158 - DNA, 502 bp, Homo sapiens
  misc_feature: GZ8MTXP02IFW53.19.67.G01.1.454.CMB.2.raw
  modified_base (306)..(306): a, c, t, g, unknown or other
  misc_feature (306)..(306): n is a, c, g, or t
  modified_base (368)..(368): a, c, t, g, unknown or other
  misc_feature (368)..(368): n is a, c, g, or t
  modified_base (487)..(487): a, c, t, g, unknown or other
  misc_feature (487)..(487): n is a, c, g, or t
tcagtactctcgtgcacgaccggtgctcgatttagagtatacatattgggtttggggagctacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacattttcccactccaagaacaaaactctagcctggtaccaacagagaccaggacagcctctaagttgctcatttacngggcttctacgcgcgaattccggggtcctgaccccgattccggggcaggcgggtctgggacngtatttcactctcacatcagcagcctgcaggctagaagatgtgcagttttatactgtcagcaattattttcttatccttcgtggacgttcggacaagggccagggtgaaatcagacacngtgctgcaccatctg

SEQ ID NO: 320159 - DNA, 529 bp, Homo sapiens
  misc_feature: GZ8MTXP02HT7MH.19.67.G01.1.454.CMB.2.raw
  modified_base (396)..(396): a, c, t, g, unknown or other
  misc_feature (396)..(396): n is a, c, g, or t
  modified_base (404)..(404): a, c, t, g, unknown or other
  misc_feature (404)..(404): n is a, c, g, or t
  modified_base (484)..(484): a, c, t, g, unknown or other
  misc_feature (484)..(484): n is a, c, g, or t
tcagtactctcgtgcacgaccggtgctcgatttagagtatacatattgggtttgggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctggtccgccaggctccagggaagaggccggagtgggtcgcgaggtatttttagaggtgggaccgacattctacggagactcagtggaggccgattcgcatctcagngactttcncagaacacactgtctacttacaaattgaaacagtcctgagggcccgaggacacggcgtctattatgtgtgagtagtttanggacgagtggctggtcgagagatcaacgtcgggggaccaacgggg

SEQ ID NO: 320160 - DNA, 533 bp, Homo sapiens
  misc_feature: GZ8MTXP02H7J4V.19.67.G01.1.454.CMB.2.raw
  modified_base (257)..(257): a, c, t, g, unknown or other
  misc_feature (257)..(257): n is a, c, g, or t
  modified_base (416)..(416): a, c, t, g, unknown or other
  misc_feature (416)..(416): n is a, c, g, or t
  modified_base (478)..(478): a, c, t, g, unknown or other
  misc_feature (478)..(478): n is a, c, g, or t
  modified_base (491)..(491): a, c, t, g, unknown or other
  misc_feature (491)..(491): n is a, c, g, or t
  modified_base (496)..(496): a, c, t, g, unknown or other
  misc_feature (496)..(496): n is a, c, g, or t
tcagtactctcgtgcacgaccggtgctcgatttagagtatacatattgggtttggggagaggagcccagcactgggattccgaggtgtttccattcggtgctcagcactgaacacagaggactcaccatggagttttggctgacctgggtttccttgctgcaatttcaggaggtgtccagtgtgaggtgcaactggtggagactggcggaggcttggtccagcctgggcggtctctgagactgtcctgtgaaccctntggggtctcgtcagcagcgactgtattgctggtccgccaggctccagggaagaggccggagtgggtcgcgaggtatttttagaggtgggaccgactattcgtacggagacttccagtgggagggcccgagttccaccgatctacccagagtacttttcncagtaacacactgtctcttacaaattgaacagcctgagggccgagacacggcgtctatatgngtgagtagtttanacggnagtggctggtggacagctcacgtcggggccaacgggg

SEQ ID NO: 320161 - DNA, 552 bp, Homo sapiens
  misc_feature: GZ8MTXP02G9OHX.19.67.G01.1.454.CMB.2.raw
  modified_base (365)..(365): a, c, t, g, unknown or other
  misc_feature (365)..(365): n is a, c, g, or t
tcagtactctcgtgcacgaccggtgctcgatttagagtatacatattgggtttgggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtaccgccagggctccgaggggaagagggccggaggtggggtcgcagggtatttttagagggtgggaccganattctacgggagactcatgggagggccgattcacatctccagagacttttcacagaacacactgtctcttacaaatgaacagcctgaggggccaggaccacggcgtctattatgtgttgagtagtttatgggacgtagtgggcgttgggaagggacaaggatacgacgtcgggggaccaaacggggg

SEQ ID NO: 320162 - DNA, 532 bp, Homo sapiens
  misc_feature: GZ8MTXP02HN6ZW.19.67.G01.1.454.CMB.2.raw
  modified_base (242)..(242): a, c, t, g, unknown or other
  misc_feature (242)..(242): n is a, c, g, or t
  modified_base (530)..(532): a, c, t, g, unknown or other
  misc_feature (530)..(532): n is a, c, g, or t
tcagtactctcgtgcacgaccggtgctcgatttagagtatacatattgggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggaggccgattcaccatctccagagacttttcncagaacacactgtctcttcaaatgacagcctgagggccgaggacacggccgtctattattgtgtgagagtttatggcgatgggctggtggacagatcacgtggggccaggggaccctggtccaccgtctcctcagccctccaccgaagggccccagtcggtccttcccccgtggccgccctgcctccgaggacgccacctccgagacgcacgagccggccctgggctgcctggtcaaggctacttcccacgagacgtactggacgcgggctggcaagggcgcagtagnnn

SEQ ID NO: 320163 - DNA, 509 bp, Homo sapiens
  misc_feature: GZ8MTXP02JSSWF.19.67.G01.1.454.CMB.2.raw
  modified_base (249)..(249): a, c, t, g, unknown or other
  misc_feature (249)..(249): n is a, c, g, or t
tcagtactctcgtgcacgaccggtgctcgatttagagtatacatattgggtttgggggtagctcaggaagcagagcctggagcatctccactatggcctgggctccactacttctcaccctcctcgctcactgcacaggttcttgggccaactttatgctgactcagccccactctgtgtcggagtctccggggaagacggtaaccatctttgcacccacaacagtggcaacattgccagcaattttgngcagtggtaccagcagcgcccgggcagttcccccacattgtgatctatgaggataatcaaaagaccgtctggggtccctgatcggtctctggctccatcgacagctccctcaaactctgcctccctcaccatctctggactgaaagactgaggacgaggctgactatactgtcagtcttaatgatagcgcggtcagtgtggtcttcgggcggagggaccaagctcgaccgtctaaggcacgcccaaggctcgcccctcgg

SEQ ID NO: 320164 - DNA, 545 bp, Homo sapiens
  misc_feature: GZ8MTXP02G3K9B.19.67.G01.1.454.CMB.2.raw
  modified_base (299)..(299): a, c, t, g, unknown or other
  misc_feature (299)..(299): n is a, c, g, or t
  modified_base (501)..(501): a, c, t, g, unknown or other
  misc_feature (501)..(501): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagtttggctgacctgggttttcctgctgcaatttcaggaggtgtccagtgtgaggtgcaactggtggagactggcggaggcttggtccagccgtgggcggtctctgagactgtcctgtcgaaccctcgtggggtctccgtcagcagcgactgtatgcctgggtccnccaggctccgaggggaagaggccggaggtggggtcgcgtaggtatttttagagggtggaccgacattcgtacggagactcagtggagggccgattcacatctaccagagtactttctcaagaacacactgtctcttacaaatgaaacagcctgacgggccgaggacgacggccgtactagttatgtgtagagtagtttaggnggacgagtggcgtggtaagagagactacgacggcgggacgacgg

SEQ ID NO: 320165 - DNA, 523 bp, Homo sapiens
  misc_feature: GZ8MTXP02GHZYV.19.67.G01.1.454.CMB.2.raw
  modified_base (374)..(374): a, c, t, g, unknown or other
  misc_feature (374)..(374): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttgggtccagcctgggcggtctctgagactgtcctgtgaaccctctggggtctccgtcagcagcgactgtattgcctgggtccgccaggctccagggaagaggccggagtgggtcgcaggtatttttagtaggtgggacgacattctacggagnttccatggagggccgattcaccatctccagagtactttctcagaacacactgtctcttacaaatgaacagcctgacggccgaggacacggccgtctattatgtgtgagtagttatggcgatggcgtggtggacagactcgacgtcgggg

SEQ ID NO: 320166 - DNA, 254 bp, Homo sapiens
  misc_feature: GZ8MTXP02IF81U.19.67.G01.1.454.CMB.2.raw
  modified_base (251)..(254): a, c, t, g, unknown or other
  misc_feature (251)..(254): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggccagcctgagcgggctggcaaggcgcatagnnnn

SEQ ID NO: 320167 - DNA, 532 bp, Homo sapiens
  misc_feature: GZ8MTXP02IEJAD.19.67.G01.1.454.CMB.2.raw
  modified_base (411)..(411): a, c, t, g, unknown or other
  misc_feature (411)..(411): n is a, c, g, or t
tcagtactctcgtgcacgaccggtgctcgatttagagtatacatattgggtttgggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccgagggaagaggccggagtggggtcgcagggtatttttagtaggtgggaccgacattctacggagactccagtggagggccgattcacatctccagagactttcncagaacacactgtctcttcaaatgaaacagcctggagggccgaggacacggccgtctattattgtgtgagtagtttatggcgagtggctgggtgacaggatcgacgtgggggccaacgggg

SEQ ID NO: 320168 - DNA, 533 bp, Homo sapiens
  misc_feature: GZ8MTXP02G9U8G.19.67.G01.1.454.CMB.2.raw
  modified_base (408)..(408): a, c, t, g, unknown or other
  misc_feature (408)..(408): n is a, c, g, or t
  modified_base (415)..(415): a, c, t, g, unknown or other
  misc_feature (415)..(415): n is a, c, g, or t
  modified_base (488)..(488): a, c, t, g, unknown or other
  misc_feature (488)..(488): n is a, c, g, or t
tcagtactctcgtgcacgaccggtgctcgatttagagtatacatattgggtttgggggagaggagcccagcactgggattccgaggtgtttccattcggtgctcagcactgaacacagaggactcaccatggagttttggctgacctgggtttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccgaggggaagaggccggagtgggtcgcgaggtatttttagaggtgggaccgacattctacggagactcagtgggaggccgattcacatctcagagtactttcncagaacncactgtctcttacaaatgaaacagcctggagggccaggacacgggccgtactattattgtgtgagtagtttanggcgatggctgggtgacaggactcgacgtcgggggcctaacgggg

SEQ ID NO: 320169 - DNA, 525 bp, Homo sapiens
  misc_feature: GZ8MTXP02I1W96.19.67.G01.1.454.CMB.2.raw
  modified_base (237)..(237): a, c, t, g, unknown or other
  misc_feature (237)..(237): n is a, c, g, or t
  modified_base (448)..(448): a, c, t, g, unknown or other
  misc_feature (448)..(448): n is a, c, g, or t
tcagtactctcgtgcacgaccggtgctcgatttagagtatacatattgggtttggggagctacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacattttcnccacctccaagaacaaaacttctagcctgtaccaacagagaccaggacagcctacctaagttgctcatttactgggtcttctacgcgcgaattccggggtcctgaccccgagttccggggcacggcgggtctgggacagtatttcgactctcaccatcagcagcctagcaggctagaagatgtggactagtttattactgtcagctaattnttttctatcctcgtgtacgttcggcgaagggccagggtacgaaatcaacgacgaacgtgtcggctcgcaccagtctg

SEQ ID NO: 320170 - DNA, 544 bp, Homo sapiens
  misc_feature: GZ8MTXP02JDYVT.19.67.G01.1.454.CMB.2.raw
  modified_base (369)..(369): a, c, t, g, unknown or other
  misc_feature (369)..(369): n is a, c, g, or t
  modified_base (421)..(421): a, c, t, g, unknown or other
  misc_feature (421)..(421): n is a, c, g, or t
  modified_base (490)..(490): a, c, t, g, unknown or other
  misc_feature (490)..(490): n is a, c, g, or t
  modified_base (514)..(514): a, c, t, g, unknown or other
  misc_feature (514)..(514): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctcgtggggtctccgtcagcagcgactgtatgcctggtccgccaggctccgagggaagaggccggagtgggtcgcgaggttattttagaggtgggaccgacattcgtacggngactccgagtgggacgggccgtattcaccagtcctaccagtacgtactttcnctaagaacactactgtctacttacaaatgaaacagcctggacgggccgaggacacggcgtctattatgngtgagtagttatggcgtagtcggngtggtggacagactcacgtggacgaacggg

SEQ ID NO: 320171 - DNA, 528 bp, Homo sapiens
  misc_feature: GZ8MTXP02F02HL.19.67.G01.1.454.CMB.2.raw
  modified_base (349)..(349): a, c, t, g, unknown or other
  misc_feature (349)..(349): n is a, c, g, or t
  modified_base (495)..(495): a, c, t, g, unknown or other
  misc_feature (495)..(495): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctgggcgtctctgagctgtcctgtgaaccctctggggtctccgtcagcagcgactgtattgcctgggtccgccaggctccagggaagaggccggagtggggtcgcgaggtatttttanaggtgggacgacattcgtacggagactccatggagggccgattcgacatctccagagtacttttctacagtaacacactagtctacttcaaatgaacagccctgaacgggccgaggacacggcgtctattatgtgtgagtagttanggcgatggctggtggacagactcgacgtcgggg

SEQ ID NO: 320172 - DNA, 541 bp, Homo sapiens
  misc_feature: GZ8MTXP02GAAE8.19.67.G01.1.454.CMB.2.raw
  modified_base (379)..(379): a, c, t, g, unknown or other
  misc_feature (379)..(379): n is a, c, g, or t
  modified_base (413)..(413): a, c, t, g, unknown or other
  misc_feature (413)..(413): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtcgaaccctctggggtctccgtcagcagcgactgtattgcctgggtccgccaggctccgaggggaagaggccggagtggggtcgcgtaggtatttttagaggtgggaccgacattctacggagactcngtgggaggccgattcacatctcagagtactttcncagaacacactgtctcttacaaatgaaacagcctaggacgggccgaggacacggcgtctagttatgtgtgagtagtttagtggcgagtggctgggtggacaggactcgacggtcggggaccaacgggg

SEQ ID NO: 320173 - DNA, 556 bp, Homo sapiens
  misc_feature: GZ8MTXP02JNOIY.19.67.G01.1.454.CMB.2.raw
  modified_base (504)..(504): a, c, t, g, unknown or other
  misc_feature (504)..(504): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctgggcggtctctgagactgtcctgtgaaccctctggggtctccgtcagcagcgactgtattgcctgggtccgccaggctccgagggaagaggccggaggtgggtcgcaggtatttttagagggtgggacgacagttctacggagactccagtgggaggccgattcaccatctaccagagtactttctacagaaacaccactgtctacttacaaaacttgaaacagcctggacgggccgaaggacacggccgtctattagtgtgtgagtagtttagnggcgtagtggctgggtggacaggtactcgacggtcggggaccgtaaccgggg

SEQ ID NO: 320174 - DNA, 545 bp, Homo sapiens
  misc_feature: GZ8MTXP02HCA1D.19.67.G01.1.454.CMB.2.raw
  modified_base (294)..(294): a, c, t, g, unknown or other
  misc_feature (294)..(294): n is a, c, g, or t
  modified_base (438)..(438): a, c, t, g, unknown or other
  misc_feature (438)..(438): n is a, c, g, or t
  modified_base (448)..(448): a, c, t, g, unknown or other
  misc_feature (448)..(448): n is a, c, g, or t
tcagtactctcgtgcacgaccggtgctcgatttagagtatacatattgggtttgggggtagctcaggaagcagagcctggagcatctccactatggcctgggctccactacttctcaccctcctcgctcactgcacaggttcttgggccaactttatgctgactcagccccactctgtgtcggagtcgtccggggaagacggtaaccatcttttgcacccacaacagtggcaacattgccagctaattttgtgcagtggtaccagcagcgcccgggcacgttcccccacattgngatctatgaggataatcaaagaccgtcgtggggtccctgattcggtctcgtcggctccatcgacagctcctccaactcctcgccctccctcacccatcctctgactgaagctgaggacgagctgactactactgtcagtcttangatacgccgnggtcagtgtggttcgttcggggcgggtacggggaccaaggcgttacggacccgttccgtaagggtcacggaccccgaaggccctccggccccctcgg

SEQ ID NO: 320175 - DNA, 571 bp, Homo sapiens
  misc_feature: GZ8MTXP02IGCVT.19.67.G01.1.454.CMB.2.raw
  modified_base (299)..(299): a, c, t, g, unknown or other
  misc_feature (299)..(299): n is a, c, g, or t
  modified_base (408)..(408): a, c, t, g, unknown or other
  misc_feature (408)..(408): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactgggtggagactgggcggaggcttggccagcctgggcggtctctgagactgtcctgtgaaccctctggggtctccgtcagcagcgactgtatgcctgggtccnccaggctccgaggggaagaggccgggagtggggtcgcgtaggttatttttagagggtgggaccgacagttcacggagactcagtggagggccgattccacatctccagngtactttctacagaacacactgtctacttacaaattcgaaacacgtacccgtaggacggggaccgaggggaaccaccgggtccgtacttagttagtttggtgtagaggtagtttacgtgggcgtagtggtctgggtgacaggatcgacgtggggccaacgggg

SEQ ID NO: 320176 - DNA, 519 bp, Homo sapiens
  misc_feature: GZ8MTXP02HHY99.19.67.G01.1.454.CMB.2.raw
  modified_base (237)..(237): a, c, t, g, unknown or other
  misc_feature (237)..(237): n is a, c, g, or t
  modified_base (411)..(411): a, c, t, g, unknown or other
  misc_feature (411)..(411): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctgcgggacatcgtgatgacccagtacccagactcactggctgtgtctctgggcgagacggccacaatcaactgcaggtccagccagaacattttcnccactcaagaacaaaacttctagcctgtaccaacagagaccaggacagcctcctaagttgctcatttactgggctttctacgcgcgaaagttccggggccctgaccccgtagttccggggcaggcggtctgggcagatttcactctcaccatcagcagcctgcaggctgaaagntgtggactagtttatactgctatcaatttattttctattcctcgtgtacgtcggcaagggccagggtgaaaactcgacgacgaactgtagcctgaccaccgatcgtcg

SEQ ID NO: 320177 - DNA, 540 bp, Homo sapiens
  misc_feature: GZ8MTXP02HAUXG.19.67.G01.1.454.CMB.2.raw
  modified_base (496)..(496): a, c, t, g, unknown or other
  misc_feature (496)..(496): n is a, c, g, or t
tcagtactctcgtgcacgaccggtgctcgatttagagtatacatattgggtttgggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagccctgggcggtctctgagactgtcctgtcgaaccctctggggtctccgtcagcagcgactgtatgcctggtccgccaggctccagggaagaggccggagtgggtcgcaggttatttttagaggtgggaccgacattcgacggagacttcagtgggagggccgattcaccatctccagagacttttctcaagaacacactgtctcttcaaaatgaaaccagtcgttaggagggggcgaggacacggccgtactattatgtgtgagtagtttanggcgagtggctgggtggacagatcacggtcggggacgaacgggg

SEQ ID NO: 320178 - DNA, 535 bp, Homo sapiens
  misc_feature: GZ8MTXP02JQJED.19.67.G01.1.454.CMB.2.raw
tcagtactctcgtgcacgaccggtgctcgatttagagtatacatattgggtttgggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagaggccggagtggggtcgcgtaggtatttttagtaggtgggaccgacattctacggagactccatggagggccgattcaccatctccagagtactttctcagaacacactgtctcttcaaatgaaacagcctgagggccgaggacacggccgtctattattgtgtgagtagtttatgggactagtggctgggtggacaggatcacgtcgggggcaacggggg

SEQ ID NO: 320179 - DNA, 571 bp, Homo sapiens
  misc_feature: GZ8MTXP02GWT18.19.67.G01.1.454.CMB.2.raw
  modified_base (419)..(419): a, c, t, g, unknown or other
  misc_feature (419)..(419): n is a, c, g, or t
  modified_base (517)..(517): a, c, t, g, unknown or other
  misc_feature (517)..(517): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactgggtggagacgtgggcggaggcttggtccaggcccgtggggcggtctctgagactgtcctgtcgaaccctcgtggggtctccgtcagcagcgactgtattgcctgggtccgccaggctccgaggggaagaggccggagtggggtcgcgaggttatttttagaggtggacgacattcgtaggagactcagtggaggccgattcgacatctcagagtactttcnaagtaacacactcgtctacttacaaaatcgaaacacgtcctaggacggggccgaacggacgaccgggcgtactattagtggtagtgagttaggtttangggtcgaagtggtcgtggtaaggacagtactcgacggtcggggaccgaacgggg

SEQ ID NO: 320180 - DNA, 496 bp, Homo sapiens
  misc_feature: GZ8MTXP02GPDMR.19.67.G01.1.454.CMB.2.raw
  modified_base (437)..(437): a, c, t, g, unknown or other
  misc_feature (437)..(437): n is a, c, g, or t
tcagtactctcgtgcacgaccggtgctcgatttagagtatacatattgggtttgggggtagctcaggaagcagagcctggagcatctccactatggcctgggctccactacttctcaccctcctcgctcactgcacaggttcttgggccaactttatgctgactcagccccactctgtgtcggagtctccggggaagacggtaaccatcttttgcacccacaacagtggcaacattgccagcaattttgtgcagtggtaccagcagcgcccgggcagttcccccacatgtgatctatgaggataatcaaaagaccgtctggggtccctgatcggttctctggctccatcgacagctcctccaactctgccctccctcacccatctctgactgaagactgagacgagctgactatactgtcagtcttatgatagccgnggtcatgtgtcttcggcggaggaccagctgaccgtctaaggcagcccagctcgccctcg

SEQ ID NO: 320181 - DNA, 568 bp, Homo sapiens
  misc_feature: GZ8MTXP02I8O80.19.67.G01.1.454.CMB.2.raw
  modified_base (246)..(246): a, c, t, g, unknown or other
  misc_feature (246)..(246): n is a, c, g, or t
  modified_base (566)..(568): a, c, t, g, unknown or other
  misc_feature (566)..(568): n is a, c, g, or t
tcagtactctcgtgcacgaccggtgctcgatttagagtatacatattgggcttggtccagcctgggcggtctctgagactgtcctgtgaaccctctggggtctccgtcagcagcgactgtattgcctgggtccgccaggctccagggaagaggccggagtgggtcgcaggtatttttatagggtgggacgacatttctacggagactccatggagggccgattcaccatctccagagtacttttcncagaacacactgtctcttcaaatgaacagcctgagggccgaggacacggccgtctattattgtgtgagtagtttatggcatgggctgggtggacagatcgaccgtggggccaggggaacccctgggtccaccgtctcctcagccctccacgaacgggcccagtccggtcctccccgtggcccgccctgcctccgagggacgccaccgtccggagacgcacgacggcccgggcccgtggggcctcggcccgtgggtaccaagggtacctaccgttcccacggagacggtactggacgcggggctgggcgaaggcgacatgnnn

SEQ ID NO: 320182 - DNA, 536 bp, Homo sapiens
  misc_feature: GZ8MTXP02GZ2OQ.19.67.G01.1.454.CMB.2.raw
  modified_base (485)..(485): a, c, t, g, unknown or other
  misc_feature (485)..(485): n is a, c, g, or t
tcagtactctcgtgcacgaccggtgctcgatttagagtatacatattgggtttgggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccaggggaagaggccggagtgggtcgcgaggtatttttagaggtgggacgacattctacggagactcatggaggccgattcaccatctccagagactttctcagaacacactgtctacttcaaaatgaaacagcctgagggccaggacacggccgtctattagttgtgtgagagtttagnggacgagtcggtcgtggtaagacgagactcgacggtcggggaccgaacggg

SEQ ID NO: 320183 - DNA, 546 bp, Homo sapiens
  misc_feature: GZ8MTXP02JACKO.19.67.G01.1.454.CMB.2.raw
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctggtccgccaggctccgaggggaagaggccggaggtggggtcgcaggtatttttagaggtgggaccgacattctacggagactccagtgggagggccgattcgaccatctccagagacttttcacagaacacactgtctcttcaaattgaaacagtcctgacggggccgaggacacggccgtctattatgtgtgagtagtttagtggcgtagtggtcgtgggtggacgagactcgacgtcggggacgaaccgggg

SEQ ID NO: 320184 - DNA, 588 bp, Homo sapiens
  misc_feature: GZ8MTXP02JBUPV.19.67.G01.1.454.CMB.2.raw
  modified_base (531)..(531): a, c, t, g, unknown or other
  misc_feature (531)..(531): n is a, c, g, or t
tcagtactctcgtgcacgaccggtgctcgatttagagtatacatattgggtttgggggagaggagcccatcactgggattccgaggtgtttccattcggtgctcagcactgaacacagaggactcaccatggagtttggctgacctgggtttcctgctgcaatttcaggaggtgtccagtgtgaggtgcaactggtggagactgggcggaggcttggtccagcctgggcggtctctgagctgtcctgtcgaaccctgtggggtctcgtcagcagcgactgtattgccgtggtccgcaggctccgagggaagaggccggagtgggtcgcgtagggttatttttagagggttgggaccgtactagtttacgtacgggataaccgtccgaggtcgggaacgggggccgtaattccgaacctacttcctacccgagtacggttaccttttcacaagtaacacacttgtcctactacaaatgaaacagcctggacgggccgaggacacggcgtctattagtgtgtgagtaggttangggcgtagtgggcgttgggtggacgagtactcgaacggtcggggaccgaaaccgggg

SEQ ID NO: 320185 - DNA, 543 bp, Homo sapiens
  misc_feature: GZ8MTXP02GQZMS.19.67.G01.1.454.CMB.2.raw
  modified_base (380)..(380): a, c, t, g, unknown or other
  misc_feature (380)..(380): n is a, c, g, or t
  modified_base (415)..(415): a, c, t, g, unknown or other
  misc_feature (415)..(415): n is a, c, g, or t
  modified_base (491)..(491): a, c, t, g, unknown or other
  misc_feature (491)..(491): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccaggggaagaggccggagtggggtcgcagggttatttttagagggttgggaccgacattctacggagactccngtggagggccgattcacgatctcagagtactttcncagaacacactgtactcttacaaatgaaacagctgagggccgaggacacggcgtctattatgtgtgagtagtttangggctagtcggcgtggtggacagtactcgacgtcgggggacctaaccggggg

SEQ ID NO: 320186 - DNA, 549 bp, Homo sapiens
  misc_feature: GZ8MTXP02J2IRB.19.67.G01.1.454.CMB.2.raw
  modified_base (296)..(296): a, c, t, g, unknown or other
  misc_feature (296)..(296): n is a, c, g, or t
  modified_base (312)..(312): a, c, t, g, unknown or other
  misc_feature (312)..(312): n is a, c, g, or t
  modified_base (375)..(375): a, c, t, g, unknown or other
  misc_feature (375)..(375): n is a, c, g, or t
  modified_base (428)..(428): a, c, t, g, unknown or other
  misc_feature (428)..(428): n is a, c, g, or t
  modified_base (451)..(451): a, c, t, g, unknown or other
  misc_feature (451)..(451): n is a, c, g, or t
  modified_base (502)..(502): a, c, t, g, unknown or other
  misc_feature (502)..(502): n is a, c, g, or t
tcagtactctcgtgcacgaccggtgctcgatttagagtatacatattgggtttgggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagccgtgggcgtctctgagactgtcctgtcgaaccctgtgggtctccgtcagcagcgactgtatgccgtggccncaggctccgagggagnggccggagtgggtcgcgtaggtttattttagagggtggaccgactattcgtacggagacctcngtgggaacgggccgattcaacctatcctaccagtacgtacttttcacagaacncactgtctcttacaaatgaaacncgcgaggacgggacgagacgacggctatattagtgtgtagagtagttacgnggtcgagtcggcgtggaacgacagtactcgacggtcggggacgacgg

SEQ ID NO: 320187 - DNA, 534 bp, Homo sapiens
  misc_feature: GZ8MTXP02GCD3U.19.67.G01.1.454.CMB.2.raw
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctgggcggtctctgagactgtcctgtgaaccctctggggtctccgtcagcagcgactgtattgcctgggtccgccaggctccagggagaggccggagtgggtcgcgaggtatttttagtaggtgggacgacattctacggagctccatgggagggccgattcgaccatctcccagagtacttttctacacgaacacactcgtctcttacaaattgaacagcctgacgggccgaggacacggcctctattatgtgtgagtagtttatggcgagtggcgtgggtggtacagactcacgtcggggg

SEQ ID NO: 320188 - DNA, 543 bp, Homo sapiens
  misc_feature: GZ8MTXP02JX1U3.19.67.G01.1.454.CMB.2.raw
  modified_base (421)..(421): a, c, t, g, unknown or other
  misc_feature (421)..(421): n is a, c, g, or t
  modified_base (502)..(502): a, c, t, g, unknown or other
  misc_feature (502)..(502): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctgggcggtctctgagactgtcctgtgaaccctctggggtctccgtcagcagcgactgtattgcctgggtccgccaggctccgagggaagaggccgggaggtgggtcgcgtaggtatttttagtagggtgggacgacattcgtacggagcctccagtgggagggccgattcacatctccagagactttcncagaacacactgtctcttacaaatgaacagccgtagacggccgaggacgacggcgtactattattgtgtgagtagtttagnggcgagtggcgtgggtacggacgagactcgacgtacggggg

SEQ ID NO: 320189 - DNA, 530 bp, Homo sapiens
  misc_feature: GZ8MTXP02GIKHH.19.67.G01.1.454.CMB.2.raw
  modified_base (292)..(292): a, c, t, g, unknown or other
  misc_feature (292)..(292): n is a, c, g, or t
tcagtactctcgtgcacgaccggtgctcgatttagagtatacatattgggtttgggggtagctcaggaagcagagcctggagcatctccactatggcctgggctccactacttctcaccctcctcgctcactgcacaggttcttgggccaactttatgctgactcagccccactctgtgtcggagtctccggggaagacggtaaccatcttttgcacccacaacagtggcaacattgccagcaattttgtgcagtggtaccagcagcgcccgggcacgttcccccacattgngatctatgaggataatcaaaagccgtctggggtccctgatcggttctctggctccatcgacagctcctcaactctcgccctccctcaccatctctggactgaagactgaggacgaggctgactactactgtcagttcttatgatacgccgtcggtcagtggtggttcgttcgggacgggacgggaccaaggcctcggacccgtcgtaaggtcacgcccaaggcctcgcccccgttcgg

SEQ ID NO: 320190 - DNA, 574 bp, Homo sapiens
  misc_feature: GZ8MTXP02HDEHG.19.67.G01.1.454.CMB.2.raw
  modified_base (265)..(265): a, c, t, g, unknown or other
  misc_feature (265)..(265): n is a, c, g, or t
  modified_base (537)..(537): a, c, t, g, unknown or other
  misc_feature (537)..(537): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtgggcggaggcttggtccagccgtggggcggtctctgagactgtcctgtcgaaccctntggggtctccgtcagcagcgactgtattgcctgggtccgcagggctccgaggggaagaggccggagtgggtcgctagggttatttttagagggtggggaccacatttcgtacggagactccagtgggagggccgattcacatcctaccagagtacttttcacagaacacacttgtctcttacaaaattgaaactagccgtaggacggggccgaaggaccacgggcctatattagtgtgtagagtagtttagtgggacgtagtgggcttgggnggacaggactcgaacggtcgggggaccaaaccggggg

SEQ ID NO: 320191 - DNA, 564 bp, Homo sapiens
  misc_feature: GZ8MTXP02IMFAU.19.67.G01.1.454.CMB.2.raw
  modified_base (301)..(301): a, c, t, g, unknown or other
  misc_feature (301)..(301): n is a, c, g, or t
  modified_base (320)..(320): a, c, t, g, unknown or other
  misc_feature (320)..(320): n is a, c, g, or t
  modified_base (335)..(335): a, c, t, g, unknown or other
  misc_feature (335)..(335): n is a, c, g, or t
  modified_base (374)..(374): a, c, t, g, unknown or other
  misc_feature (374)..(374): n is a, c, g, or t
  modified_base (419)..(419): a, c, t, g, unknown or other
  misc_feature (419)..(419): n is a, c, g, or t
  modified_base (511)..(511): a, c, t, g, unknown or other
  misc_feature (511)..(511): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttcctgctgcaatttcaggaggtgtccagtgtgaggtgcaactggtggagactgggcggaggcttgggtccagcctggggcggtctctgagactgtcctgtgaaccctctggggtctccgtcagcagcgactgtattgcctgggtccnccaggctccgaggggaagnggccggagtgggtcncgaggttattttagaggtgggaccgacagttctacgganacctccagtggagggccgattccgacatctccagacgtactttcncaagtaacactactgtctctcaaaatgaaacagcctaggacgggacccgaggaccacggccgtactagtttagtgtgttagagtagtttagngggacgagtcggctgggtaagacaggtctacgacggtcggggacctaacgggg

SEQ ID NO: 320192 - DNA, 541 bp, Homo sapiens
  misc_feature: GZ8MTXP02GZRQP.19.67.G01.1.454.CMB.2.raw
  modified_base (517)..(517): a, c, t, g, unknown or other
  misc_feature (517)..(517): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttgggtccagcctgggcggtctctgagactgtcctgtgaaccctctggggtctccgtcagcagcgactgtattgcctgggtccgccaggctccgagggaagaggccggagtgggtcgcgaggtatttttagaggtgggacgacattctacggagactccagtgggagggccgattcacatctccagagtactttcgtacagaacacactgtctcttacaaatcgaaacacgctaggacgggaccgaggacacggccgtctattattgtgtgagtagtttatggacgagtggctgggtganaggatcgacgtcgggacaacgggg

SEQ ID NO: 320193 - DNA, 559 bp, Homo sapiens
  misc_feature: GZ8MTXP02GMRVP.19.67.G01.1.454.CMB.2.raw
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagctgtcctgtgaaccctctggggtctccgtcagcagcgactgtattgcctgggtccgccaggctccgagggaagagggccggagtgggtcgcagggtatttttagaggtggggaccgacattctacggagactccagtgggacgggccgtattccaccatcctacccagtagtaccttttcacaagtaaacactactcgtctacttacaaaatgaaacagcctggacgggccgaggacacggccgtctattagtagtgtgagtagtttatgggcgagtgggctgggtgacagactcgacgtcggggaccgtaacgggg

SEQ ID NO: 320194 - DNA, 571 bp, Homo sapiens
  misc_feature: GZ8MTXP02F409J.19.67.G01.1.454.CMB.2.raw
  modified_base (319)..(319): a, c, t, g, unknown or other
  misc_feature (319)..(319): n is a, c, g, or t
  modified_base (364)..(364): a, c, t, g, unknown or other
  misc_feature (364)..(364): n is a, c, g, or t
  modified_base (382)..(382): a, c, t, g, unknown or other
  misc_feature (382)..(382): n is a, c, g, or t
  modified_base (419)..(419): a, c, t, g, unknown or other
  misc_feature (419)..(419): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccaggcctgggcggtctctgagactgtcctgtcgaaccctcgtggggtctccgtcagcagcgactgtatgcctggtccgccaggctccgagggaagnggccggaggtgggtcgcgtaggttatttttagaggtgggaccganattcgtacggagactccngtgggagggccgattcacatctccagtagtactttcncaagaacacactcgtctacttacaaatcgaaacagccgtaggacgggaccggaacggaccgacggtccgtacttattagttgtgtgagtagtttagtggcgtagtcggcgtgggtaaggacaggactcgacggtcggggaccgtaaccgggg

SEQ ID NO: 320195 - DNA, 567 bp, Homo sapiens
  misc_feature: GZ8MTXP02GIM79.19.67.G01.1.454.CMB.2.raw
  modified_base (305)..(305): a, c, t, g, unknown or other
  misc_feature (305)..(305): n is a, c, g, or t
  modified_base (369)..(369): a, c, t, g, unknown or other
  misc_feature (369)..(369): n is a, c, g, or t
  modified_base (380)..(380): a, c, t, g, unknown or other
  misc_feature (380)..(380): n is a, c, g, or t
  modified_base (519)..(519): a, c, t, g, unknown or other
  misc_feature (519)..(519): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagccgtggggcggtctcgtgagactgtcctgtcgaaccctcgtggggtctccgtcagcagcgactgtattgcctgggtccnccaggctccgaggggaagagggccggaggtgggtcgcgtaggttattttagagggtggaccganattcgacgganacctcagtggagggccgattccacatcctccagtacgtcttttcacaagaacacactcgtctctacaaatcgaacagccgtaggacgggccgaaggaccacggccgtacttagttattggtgtaggtagtagtttacgnggacgtgtggcgtggaagacgagtacgacgacggtcgggacgtacggg

SEQ ID NO: 320196 - DNA, 521 bp, Homo sapiens
  misc_feature: GZ8MTXP02HA8SU.19.67.G01.1.454.CMB.2.raw
  modified_base (346)..(346): a, c, t, g, unknown or other
  misc_feature (346)..(346): n is a, c, g, or t
  modified_base (408)..(408): a, c, t, g, unknown or other
  misc_feature (408)..(408): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagtttggctgacctgggttttccttgctgcaatttcaggagtgtccagtgtgaggtgcaactggtggagactgggcggaggcttggtccagcctgggcggtctctgagactgtcctgtgaaccctctggggtctccgtcagcagcgactgtattgcctgggtccgccaggctccgaggagaggccggagtgggtcgcaggtatttttanaggtgggacgacattctacggagctccatggaggccgagttcacatctccagagacttttcnctagacacactgtctcttcaaatgaacagcctgagggccgaggacacggccgtctattattgtgtgagtagttatggacgatggcgtggtaggactagactcgacgtcggggg

SEQ ID NO: 320197 - DNA, 559 bp, Homo sapiens
  misc_feature: GZ8MTXP02FJ0A6.19.67.G01.1.454.CMB.2.raw
  modified_base (299)..(299): a, c, t, g, unknown or other
  misc_feature (299)..(299): n is a, c, g, or t
  modified_base (509)..(509): a, c, t, g, unknown or other
  misc_feature (509)..(509): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccnccaggctccgaggggaagaggcccggagtggggcgcgtagggttatttttagtagggttggggaccgactattcgtaacgggagacctccagtgggagggccgattcacatctccagagacttttctcaagaaacacaactgtctacttacaaaatgaaacagcctgaagggccaggacacggcgtctatagttgtgtgagtagtttagnggacgagtcggcgtggaagacgagactacgacggtcggggaccgaacggg

SEQ ID NO: 320198 - DNA, 587 bp, Homo sapiens
  misc_feature: GZ8MTXP02JADHZ.19.67.G01.1.454.CMB.2.raw
  modified_base (371)..(371): a, c, t, g, unknown or other
  misc_feature (371)..(371): n is a, c, g, or t
  modified_base (533)..(533): a, c, t, g, unknown or other
  misc_feature (533)..(533): n is a, c, g, or t
tcagtactctcgtgcacgaccggtgctcgatttagagtatacatattgggtttgggggagaggagcccagcactgggattccgaggtgtttccattcggtgctcagcactgaacacagaggactcaccatggagttttggctgacctgggttttcctgctgcaatttcaggaggtgtccagtgtgaggtgcaactggtggagactggcggaggcttggtccagcctgggcggtctctgagactgtcctgtcgaaccctctggggtctccgtcagcagcgactgtattgcctgggtccgccaggctccgagggaagaggccggaggtgggtcgcaggtatttttagagggtggaccgacattcgtacggganaccttccagtgggacgggccgattcgaccatcctaccagacgtacttttcacaagaacacacttgtcctacttacaaaattgaaacaggtccctaggacggggcccgaagggaccgtaacgggcccgtattattaagttggtgttagagtagttttaacggnggacgtagtcggtcgtagggtggaacacggtactcgacggcggggtacgacggg

SEQ ID NO: 320199 - DNA, 536 bp, Homo sapiens
  misc_feature: GZ8MTXP02IYLDU.19.67.G01.1.454.CMB.2.raw
  modified_base (235)..(235): a, c, t, g, unknown or other
  misc_feature (235)..(235): n is a, c, g, or t
  modified_base (360)..(360): a, c, t, g, unknown or other
  misc_feature (360)..(360): n is a, c, g, or t
  modified_base (399)..(399): a, c, t, g, unknown or other
  misc_feature (399)..(399): n is a, c, g, or t
  modified_base (422)..(422): a, c, t, g, unknown or other
  misc_feature (422)..(422): n is a, c, g, or t
tcagtactctcgtgcacgaccggtgctcgatttagagtatacatattgggtttggggagctacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagacatttcnccacctcaagacaaaactctagctgtaccacagagaccaggacagcctcctaaagttgctcatttactgggcttctacgcgcgaattcggggtcctgaccccgatccggggcagcggtctgggcngattcactctcacatcagcagcctgcaggctgaagatgngcagtttatactgcagctaattnttttctatccgtcgtggtacgttcggaccgtaaggggacccgaggggttaggaaaacttccgaaaggtaccgaaacgtggttacgggccttcggacctaccgtacgttcttcgg

SEQ ID NO: 320200 - DNA, 538 bp, Homo sapiens
  misc_feature: GZ8MTXP02G5M92.19.67.G01.1.454.CMB.2.raw
  modified_base (508)..(508): a, c, t, g, unknown or other
  misc_feature (508)..(508): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttgggtccagcctgggcggtctctgagactgtcctgtgaaccctctgggtctccgtcagcagcgactgtattgcctgggtccgccaggctccagggagaggccggagtgggtcgcaggtatttttagagggttgggaccgacatttcgtacggagacttccagtgggagggccgattcgaccatcctccagagacttttcactagaacacactgtcctcttacaaatgaacagcctaggagggaccgaggacacggcgtctattatgtgtagagtagttagtggcagtcggntggtgacagactcacgtggggccaacgggg

SEQ ID NO: 320201 - DNA, 565 bp, Homo sapiens
  misc_feature: GZ8MTXP02HWIK4.19.67.G01.1.454.CMB.2.raw
  modified_base (519)..(519): a, c, t, g, unknown or other
  misc_feature (519)..(519): n is a, c, g, or t
  modified_base (532)..(532): a, c, t, g, unknown or other
  misc_feature (532)..(532): n is a, c, g, or t
tcagtactctcgtgcacgaccggtgctcgatttagagtatacatattgggtttggggggaggaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtcgaaccctgtcggggtctccgtcagcagcgactgtattgctgggtccgccaggctccgagggaagaggccggagtgggtcgcgtaggtatttttagagggtgggacgactattcgtacggagacctcagtgggacgggccgattcactatcctccagagtcttttctcagaacacacttgtcctcttacaaattcgaaacagtacctaggaacggggcccgaaggaccaccgggcgtactagttacgttgtgtgagtagtttaggnggtacgagtcggngtggtgacgagacgtcgacggtcgggacgacgg

SEQ ID NO: 320202 - DNA, 514 bp, Homo sapiens
  misc_feature: GZ8MTXP02GER8D.19.67.G01.1.454.CMB.2.raw
  modified_base (237)..(237): a, c, t, g, unknown or other
  misc_feature (237)..(237): n is a, c, g, or t
  modified_base (435)..(435): a, c, t, g, unknown or other
  misc_feature (435)..(435): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacatttcnccacctcaagaacaaaacttctagcctggtaccaacagagaccaggacagcctcctaagttgctcatttactggcttctacgcgcgaattcggggccctgaccccgattccggggcaggcgggtctgggcagatttcactctcaccatcagcagcctgcaggctgaagatgtggctagtttatactgtcagctaattnttttctatcctcgtgtacgttcggacaagggacctagggtagaaactcgaacgacgaactgtcgctcgacaccatctcg

SEQ ID NO: 320203 - DNA, 522 bp, Homo sapiens
  misc_feature: GZ8MTXP02GF5L8.19.67.G01.1.454.CMB.2.raw
  modified_base (351)..(351): a, c, t, g, unknown or other
  misc_feature (351)..(351): n is a, c, g, or t
  modified_base (490)..(490): a, c, t, g, unknown or other
  misc_feature (490)..(490): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagtttggctgacctgggttttccttgctgcaatttcaggaggtgtccagtgtgaggtgcaactggtggagactgggcggaggcttggtccagcctgggcggtctctgagactgtcctgtgaaccctctggggtctccgtcagcagcgactgtattgcctgggtccgccaggctccagggaagaggcccgggagtggggtcgcaggtatttttanaggtgggacgacattctacggagactccatggaggccgattcacatctccagagactttctcagaacacactgtctacttcaaatgaacagcctagagggccgaggacacggccgtctattattgtgtgagtagtttanggcgatggctggtgacagactcgacgtcgggg

SEQ ID NO: 320204 - DNA, 537 bp, Homo sapiens
  misc_feature: GZ8MTXP02GGJ6C.19.67.G01.1.454.CMB.2.raw
  modified_base (348)..(348): a, c, t, g, unknown or other
  misc_feature (348)..(348): n is a, c, g, or t
  modified_base (415)..(415): a, c, t, g, unknown or other
  misc_feature (415)..(415): n is a, c, g, or t
  modified_base (510)..(510): a, c, t, g, unknown or other
  misc_feature (510)..(510): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctgggcggtctctgagactgtcctgtgaaccctctggggtctccgtcagcagcgactgtattgcctggtccgccaggctccagggaagaggccggagtgggtcgcaggtatttttanagggtgggacgacattctacggagactccagtggagggccgattcaccatctccagagtacttttcncaagaaacacactgtctacttcaaaatgaaacagccctagacgggccgagggacacgggcctatattattgtgtgagtagttatcggcgagtggngtggtaggacgagacgtacgacgtcgg

SEQ ID NO: 320205 - DNA, 542 bp, Homo sapiens
  misc_feature: GZ8MTXP02FW35G.19.67.G01.1.454.CMB.2.raw
  modified_base (501)..(501): a, c, t, g, unknown or other
  misc_feature (501)..(501): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccgaggggaagaggccgggagtggggtcgcgtagggtatttttagagggtgggacgacattctacggagactccagtgggagggccgattcgacatctccagacgtacttttctcagaaacacactgtctcttcaaaatgaaacagcctggacgggccgaaggacacggccgtctattatgtgtgagtagtttanggcgagtggctggtgacagactcgacgtcggggcaacgggg

SEQ ID NO: 320206 - DNA, 538 bp, Homo sapiens
  misc_feature: GZ8MTXP02F4FKY.19.67.G01.1.454.CMB.2.raw
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctgggcggtctctgagactgtcctgtgaaccctctggggtctccgtcagcagcgactgtattgcctgggtccgccaggctccagggagaggccgggagtgggtcgcaggtatttttataggtggggacgacattctacggagctccatggagggccgattcaccatctccagagacttttctcagaacacactgtctcttcaaatcgaaacagaccctggacgggccgaggacgaacggccggtactattattagtgtgagtagtttatggcgtaagtggcgtggaggtacagatcgacgtcggggg

SEQ ID NO: 320207 - DNA, 567 bp, Homo sapiens
  misc_feature: GZ8MTXP02GOCCU.19.67.G01.1.454.CMB.2.raw
  modified_base (244)..(244): a, c, t, g, unknown or other
  misc_feature (244)..(244): n is a, c, g, or t
  modified_base (321)..(321): a, c, t, g, unknown or other
  misc_feature (321)..(321): n is a, c, g, or t
  modified_base (565)..(567): a, c, t, g, unknown or other
  misc_feature (565)..(567): n is a, c, g, or t
tcagtactctcgtgcacgaccggtgctcgatttagagtatacatattgggcttggtccagcctgggcggtctctgagactgtcctgtgaaccctctggggtctccgtcagcagcgactgtattgcctgggtccgccaggctccagggaagaggccggagtgggtcgcaggttatttttataggtgggacgacattctacggagactccatggagggccgattcaccatctccagagacttttcncagaacacactgtctcttcaaaatgaacagcctgagggccgaggacacggccgtctattattgtgtgagtagtttanggcgatgggctgggtggacagatcacgtggggccaggggaccctggtccaccgtctcctcacgccctccacaacggggccccagtccggtccttcccccgtggccgcccctgccctccgaggacgccaccctccgagacgccacacggccgggccctggggcctcggccgtcggtcaacgggacctaccgttcccgacgacgacgtacgcggacggcggcgcggaacgaacggcgacagtacgnnn

SEQ ID NO: 320208 - DNA, 533 bp, Homo sapiens
  misc_feature: GZ8MTXP02F1V5Y.19.67.G01.1.454.CMB.2.raw
  modified_base (422)..(422): a, c, t, g, unknown or other
  misc_feature (422)..(422): n is a, c, g, or t
  modified_base (496)..(496): a, c, t, g, unknown or other
  misc_feature (496)..(496): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccgagggaagaggccgggagtggggtcgcgagggtatttttagagggttggggacgacatttctacggagactccaatggagggccgattcaccatctccagagacttttcncagtaacacactgtctcttacaaatgaacagcctgaggccgagacacggccgtctatatgtgtgagtagtttanggcgatggcgtggtggacaggactacgacgtcggggg

SEQ ID NO: 320209 - DNA, 532 bp, Homo sapiens
  misc_feature: GZ8MTXP02HPO95.19.67.G01.1.454.CMB.2.raw
  modified_base (302)..(302): a, c, t, g, unknown or other
  misc_feature (302)..(302): n is a, c, g, or t
  modified_base (348)..(348): a, c, t, g, unknown or other
  misc_feature (348)..(348): n is a, c, g, or t
  modified_base (376)..(376): a, c, t, g, unknown or other
  misc_feature (376)..(376): n is a, c, g, or t
  modified_base (466)..(466): a, c, t, g, unknown or other
  misc_feature (466)..(466): n is a, c, g, or t
  modified_base (474)..(474): a, c, t, g, unknown or other
  misc_feature (474)..(474): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagccgtgggcggtctctgagactgtcctgtcgaaccctctggggtctccggtcagcagcgactgtattgcctgggtccnccaggctccagggaagaggccggagtgggtcgcgaggtatttttanaggtggaccgacattctacggagactcntgggaggccgatcaccatctccagagtactttctcagaacacaactgtctcttacaaaatgaaacagcctgaggccgagacacggccgtntattatgngtgagtagttatggcgagtggcgtggtggacagacgtacacgtcgggaccgaacgggg

SEQ ID NO: 320210 - DNA, 548 bp, Homo sapiens
  misc_feature: GZ8MTXP02GSDJZ.19.67.G01.1.454.CMB.2.raw
  modified_base (376)..(376): a, c, t, g, unknown or other
  misc_feature (376)..(376): n is a, c, g, or t
  modified_base (412)..(412): a, c, t, g, unknown or other
  misc_feature (412)..(412): n is a, c, g, or t
  modified_base (497)..(497): a, c, t, g, unknown or other
  misc_feature (497)..(497): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccgagggaagaggccgggagtgggtcgcaggtatttttagaggtgggaccgacattctacggagactccngtgggagggccgattcgacatctccagagactttcncagaacacactgtctctacaaatgaaacagcctggacgggccgaaggacacgggccgtactattacttgtgtggagtagttttangggcgagtggcgtgggtaaggacagatcgaacgtcgggggccaaacggggg

SEQ ID NO: 320211 - DNA, 530 bp, Homo sapiens
  misc_feature: GZ8MTXP02H6VNQ.19.67.G01.1.454.CMB.2.raw
  modified_base (511)..(511): a, c, t, g, unknown or other
  misc_feature (511)..(511): n is a, c, g, or t
tcagtactctcgtgcacgaccggtgctcgatttagagtatacatattgggtttgggggagaggagcccagcactgggattccgaggtgtttccattcggtgctcagcactgaacacagaggactcaccatggagttttggctgacctgggtttccttgctgcaatttcaggaggtgtccagtgtgaggtgcaactggtggagactgggcggaggcttggtccagccgtgggcggtctctgagactgtcctgtgaaccctctggggtctccgtcagcagcgactgtattgcctgggtccgccaggctccagggaagaggccgggagtgggtcgcgaggtatttttagagggtggggaccgacattcgtacggagactccagtgggaggggccgattcgaccatcctcccagagactttctcagaaacacactgtctctcaaatgaacagctgaggcgaggacacggcgctatatgtgtgagtagtttatggcgatggctggtggacagactnacgtcgggaccgaaccggg

SEQ ID NO: 320212 - DNA, 564 bp, Homo sapiens
  misc_feature: GZ8MTXP02IEOWZ.19.67.G01.1.454.CMB.2.raw
  modified_base (306)..(306): a, c, t, g, unknown or other
  misc_feature (306)..(306): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactgggtggagactgggcggaggcttgggtccagcctgggcggtctctgagactgtcctgtcgaacccctcgtggggtctccgtcagcagcgactgtattgcctggggtccnccagggctccgaggggaagaggccggagtggggtcgcagggttatttttagagggtgggaccgacagttctacgggagacttccagtgggagggcccgattccaccatcctccagagtactttcacagaacacactgtctcttacaaattcgaaacagcctaggagggcccgaggacacggccgtatagttattgtgtgagtagtttatcgggacgtagtggcgtggaagacagtactcgacggtcgggaccgacggg

SEQ ID NO: 320213 - DNA, 535 bp, Homo sapiens
  misc_feature: GZ8MTXP02JA4RP.19.67.G01.1.454.CMB.2.raw
  modified_base (344)..(344): a, c, t, g, unknown or other
  misc_feature (344)..(344): n is a, c, g, or t
  modified_base (410)..(410): a, c, t, g, unknown or other
  misc_feature (410)..(410): n is a, c, g, or t
  modified_base (466)..(466): a, c, t, g, unknown or other
  misc_feature (466)..(466): n is a, c, g, or t
  modified_base (486)..(486): a, c, t, g, unknown or other
  misc_feature (486)..(486): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctggtccgccaggctccaggggaagaggccggagtgggtcgcaggtatttttanagggtgggaccgacattctacggagactccatgggagggccgattcacatctccagagacttttcncagaacacactgtctcttacaaatgaaacagcctgacggggccaggacacggcctntattatgtgtgagagtttanggacgatgggctgggtggacaggactcgacgtcgggggacctaacgggg

SEQ ID NO: 320214 - DNA, 532 bp, Homo sapiens
  misc_feature: GZ8MTXP02JQHTV.19.67.G01.1.454.CMB.2.raw
  modified_base (179)..(179): a, c, t, g, unknown or other
  misc_feature (179)..(179): n is a, c, g, or t
  modified_base (243)..(243): a, c, t, g, unknown or other
  misc_feature (243)..(243): n is a, c, g, or t
  modified_base (318)..(318): a, c, t, g, unknown or other
  misc_feature (318)..(318): n is a, c, g, or t
  modified_base (375)..(375): a, c, t, g, unknown or other
  misc_feature (375)..(375): n is a, c, g, or t
  modified_base (407)..(407): a, c, t, g, unknown or other
  misc_feature (407)..(407): n is a, c, g, or t
  modified_base (410)..(410): a, c, t, g, unknown or other
  misc_feature (410)..(410): n is a, c, g, or t
  modified_base (530)..(532): a, c, t, g, unknown or other
  misc_feature (530)..(532): n is a, c, g, or t
tcagtactctcgtgcacgaccggtgctcgatttagagtatacatattgggcttggtccagcctgggcggtctctgagactgtcctgtgaaccctctggggtctccgtcagcagcgactgtattgcctgggtccgccaggctccagggaagaggccggagtgggtcgcaggtatttttanaggtgggacgacattctacggagactccatggagggccgattcaccatctccagagacttttcncagaacacactgtctcttcaaatgaacagcctgagggccgaggacacggccgtctattattgtgtgagagtttanggcgatgggctgggtgacagatcacgtggggccagggaccctggtccaccgtctccncagccctccaccagggcccatccgtctccccngcnccctgctcagcgcacctccgagacgcacagccggccctgggcctggccctggtacaaggacctaccttcccacggagacgtactggacgccgggcctgggccgaaggggccacagtacgnnn

SEQ ID NO: 320215 - DNA, 549 bp, Homo sapiens
  misc_feature: GZ8MTXP02IX8DL.19.67.G01.1.454.CMB.2.raw
  modified_base (321)..(321): a, c, t, g, unknown or other
  misc_feature (321)..(321): n is a, c, g, or t
  modified_base (505)..(505): a, c, t, g, unknown or other
  misc_feature (505)..(505): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcgttggtccaggcctgggcggtctctgagactgtcctgtgaaccctctggggtctccgtcagcagcgactgtattgcctgggtccgccaggctccgaggggaagnggccggagtgggtcgctaggtatttttagaggtgggaccgacattcgtacggagacctccagtgggagggccgattccgaccatctccagagtacttttctacagtaacacactgtctctacaaatgaaacagcctggacgggccgaggacgacggccgtatagttatgtgtgagtagtttagnggcgagtggcgtggtgacagactcgacgtcggggaccaacgggg

SEQ ID NO: 320216 - DNA, 526 bp, Homo sapiens
  misc_feature: GZ8MTXP02IV8RB.19.67.G01.1.454.CMB.2.raw
  modified_base (407)..(407): a, c, t, g, unknown or other
  misc_feature (407)..(407): n is a, c, g, or t
  modified_base (481)..(481): a, c, t, g, unknown or other
  misc_feature (481)..(481): n is a, c, g, or t
tcagtactctcgtgcacgaccggtgctcgatttagagtatacatattgggtttgggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtatgcctggtccgccaggctccagggaagaggccggagtgggtcgcaggtatttttagaggtgggaccgacattctacggagacctccagtgggagggccgattcacatctccagagactttcncagaacacactgtctctcaaatgaacagcctgagggccgaggcacggcgtactattatgtgtggagtagtttanggcgtagtggctggtggacaggatcaacgtggggacctaacgggg

SEQ ID NO: 320217 - DNA, 557 bp, Homo sapiens
  misc_feature: GZ8MTXP02GSV3Q.19.67.G01.1.454.CMB.2.raw
  modified_base (298)..(298): a, c, t, g, unknown or other
  misc_feature (298)..(298): n is a, c, g, or t
  modified_base (377)..(377): a, c, t, g, unknown or other
  misc_feature (377)..(377): n is a, c, g, or t
  modified_base (512)..(512): a, c, t, g, unknown or other
  misc_feature (512)..(512): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctgggcggtctctgagactgtcctgtcgaaccctctggggtctccgtcagcagcgactgtatgctggtccncaggctccgagggaagaggccggagtggggtcgcgtaggtatttttagtagggtgggaccgacattctacggagactcngtggagggccgattcacatctaccagagtacttttcgctagaacacactgtctactacaaaatgaaacagcctaggacgggccgaggacgacggccgtctattagtgtgtagagtagtttagtggcgtagtcggngttgggaaggacaggtactcgacggtcgggggaccgaaaccgggg

SEQ ID NO: 320218 - DNA, 535 bp, Homo sapiens
  misc_feature: GZ8MTXP02IH99R.19.67.G01.1.454.CMB.2.raw
  modified_base (397)..(397): a, c, t, g, unknown or other
  misc_feature (397)..(397): n is a, c, g, or t
  modified_base (489)..(489): a, c, t, g, unknown or other
  misc_feature (489)..(489): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttcctgctgcaattcaggaggtgtccagtgtgaggtgcaactggtggagactggcggaggcttggtccaggcctgggcggtctctgagactgtcctgtgaaccctctggggtctccgtcagcagcgactgtatgcctgggtccgccaggctccgagggaagaggcccggagtgggcgcgaggtatttttagaggtgggacgacattctacggagctccatgggaggccgattcaccatcnccagagtacttttctcagaacacactgtctcttacaaatgaacagcctgacgggccgaggacacggcctctattattgtgtgagtagtttanggacgtatgggcgttgggtaggtacgaggacgtacgacgtcggggg

SEQ ID NO: 320219 - DNA, 566 bp, Homo sapiens
  misc_feature: GZ8MTXP02JWXZL.19.67.G01.1.454.CMB.2.raw
  modified_base (450)..(450): a, c, t, g, unknown or other
  misc_feature (450)..(450): n is a, c, g, or t
  modified_base (503)..(503): a, c, t, g, unknown or other
  misc_feature (503)..(503): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtgggcggaggcttggtccagccgtgggcggtctctgagactgtcctgtcgaaccctcgtggggtctccgtcagcagcgactgtattgcctggtccgccaggctccgaggggaagaggccggagtggggtcgcgtaggttatttttagagggtgggaccgacattcgtaacggagacctcagtgggagggccgattcaccgatcctaccagtagtacttttctacagaacacactgtctcttanaaatgaaacagcctaggacggggaccgaggaccgacggccgtctattagttgngtgagtagtttagtggcgagtggcgtggtggacagactacgacggtcggggaccgtaacgggg

SEQ ID NO: 320220 - DNA, 607 bp, Homo sapiens
  misc_feature: GZ8MTXP02H5YOO.19.67.G01.1.454.CMB.2.raw
  modified_base (238)..(238): a, c, t, g, unknown or other
  misc_feature (238)..(238): n is a, c, g, or t
  modified_base (297)..(297): a, c, t, g, unknown or other
  misc_feature (297)..(297): n is a, c, g, or t
  modified_base (401)..(401): a, c, t, g, unknown or other
  misc_feature (401)..(401): n is a, c, g, or t
  modified_base (405)..(405): a, c, t, g, unknown or other
  misc_feature (405)..(405): n is a, c, g, or t
  modified_base (411)..(411): a, c, t, g, unknown or other
  misc_feature (411)..(411): n is a, c, g, or t
tcagtactctcgtgcacgaccggtgctcgatttagagtatacatattgggttggggagctacaacaggcaggcaggggcagcaagatggtgttgcagacccaggtcttcatttctctgttgctctggatctctggttcctgcgggacatcgtgatgacccagtacccagactcactggctgtgtctcgtgggcgagacggccaacaaatcaactgcaggtccagccagaacattttcnccactaccaagaacaaaacttctagcctgaaccaacagacacagacagcctactaagtnctctaattactggtcttcgtacgcgacgtaaacgttccggggtcctggaccccgtagttccggggacaggtggtcgcgggactagtacttcacttcacacctanacancacgcncgcgacgacgagaagagtgtagtagttagtttattacgttagtacgtacgtattaatttaacttttactttacttaccgttaccgttacggtacggtacggtaccggtaaacgggtaaccggtaacggtaacggtaaacgtaacgaacgaacgtaacgtaacggtacggtacgtacgaccgtacctacgtacgtcg

SEQ ID NO: 320221 - DNA, 563 bp, Homo sapiens
  misc_feature: GZ8MTXP02HMVRX.19.67.G01.1.454.CMB.2.raw
  modified_base (299)..(299): a, c, t, g, unknown or other
  misc_feature (299)..(299): n is a, c, g, or t
  modified_base (424)..(424): a, c, t, g, unknown or other
  misc_feature (424)..(424): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccnccaggctccaggggaagaggccggagtgggtcgcgtaggttatttttagtagggtggggaccgacattcgtacgggagacttccagtgggagggccgattccaccatctccagacgtacttttcnctagaacacactgtctctacaaatgaaacagcctaggacggggacccgaggaccacggccgtctattatgtgtgagtagtttagtggcgtagtggtcgtgggtaaggacaggactacgacgtcgggggacctaacgggg

SEQ ID NO: 320222 - DNA, 551 bp, Homo sapiens
  misc_feature: GZ8MTXP02JFZ89.19.67.G01.1.454.CMB.2.raw
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaccctctggggtctccgtcagcagcgactgtattgcctgggtccgccaggctccgaggggaagaggccggaggtggggtcgcgtaggtatttttagagggttgggaccgacagttcgtacggagaccttccagtgggaggggccgagttccaccatctccagagtacttttcacagaacacactgtctctcaaatgaacagcctgagggcccgaggacacggccgtctattattgtgtgagtagtttagtaggcgtagtgggctggtggacaggactcgacgtcgggggccaacgggg

SEQ ID NO: 320223 - DNA, 606 bp, Homo sapiens
  misc_feature: GZ8MTXP02GFN4Q.19.67.G01.1.454.CMB.2.raw
  modified_base (315)..(315): a, c, t, g, unknown or other
  misc_feature (315)..(315): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctcgtggggtctccgtcagcagcgactgtatgcctggtccgcaggctccgagggaagnggccggagtgggtcgctaggttattttagaggtgggaccgactagttcgtacggagacctcagtgggagggccgtattccaccatcctaccagtacgtaccttttctacaagaaccactactcgtacctcttacaaaattcgaaaccacggtcccgtagggacggggacccgaaggaccgacgggccgttactattagttgtgtagaggttagtttacgtgggacgtagttcgggcgttaggggtcggaacgtaggtacgtaccgacggtcgggggaccctaaaccggggg

SEQ ID NO: 320224 - DNA, 558 bp, Homo sapiens
  misc_feature: GZ8MTXP02ICWHO.19.67.G01.1.454.CMB.2.raw
  modified_base (249)..(249): a, c, t, g, unknown or other
  misc_feature (249)..(249): n is a, c, g, or t
  modified_base (380)..(380): a, c, t, g, unknown or other
  misc_feature (380)..(380): n is a, c, g, or t
  modified_base (389)..(389): a, c, t, g, unknown or other
  misc_feature (389)..(389): n is a, c, g, or t
tcagtactctcgtgcacgaccggtgctcgatttagagtatacatattgggtttgggggtagctcaggaagcagagcctggagcatctccactatggcctgggctccactacttctcaccctcctcgctcactgcacaggttcttgggccaactttatgctgactcagccccactctgtgtcggagtctccggggaagacggtaaccatcttttgcaccacaacagtggcaacattgccagcaattttgngcagtggtaccagcagcgcccgggcacgttcccccacattgtgatctatgaggataatcaaaagccgtctggggtccctgacttcggtctctggcctccatcgacagcctcctccaactctcgccctcccncacccatcnctggactgaagctgaggacgaggctgactactatgtcagttcttatgactaggccgcggtactagtggtcggttcgtcggggcggggacggacccaaggtccgtcggtaacccgttcgtaacggtccgaacggacccccgaaggtccctaccggccccccgtttccggg

SEQ ID NO: 320225 - DNA, 546 bp, Homo sapiens
  misc_feature: GZ8MTXP02I4XOK.19.67.G01.1.454.CMB.2.raw
  modified_base (418)..(418): a, c, t, g, unknown or other
  misc_feature (418)..(418): n is a, c, g, or t
  modified_base (496)..(496): a, c, t, g, unknown or other
  misc_feature (496)..(496): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctggggcggtctctgagactgtcctgtgaaccctctggggtctccgtcagcagcgactgtattgcctgggtccgccaggctccgagggaagaggccggagtgggtcgctaggttatttttagagggtgggacgacattcgtacggagactccagtgggagggccgattccacatctccagacgtacttttcncagaacacactgtctactacaaatgaaacagctggagggccgaggacacggccgtctattatgtgtgagtagtttagnggcgtagtcgggctgggtgacgagtactcgacggtcggggaccaacgggg

SEQ ID NO: 320226 - DNA, 557 bp, Homo sapiens
  misc_feature: GZ8MTXP02ICQE8.19.67.G01.1.454.CMB.2.raw
  modified_base (406)..(406): a, c, t, g, unknown or other
  misc_feature (406)..(406): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctgggcggtctctgagactgtcctgtgaaccctcgtggggtctccgtcagcagcgactgtattgcctgggtccgccaggctccgaggggaagaggccggagtggggtcgcgaggttatttttagagggtggaccgacagttcacggagactccagtgggaggccgattccgaccatccncccagacgtacttttcacagaacactactgtccttctacaaatgaaacagcgtaggacgggccgaggacgacggcgtctattatgtgtgagtgttatggtacttagtggtctggtggtacaggtactacgacgtcggggacccgaacgggg

SEQ ID NO: 320227 - DNA, 545 bp, Homo sapiens
  misc_feature: GZ8MTXP02F5ZWT.19.67.G01.1.454.CMB.2.raw
  modified_base (260)..(260): a, c, t, g, unknown or other
  misc_feature (260)..(260): n is a, c, g, or t
  modified_base (283)..(283): a, c, t, g, unknown or other
  misc_feature (283)..(283): n is a, c, g, or t
  modified_base (418)..(418): a, c, t, g, unknown or other
  misc_feature (418)..(418): n is a, c, g, or t
tcagtactctcgtgcacgaccggtgctcgatttagagtatacatattgggtttgggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtcgtctggacgagtgcctagtgacctntggggtctccgtcagcagcgacngtatgcctggtcgccaggctccaggagaggccggaggtgggtcgcgaggtagttttataggtggggaccgacgattctacggaggactccatggaggggccggattcaccaatctcccagagactttcttccaanacacactcgtctactactaaatacgacacgacgagacgggacgacgacgacggcgtctattagtgtgtgtagtagttagtgacgcgtcgtgtggtggacgacgacgtacgacggtcgggacggacgg

SEQ ID NO: 320228 - DNA, 573 bp, Homo sapiens
  misc_feature: GZ8MTXP02GSD1C.19.67.G01.1.454.CMB.2.raw
  modified_base (511)..(511): a, c, t, g, unknown or other
  misc_feature (511)..(511): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcgtctctgagactgtcctgtgaccctctggggtctccgtcagcagcgactgtattgcctgggtccgccaggctccgagggaagaggccggagtgggtcgcgtaggtatttttagagggttggggaccgacattcgtacggagtactccgagtgggacggggccgattccgaaccagtcctaccagtagtaccttttctacaagaacacactgtctacttacaaatgaaacacgctgacgggccgaggacacggctactcttagtgtgtgagtagtttagnggcgtagtggtcgttgggtcggtacaaggtactacgtacggtcgggggacctaaaccggggg

SEQ ID NO: 320229 - DNA, 550 bp, Homo sapiens
  misc_feature: GZ8MTXP02HENTD.19.67.G01.1.454.CMB.2.raw
  modified_base (298)..(298): a, c, t, g, unknown or other
  misc_feature (298)..(298): n is a, c, g, or t
  modified_base (314)..(314): a, c, t, g, unknown or other
  misc_feature (314)..(314): n is a, c, g, or t
  modified_base (498)..(498): a, c, t, g, unknown or other
  misc_feature (498)..(498): n is a, c, g, or t
  modified_base (513)..(513): a, c, t, g, unknown or other
  misc_feature (513)..(513): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtatgcctgggtccncaggctccagggaagnggccggagtgggtcgcaggtatttttagaggtggaccgacattcgtacggagactccagtgggaggggccgagttccaccgatcctcccagagtactttctcaagaacacactgtctcttacaaatgaaacacgtcctgacgggcgaggacacggccgtactattatgtgtagagtagtttagnggcgagtggctgggnggacaggactcgaacggtcggggaccgtaaccggggg

SEQ ID NO: 320230 - DNA, 587 bp, Homo sapiens
  misc_feature: GZ8MTXP02JKNLP.19.67.G01.1.454.CMB.2.raw
  modified_base (246)..(246): a, c, t, g, unknown or other
  misc_feature (246)..(246): n is a, c, g, or t
  modified_base (322)..(322): a, c, t, g, unknown or other
  misc_feature (322)..(322): n is a, c, g, or t
  modified_base (445)..(445): a, c, t, g, unknown or other
  misc_feature (445)..(445): n is a, c, g, or t
  modified_base (586)..(587): a, c, t, g, unknown or other
  misc_feature (586)..(587): n is a, c, g, or t
tcagtactctcgtgcacgaccggtgctcgatttagagtatacatattgggcttggtccagcctgggcggtctctgagactgtcctgtgaaccctctggggtctccgtcagcagcgactgtattgcctgggtccgccaggctccagggaagaggccggagtgggtcgcaggttatttttataggtgggacgacatttctacggagactccatggagggccgattcaccatctccagagtacttttcncagaacacactgtctcttcaaatgaacagcctgagggccgaggacacggccgtctatttattgtgtgagagtttanggcgatgggctgggtgacagatcactggggccaggggaccctggtcacgtctcctcacgccctccaccgaaggggccccagtccggtccttcccccgtggcccgccctgcctcccgagggacnccacccgtccggagacgccacgacggcccgggtcccgtgggcctcggccgtaggtaccgaaacggtacctacccgttccccgaacggacgtacgtacgtcggacggccggggcgtaggaacgacggacggacgagacgcgnn

SEQ ID NO: 320231 - DNA, 565 bp, Homo sapiens
  misc_feature: GZ8MTXP02JVIS7.19.67.G01.1.454.CMB.2.raw
  modified_base (301)..(301): a, c, t, g, unknown or other
  misc_feature (301)..(301): n is a, c, g, or t
  modified_base (500)..(500): a, c, t, g, unknown or other
  misc_feature (500)..(500): n is a, c, g, or t
  modified_base (521)..(521): a, c, t, g, unknown or other
  misc_feature (521)..(521): n is a, c, g, or t
  modified_base (538)..(538): a, c, t, g, unknown or other
  misc_feature (538)..(538): n is a, c, g, or t
tcagtactctcgtgcacgaccggtgctcgatttagagtatacatattgggtttggggggagaggagcccagcactgggattccgaggtgtttccattcggtgctcagaactgaacacagaggactcaccatggagttttggctgacctgggttttccttgctgcaatttcaggaggtgtccagtgtgaggtgcaactggtggagactggcggaggcttggtccagcctggggcggtctctgagactgtcctgtgaaccctcgtggggtctccgtcagcagcgactgtattgcctgggtccnccaggctccgaggggaagaggccggaggtgggtcgcgtagggttatttttagtagggtggggacgacctattcgtacgggagactccagtggggacgggcgaattccacctactctcccaagacgtacttttctcaagaaacacactgtctcttacaaatagaacagcctggacggccggagaccacggccgtctattntagtgtgtagtagttagtggnagtggcgtggtggaacngactcgacgtcgggacgagggtacccg

SEQ ID NO: 320232 - DNA, 538 bp, Homo sapiens
  misc_feature: GZ8MTXP02IGUXG.19.67.G01.1.454.CMB.2.raw
  modified_base (365)..(365): a, c, t, g, unknown or other
  misc_feature (365)..(365): n is a, c, g, or t
  modified_base (489)..(489): a, c, t, g, unknown or other
  misc_feature (489)..(489): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaccctctgggtctccgtcagcagcgactgtatgcctggtccgcaggcctccgagggagaggccggagtgggtcgcaggtatttttagaggtgggacacattctacggngactcagtgggaggccgattcaccatcgtccagacgtacttttctacagtaacacaactgtctacttacaaattgaaacagtccctaggacggggccgaggacgacggccgtactagttattgngttgagtagtttactggcgtatggcgtggtgacagctacgacgtcgggg

SEQ ID NO: 320233 - DNA, 522 bp, Homo sapiens
  misc_feature: GZ8MTXP02IL539.19.67.G01.1.454.CMB.2.raw
  modified_base (340)..(340): a, c, t, g, unknown or other
  misc_feature (340)..(340): n is a, c, g, or t
  modified_base (362)..(362): a, c, t, g, unknown or other
  misc_feature (362)..(362): n is a, c, g, or t
  modified_base (411)..(411): a, c, t, g, unknown or other
  misc_feature (411)..(411): n is a, c, g, or t
tcagtactctcgtgcacgaccggtgctcgatttagagtatacatattgggtttggggagaggagcccagcactgggattccgaggtgtttccattcggtgctcagcactgaacacagaggactcaccatggagtttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagaggccggagtgggtcgcaggtattttanaggtggacgacattctacgganactccatggagggccgattcaccatctccagagtactttctcagaaacncactgtctcttcaaatgaaacagcctgacgggccgaggacacggccgtactattatgtgtgagtagtttatggcatgggcttgggtgacagctcgacgtggggccaagggg

SEQ ID NO: 320234 - DNA, 514 bp, Homo sapiens
  misc_feature: GZ8MTXP02F1TD7.19.67.G01.1.454.CMB.2.raw
  modified_base (236)..(236): a, c, t, g, unknown or other
  misc_feature (236)..(236): n is a, c, g, or t
  modified_base (410)..(410): a, c, t, g, unknown or other
  misc_feature (410)..(410): n is a, c, g, or t
  modified_base (422)..(422): a, c, t, g, unknown or other
  misc_feature (422)..(422): n is a, c, g, or t
tcagtactctcgtgcacgaccggtgctcgatttagagtatacatattgggtttggggagctacaacaggcaggcaggggcagcaagatggtgttgcagacccaggtcttcatttctctgttgctctggatctctggttcctgcggggacatcgtgatgacccagtacccagactcactggctgtgtctctgggcagacggccacaatcaactgcaggtccagccagaacattttcnccacctcaagaacaaaacttctagcctggtaccaacagagaccaggacagcctcctaagttgctcatttactggcttctacgcgcgaaattcggggtccctgaccccgattccggggcagcggtctggggcagatttcactctcaccatcagcagcctgcaggctagaagatgngcagtttatacngtcagactaattattttctatcctcgtagacgttcggacaagggccagggtagaaacttcgaagacgaactgtacggctacgcaccatctcg

SEQ ID NO: 320235 - DNA, 541 bp, Homo sapiens
  misc_feature: GZ8MTXP02JOHOP.19.67.G01.1.454.CMB.2.raw
  modified_base (298)..(298): a, c, t, g, unknown or other
  misc_feature (298)..(298): n is a, c, g, or t
  modified_base (414)..(414): a, c, t, g, unknown or other
  misc_feature (414)..(414): n is a, c, g, or t
  modified_base (493)..(493): a, c, t, g, unknown or other
  misc_feature (493)..(493): n is a, c, g, or t
  modified_base (510)..(510): a, c, t, g, unknown or other
  misc_feature (510)..(510): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggccagcctgggcggtctctgagactgtcctgtgaaccctctggggtctccgtcagcagcgactgtattgcctgggtccnccaggctccagggaagaggccggagtgggtcgcagggtatttttagaggtgggaccgacattcgtacggagactccagtgggagggccgagttcaccatctccagagtacttttcncaagaacacactgtctctacaaatgaaacagcctggagggccgaggacacggccgtctattactgtgtgagagtttagnggcgtagtcggcgtggngacgagactcgacggtcggggaccgtacggg

SEQ ID NO: 320236 - DNA, 551 bp, Homo sapiens
  misc_feature: GZ8MTXP02I7BFU.19.67.G01.1.454.CMB.2.raw
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagaggccggagtggggtcgcagggtatttttagaggtgggaccgacattctacggagactcagtggagggccgattcacatctccagagtactttctacagaaacacaactcgtctacttacaaaattgaaacagcctggacgggccgaggacacgggccgtactattatggtgtgtagtagtttagtggacgagtgggctagggtggacaggtactcgacgtggggaccaacggggg

SEQ ID NO: 320237 - DNA, 584 bp, Homo sapiens
  misc_feature: GZ8MTXP02IOG4H.19.67.G01.1.454.CMB.2.raw
  modified_base (418)..(418): a, c, t, g, unknown or other
  misc_feature (418)..(418): n is a, c, g, or t
tcagtactctcgtgcacgaccggtgctcgatttagagtatacatattgggtttgggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctcttagactgtcctgtgaaccctctggggtctccgtcagcagcgactgtatgcctgggtccgccaggctccgaggggaagaggccggagtgggtcgcgtaggttatttttagtaggtggggacgtaccattcgtacggagactccatgggagggccgattcaccatctccagagtacttttcncaagaaaccacactgtcctcttacaaatgaaacagcctggacgggccgaaggacaccgggccgttatattagttgtgtggtagtagtttatgggtacgagttgggcgtggggtacggaacgtaagacgttccgaacggtcgggggaccctacgggggtaaaccccg

SEQ ID NO: 320238 - DNA, 530 bp, Homo sapiens
  misc_feature: GZ8MTXP02GII8L.19.67.G01.1.454.CMB.2.raw
  modified_base (348)..(348): a, c, t, g, unknown or other
  misc_feature (348)..(348): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtatgcctgggtccgccaggctccagggaagaggccggagtgggtcgcgaggtatttttanaggtgggacgacattctacggagctccatgggagggccgagttcaccatctccagagtactttctcagaacacactgtctcttacaaattgaaacagacctgagggccgaggacacggccgtctattattgtgtgtagtagtttagtggacgattggctggtggacaggactcgacgtgggg

SEQ ID NO: 320239 - DNA, 550 bp, Homo sapiens
  misc_feature: GZ8MTXP02GQJJY.19.67.G01.1.454.CMB.2.raw
  modified_base (526)..(526): a, c, t, g, unknown or other
  misc_feature (526)..(526): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctggggcgtctctgagactgtcctgtgaaccctcgtggggtctccgtcagcagcgactgtatgcctggtccgccaggctccgagggaagaggcccgggaggtgggtcgcgtaggttatttttagtaggggtgggacgactagttcgtacggagctccagtgggagggccgagttcaccatctaccagacgtactttctacacgaacacgactgtcttactacaaatgaacagccgtaggacggccgaggacgacggccgtcgtattagttgtgtagagtagttagtgcgagtggngtggtgacagactcgacgtcgggg

SEQ ID NO: 320240 - DNA, 529 bp, Homo sapiens
  misc_feature: GZ8MTXP02F1W36.19.67.G01.1.454.CMB.2.raw
  modified_base (238)..(238): a, c, t, g, unknown or other
  misc_feature (238)..(238): n is a, c, g, or t
  modified_base (415)..(415): a, c, t, g, unknown or other
  misc_feature (415)..(415): n is a, c, g, or t
  modified_base (418)..(418): a, c, t, g, unknown or other
  misc_feature (418)..(418): n is a, c, g, or t
  modified_base (447)..(447): a, c, t, g, unknown or other
  misc_feature (447)..(447): n is a, c, g, or t
  modified_base (522)..(522): a, c, t, g, unknown or other
  misc_feature (522)..(522): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaactatttcnccacctcaagaacaaaacttctagcctggtaccaacagagaccaggacagcctactaagtgctcatttactggtcttctacgcgtacgaaagttccggggtccctgaccccgtagttccggggcaggcgggtctgggcagtattcactctcacatcagcagcctgcaggctagaagntgnggactagtttatactgtcagtactaattnttttctatcctcgtgtacgttcgacgagggaccgagggtagaaactcgaagacgaaacgtgtagctacgccaacngttctcg

SEQ ID NO: 320241 - DNA, 573 bp, Homo sapiens
  misc_feature: GZ8MTXP02HSGSQ.19.67.G01.1.454.CMB.2.raw
  modified_base (425)..(425): a, c, t, g, unknown or other
  misc_feature (425)..(425): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctggggcggtctctgagactgtcctgtgaaccctgtggggtctccgtcagcagcgactgtattgcctgggtccgccaggctccgagggaagaggccggagtgggtcgctaggtatttttagtaggtgggaccgactattcgtacggagacctccagtggggagggccgattccaccatcctcccagaggtacttttcnctagaacactaactgtcttctacaaatcgaaacagcctggaggggccgaggaccgacggccgtctattattgtgtgagttagtttagtggtacgagtcggtgtagggtggaacgagtactcgacgttcgggggaccgtaaaccggggg

SEQ ID NO: 320242 - DNA, 605 bp, Homo sapiens
  misc_feature: GZ8MTXP02F79QZ.19.67.G01.1.454.CMB.2.raw
  modified_base (244)..(244): a, c, t, g, unknown or other
  misc_feature (244)..(244): n is a, c, g, or t
  modified_base (319)..(319): a, c, t, g, unknown or other
  misc_feature (319)..(319): n is a, c, g, or t
  modified_base (447)..(447): a, c, t, g, unknown or other
  misc_feature (447)..(447): n is a, c, g, or t
  modified_base (453)..(453): a, c, t, g, unknown or other
  misc_feature (453)..(453): n is a, c, g, or t
  modified_base (473)..(473): a, c, t, g, unknown or other
  misc_feature (473)..(473): n is a, c, g, or t
  modified_base (603)..(605): a, c, t, g, unknown or other
  misc_feature (603)..(605): n is a, c, g, or t
tcagtactctcgtgcacgaccggtgctcgatttagagtatacatattgggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagtacttttcncagaacacactgtctcttcaaatgaacagcctgagggccgaggacacggccgtctattatgtgtgagtagtttanggcatgggctgggtgacagatcgacggtcggggaccgaacgggtacccgtggtaccaccggttcctcctacgaccgtcccctacccaaccggaaccgggcccctagttcccggttccccttcccccgnggcccncccgtcgcctaccgagggcncccaccgtccggagacgccacgacggcccgggcccgtggggcctcggccgtggtccgaacggtaccttacccgtcccgaaggtagtacgtacgacggacggcgggtctagggaacgacggcgacagtacnnn

SEQ ID NO: 320243 - DNA, 537 bp, Homo sapiens
  misc_feature: GZ8MTXP02ICLC1.19.67.G01.1.454.CMB.2.raw
  modified_base (506)..(506): a, c, t, g, unknown or other
  misc_feature (506)..(506): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccgaggggaagaggccggagtggggtcgcaggttatttttagtaggtgggaccgacattctacggagactccagtgggagggccgattcacatctccagagtactttctcagaacacactgtctctcaaatgaaatagcctagagggccgaggacacggcgtctattatgtgtgagtagtttatggcgtagtggctgggnggacagactacgacgtcggggaccaacgggg

SEQ ID NO: 320244 - DNA, 594 bp, Homo sapiens
  misc_feature: GZ8MTXP02IQR53.19.67.G01.1.454.CMB.2.raw
  modified_base (425)..(425): a, c, t, g, unknown or other
  misc_feature (425)..(425): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagactgggcggaggcttggtccagccgtgggcgtctctgagactgtcctgtcgaccctcgtgggtctccgtcagcagcgactgtattgcctgggtccgccgaggctccgaggggaagagggccggaggtgggtcgctaggttatttttagagggtggaccgactattctacggagacctccagtgggacgggccattccaccatcctccagacgtactttcncaacgaaacactacttgtcctacttacaaatacgaaacacgtaccgtagggacgggacccgaagggaccacgggtccgtacttagttagttgtgttagagttagtttagtggacgtagtggtcgtgggtaacggatagaacgtcgacggtcggggaccgtaaaccgggg

SEQ ID NO: 320245 - DNA, 570 bp, Homo sapiens
  misc_feature: GZ8MTXP02JRDV7.19.67.G01.1.454.CMB.2.raw
  modified_base (529)..(529): a, c, t, g, unknown or other
  misc_feature (529)..(529): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggatttttggctgacctgggttttccttgctgcaatttcaggaggtgtccagtgtgaggtgcaactggtggagactgggcggaggcttggtccagcctgggcggtctctgagactgtcctgtgaaccctctggggtctccgtcagcagcgactgtattgcctggtccgccaggctccgagggaagaggccgggagtggggtcgcgtaggtatttttagagggtgggacgtacattcgtacggagcctccagtgggagggccgagttcaccatcctcccagtacgtacttttctactacgaaacacgtaactcgttctacttacaaattacgaactagccgtagacgggaccgaggacgacgggtccgtactattagttgtgtggagtagtttanggtacgagtggcgtggtacggacaggactacgacgtcgggg

SEQ ID NO: 320246 - DNA, 534 bp, Homo sapiens
  misc_feature: GZ8MTXP02GK32X.19.67.G01.1.454.CMB.2.raw
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccgagggaagaggcccgggagtggggtcgcgaggtatttttatagggtgggacgacattctacggagctccatggaggccgattcgaccatctccagacgactttctcagacacactgtctacttacaaatgaacagccgtgacgggccgaggacacggccgtactacttattgtgtgagtagttatggcgagtggtcgtggtggacagactcgacgtcggggg

SEQ ID NO: 320247 - DNA, 565 bp, Homo sapiens
  misc_feature: GZ8MTXP02GP869.19.67.G01.1.454.CMB.2.raw
  modified_base (376)..(376): a, c, t, g, unknown or other
  misc_feature (376)..(376): n is a, c, g, or t
  modified_base (383)..(383): a, c, t, g, unknown or other
  misc_feature (383)..(383): n is a, c, g, or t
  modified_base (418)..(418): a, c, t, g, unknown or other
  misc_feature (418)..(418): n is a, c, g, or t
  modified_base (490)..(490): a, c, t, g, unknown or other
  misc_feature (490)..(490): n is a, c, g, or t
  modified_base (525)..(525): a, c, t, g, unknown or other
  misc_feature (525)..(525): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctgggcggtctctgagactgtcctgtgaaccctcgtggggtctccgtcagcagcgactgtattgcctgggtccgccaggctccgagggaagaggccggagtgggtcgctaggttatttttagagggtgggaccgactattctacggganacttccngtgggagggccattcacatctccagagtactttcncaagaacacactgtctctacaaatgaaacagccgtagacggggccgaaggaccacggcctactattagttgngtagagtagtttagtgggactagtcggcgttaggnggaacaggaactcgaacggtcggggaccgtaaaccggggg

SEQ ID NO: 320248 - DNA, 667 bp, Homo sapiens
  misc_feature: GZ8MTXP02FUG61.19.67.G01.1.454.CMB.2.raw
  modified_base (271)..(271): a, c, t, g, unknown or other
  misc_feature (271)..(271): n is a, c, g, or t
  modified_base (314)..(314): a, c, t, g, unknown or other
  misc_feature (314)..(314): n is a, c, g, or t
tcagtactctcgtgcacgaccggtgctcgatttagagtatacatattgggtttgggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaccctcgtgggtctccgtnagcagcgactgtatgccgtggtccgccaggctccgagggaagnggccggagtggggtcgcgtaggttattttagagggtgggaccgactattcgtacggagaccttccagtgggacggggccgaatttccgaacctattccctacccgaagtacgtacctttttacacaagtaaacactaactcgtcctacttacaaaagttcgaaacctacggacccgtagggaaccggggaccggaaacgggaacccgtaaccgggcccggtttacttaacgtttaagtttgggtggttacggtaaggttaaggtttaacgtggggtacgtacggttcgggtcggttagggtaagggaacgacggtaagtccgtaacgggttcgggggacccgtaaaccggggg

SEQ ID NO: 320249 - DNA, 596 bp, Homo sapiens
  misc_feature: GZ8MTXP02JJ3O4.19.67.G01.1.454.CMB.2.raw
  modified_base (532)..(532): a, c, t, g, unknown or other
  misc_feature (532)..(532): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcgtctctgagactgtcctgtgaaccctcgtggggtctccgtcagcagcgactgtattgcctggtccgcaggctccgagggagaggccggagtgggtcgctaggttattttagaggtgggaccgtacgattctacggagacctccgagtggggaacgggcccgatttccgacctatcctcccgaagtagtacttttcgactaagaacacacttcgtctacttacaaatgaaacagccgtaggacgggaccgacggaccgacggtaccgtactagttagttgtagttggtagtaggtttacgngggtacgagtcggcgttggggtaaggactaggtactacgtacggtcgggggacctaaaccgggg

SEQ ID NO: 320250 - DNA, 534 bp, Homo sapiens
  misc_feature: GZ8MTXP02GJSVA.19.67.G01.1.454.CMB.2.raw
  modified_base (408)..(408): a, c, t, g, unknown or other
  misc_feature (408)..(408): n is a, c, g, or t
  modified_base (483)..(483): a, c, t, g, unknown or other
  misc_feature (483)..(483): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccgagggaagaggccggagtgggtcgcaggtatttttagaggtggacgacattctacggagactcatgggaggccgattccacatctcagtagtactttctnaagaacacactgtctcttcaaaatgaacagcctgagggccgaggacacggcgtctattatgtgtgagtagtttancggcgagtggctggggtggacaggtactcaacgtcggggaccgaaccgggg

SEQ ID NO: 320251 - DNA, 551 bp, Homo sapiens
  misc_feature: GZ8MTXP02GZ0VW.19.67.G01.1.454.CMB.2.raw
  modified_base (420)..(420): a, c, t, g, unknown or other
  misc_feature (420)..(420): n is a, c, g, or t
  modified_base (487)..(487): a, c, t, g, unknown or other
  misc_feature (487)..(487): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccgaggggaagaggccggagtggggtcgctaggttatttttagagggttgggaccgacattctacggagacttccagtgggagggccgattccaccatctccagagtactttcncagaacacactgtctcttacaaaatgaaacagcctaggacgggccgaggacacggcgtctattatgngtgagtagtttagtggcgtagtggctgggtggactaggactacgacgtcgggggcctaacgggg

SEQ ID NO: 320252 - DNA, 503 bp, Homo sapiens
  misc_feature: GZ8MTXP02HX3GE.19.67.G01.1.454.CMB.2.raw
  modified_base (248)..(248): a, c, t, g, unknown or other
  misc_feature (248)..(248): n is a, c, g, or t
  modified_base (374)..(374): a, c, t, g, unknown or other
  misc_feature (374)..(374): n is a, c, g, or t
  modified_base (435)..(435): a, c, t, g, unknown or other
  misc_feature (435)..(435): n is a, c, g, or t
tcagtactctcgtgcacgaccggtgctcgatttagagtatacatattgggtttgggggtagctcaggaagcagagcctggagcatctccactatggcctgggctccactacttctcaccctcctcgctcactgcacaggttcttgggccaactttatgctgactcagccccactctgtgtcggagtctccggggaagacggtaaccatctttgcaccacaacagtggcaacattgccagcaattttgngcagtggtaccagcagcgcccgggcagttcccccaccattgtgatctatgaggataaatcaaagaccgtctggggtccctgatcggtctctggctccatcgcagctcctcaactctcgcctccctnacccatctctgctgaagactgaggacgaggctgactactactgtcagtctatgatagccgnggtcatgtgtcgttcgggacgaggaccaagctacgaccgtcaagtcacgccgaagctcgccccgtcgg

SEQ ID NO: 320253 - DNA, 547 bp, Homo sapiens
  misc_feature: GZ8MTXP02J3NLZ.19.67.G01.1.454.CMB.2.raw
  modified_base (349)..(349): a, c, t, g, unknown or other
  misc_feature (349)..(349): n is a, c, g, or t
  modified_base (416)..(416): a, c, t, g, unknown or other
  misc_feature (416)..(416): n is a, c, g, or t
  modified_base (425)..(425): a, c, t, g, unknown or other
  misc_feature (425)..(425): n is a, c, g, or t
  modified_base (454)..(454): a, c, t, g, unknown or other
  misc_feature (454)..(454): n is a, c, g, or t
  modified_base (506)..(506): a, c, t, g, unknown or other
  misc_feature (506)..(506): n is a, c, g, or t
  modified_base (521)..(521): a, c, t, g, unknown or other
  misc_feature (521)..(521): n is a, c, g, or t
tcagtactctcgtgcacgaccggtgctcgatttagagtatacatattgggtttggggtctgggagaggagccagcactgggattccgaggtgtttccattcggtgctcagcactgaaaacagaggactcaccatggagttttggctgacctgggttttcctgctgcaatttcaggaggtgtccagtgtgaggtgcaactggtggagactggcggaggcttggtccagcctgggcgtctctgagactgtcctgtcgaaccctctggggtctccgtcagcagcgactgtattgcctgggtcccgccaggctccgagggagaggccggagtgggtcgcaggttatttttagnggtcgggacgacattctacggagactccatgggacggggccattcaccatctccagagtacttttcncagaaaccncaactgtctcttacaaaatgaacagtccnggagggcccgaggaccacggccgttacttattattgtgtgagtagttttagnggcgagtggcgtggngacagactcgacggtcgggggacccg

SEQ ID NO: 320254 - DNA, 541 bp, Homo sapiens
  misc_feature: GZ8MTXP02JOZVW.19.67.G01.1.454.CMB.2.raw
  modified_base (377)..(377): a, c, t, g, unknown or other
  misc_feature (377)..(377): n is a, c, g, or t
  modified_base (416)..(416): a, c, t, g, unknown or other
  misc_feature (416)..(416): n is a, c, g, or t
  modified_base (481)..(481): a, c, t, g, unknown or other
  misc_feature (481)..(481): n is a, c, g, or t
  modified_base (494)..(494): a, c, t, g, unknown or other
  misc_feature (494)..(494): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtcgaaccctctggggtctccgtcagcagcgactgtattgcctgggtccgccaggctccgaggggaagaggccggagtgggtcgcgaggtatttttagaggtgggacgacattctacggagactccngtgggagggccgattcgaccatctaccagagtactttcnctagaacacactgtctcttacaaatgaaacagcctagacgggccgaggacacggctctattatgngtgagtagttagnggcgagtggtacgtggtgacagactcgacgtcgggggactaacgggg

SEQ ID NO: 320255 - DNA, 551 bp, Homo sapiens
  misc_feature: GZ8MTXP02HDR9L.19.67.G01.1.454.CMB.2.raw
  modified_base (498)..(498): a, c, t, g, unknown or other
  misc_feature (498)..(498): n is a, c, g, or t
tcagtactctcgtgcacgaccggtgctcgatttagagtatacatattgggtttgggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggcctccgagggaagaggccggagtgggtcgcaggtatttttagtaggtgggaccgacattctacggagactccatgggagggccgattcaccgatctcccagagtacttttctctaagaaacacacttgtcctctacaaaatgaaacagcctgagggccgaaggacacggccgtctattatgtgtgagtagtttangggcagtggcttgggtggaactagaactcgacgtcgggggacctaaccggggg

SEQ ID NO: 320256 - DNA, 536 bp, Homo sapiens
  misc_feature: GZ8MTXP02GPOW4.19.67.G01.1.454.CMB.2.raw
  modified_base (370)..(370): a, c, t, g, unknown or other
  misc_feature (370)..(370): n is a, c, g, or t
  modified_base (489)..(489): a, c, t, g, unknown or other
  misc_feature (489)..(489): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctgggtctccgtcagcagcgactgtattgcctgggtccgccaggctccgaggggaagaggccggagtgggtcgctaggtatttttagaggtgggaccgacattctacgganactccatgggagggccgattcaccatctccagagtactttctcagaacacactgtctcttcaaatgaacagcctgagggccgaggacacggccgtactattatgtgtagagtagtttanggcgagtggctgggtgacgagactcgacgtcgggggacctaacgggg

SEQ ID NO: 320257 - DNA, 535 bp, Homo sapiens
  misc_feature: GZ8MTXP02FSTDK.19.67.G01.1.454.CMB.2.raw
  modified_base (498)..(498): a, c, t, g, unknown or other
  misc_feature (498)..(498): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctggggcggtctctgagactgtcctgtgaaccctctggggtctccgtcagcagcgactgtattgcctgggtccgccaggctccaggggaagaggcccggagtggggtcgcgaggtatttttagaggtggggacgacattctacggagctccatggagggccgattcaccatctccagagtacttttctacagaacacactgtctcttacaaatgaacagcctagacgggccgaggacacggccgtctattatgtgtgagtagtttagnggacgagtggcgtggtggacagactcgacgtcggggg

SEQ ID NO: 320258 - DNA, 566 bp, Homo sapiens
  misc_feature: GZ8MTXP02GC6EC.19.67.G01.1.454.CMB.2.raw
  modified_base (300)..(300): a, c, t, g, unknown or other
  misc_feature (300)..(300): n is a, c, g, or t
  modified_base (375)..(375): a, c, t, g, unknown or other
  misc_feature (375)..(375): n is a, c, g, or t
  modified_base (507)..(507): a, c, t, g, unknown or other
  misc_feature (507)..(507): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagtttggctgacctgggtttcctgctgcaattcaggaggtgtccagtgtgaggtgcaactggtggagactgggcggaggcttgggtccaggcctggggcggtctcgtgagactgtcctgtgaaccctcttgggtctccgtcagcagcgactgtattgcctgggtccncaggctccgaggggaagaggccggagtcggggtcgcgtaggttatttttagagggttgggaccacattcacgganactcagtgggagggccgattcaccatcctccagtagtactttcactagaacacactgtctacttacaaatgaaactagcctgggacgggacgacggacgacggccgtactattagtgtgtagagtagtttangggacgtagtggcgttgggaacgacgtaggactacgacgtcgggggaccctaaacgggg

SEQ ID NO: 320259 - DNA, 535 bp, Homo sapiens
  misc_feature: GZ8MTXP02JLPHS.19.67.G01.1.454.CMB.2.raw
  modified_base (371)..(371): a, c, t, g, unknown or other
  misc_feature (371)..(371): n is a, c, g, or t
  modified_base (415)..(415): a, c, t, g, unknown or other
  misc_feature (415)..(415): n is a, c, g, or t
  modified_base (511)..(511): a, c, t, g, unknown or other
  misc_feature (511)..(511): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagtttggctgacctgggttttccttgctgcaatttcaggaggtgtccagtgtgaggtgcaactggtggagactgggcggaggcttggtccagcctgggcggtctctgagactgtcctgtgaaccctctggggtctccgtcagcagcactgtattgcctgggtccgccaggctccagagaagaggccggagtgggtcgcaggttattttagtagggtgggacgacattctacggngactccagtggagggccgattcaccatctccagagtacttttcnctagaaccacactgtacctcttacaaatgaaccagcctggagggccgaggacacggccgtctattattgtgtggataggtttacgtggcgatgggngtgggtcggacaggtactacgacg

SEQ ID NO: 320260 - DNA, 552 bp, Homo sapiens
  misc_feature: GZ8MTXP02HU0GY.19.67.G01.1.454.CMB.2.raw
  modified_base (412)..(412): a, c, t, g, unknown or other
  misc_feature (412)..(412): n is a, c, g, or t
  modified_base (503)..(503): a, c, t, g, unknown or other
  misc_feature (503)..(503): n is a, c, g, or t
  modified_base (515)..(515): a, c, t, g, unknown or other
  misc_feature (515)..(515): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtcgaaccctctggggtctccgtcagcagcgactgtattgcctgggtccgccaggctccaggggaagaggccggagtgggtcgcaggtatttttagaggtgggaccgacattctacgggatactccagtggagggcgattcaccatctccagagtactttcnctagaacacactgtctacttacaaaattagaaacagcctaggacggggcccgaggaccacggccgtctattaatgtgtgagttagttacgnggtcagtcgggngtggtaagacgagtacgcgtacggcgggaccgaacgg

SEQ ID NO: 320261 - DNA, 538 bp, Homo sapiens
  misc_feature: GZ8MTXP02HTTSB.19.67.G01.1.454.CMB.2.raw
  modified_base (295)..(295): a, c, t, g, unknown or other
  misc_feature (295)..(295): n is a, c, g, or t
  modified_base (424)..(424): a, c, t, g, unknown or other
  misc_feature (424)..(424): n is a, c, g, or t
  modified_base (491)..(491): a, c, t, g, unknown or other
  misc_feature (491)..(491): n is a, c, g, or t
  modified_base (503)..(503): a, c, t, g, unknown or other
  misc_feature (503)..(503): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagtttggctgacctgggtttcctgctgcaatttcaggaggtgtccagtgtgaggtgcaactggtggagactggcggaggcttggtccagcctgggcggtctcgtgagactgtcctgtgaaccctgtgggtctccgtcagcagcgactgtatgcctgggtccncaggctccgaaggggaagaggccggagtgggtcgcgtagggttatttttagagggtggacacattcgaacggagactcagtggaggccatcaccatcctacagatactttcacagaacacactgtcctnttacgaaatgaaacacgccgagacgggccgaaggtacacgggcctatagttatgtgtgagtagttancggcgtagcggngtgggaagaacagtactacgacggtcggacgacgg

SEQ ID NO: 320262 - DNA, 566 bp, Homo sapiens
  misc_feature: GZ8MTXP02JHXSS.19.67.G01.1.454.CMB.2.raw
  modified_base (422)..(422): a, c, t, g, unknown or other
  misc_feature (422)..(422): n is a, c, g, or t
  modified_base (506)..(506): a, c, t, g, unknown or other
  misc_feature (506)..(506): n is a, c, g, or t
  modified_base (537)..(537): a, c, t, g, unknown or other
  misc_feature (537)..(537): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgcaggctccgagggaagaggccggagtggggtcgctagggttatttttagagggttgggaccgacattcgtacggagaccttccagtgggacggggccgaattcgacatctccagagacttttncaagaacacactgtctacttcaaattcgaaacagcctagaggggccgaggacacggcgtactattatgtgtagagtagtttagnggacgtagtgggcgtgggtggaacaggtacncgaacggttcgggggaccgtaaccggggg

SEQ ID NO: 320263 - DNA, 552 bp, Homo sapiens
  misc_feature: GZ8MTXP02F5MBS.19.67.G01.1.454.CMB.2.raw
  modified_base (304)..(304): a, c, t, g, unknown or other
  misc_feature (304)..(304): n is a, c, g, or t
  modified_base (332)..(332): a, c, t, g, unknown or other
  misc_feature (332)..(332): n is a, c, g, or t
  modified_base (355)..(355): a, c, t, g, unknown or other
  misc_feature (355)..(355): n is a, c, g, or t
  modified_base (367)..(367): a, c, t, g, unknown or other
  misc_feature (367)..(367): n is a, c, g, or t
  modified_base (387)..(387): a, c, t, g, unknown or other
  misc_feature (387)..(387): n is a, c, g, or t
  modified_base (390)..(390): a, c, t, g, unknown or other
  misc_feature (390)..(390): n is a, c, g, or t
  modified_base (401)..(401): a, c, t, g, unknown or other
  misc_feature (401)..(401): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttcctgctgcaatttcaggaggtgtccagtgtgaggtgcaactgggtggagactgggcggaggcttgggtccagccgtggggcggtctcgtgagactgtcctgtcgaaccctgtggggtctccgtcagcagcgactgtatgcctggtccncaggctcgaggagaggccggagtgggcnctaggttatttagaggtggacanagtcgtacgganactcagtgggaggcatcacntcncagatctttcncaagaacacatcgtctactacaaaatgaaacagcctaggacggggaccgaaggaccgacgggtacccttatatttagtgtagtgagttagtttagtcggacgagtggcgttagggaaggacagataccacggttcggggaccctaacgggg

SEQ ID NO: 320264 - DNA, 533 bp, Homo sapiens
  misc_feature: GZ8MTXP02F27NW.19.67.G01.1.454.CMB.2.raw
  modified_base (372)..(372): a, c, t, g, unknown or other
  misc_feature (372)..(372): n is a, c, g, or t
  modified_base (489)..(489): a, c, t, g, unknown or other
  misc_feature (489)..(489): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctgggcgtctctgagctgtcctgtcgaaccctctggggtctccgtcagcagcgactgtattgcctgggtccgccaggctccgagggaagaggccggaggtgggtcgctaggttatttttagaggtgggaccgacattcacggganactcagtgggagggccgattcgcatctccagagtactttctcagaacacactgtctacttcaaatgaacagctggagggccgaggacacggcgtctattatgtgtgagtagtttagnggcgtagtggctgggtgacagactcgacgtcggggacaacgggg

SEQ ID NO: 320265 - DNA, 574 bp, Homo sapiens
  misc_feature: GZ8MTXP02GSFUA.19.67.G01.1.454.CMB.2.raw
  modified_base (252)..(252): a, c, t, g, unknown or other
  misc_feature (252)..(252): n is a, c, g, or t
  modified_base (287)..(287): a, c, t, g, unknown or other
  misc_feature (287)..(287): n is a, c, g, or t
  modified_base (293)..(293): a, c, t, g, unknown or other
  misc_feature (293)..(293): n is a, c, g, or t
  modified_base (302)..(302): a, c, t, g, unknown or other
  misc_feature (302)..(302): n is a, c, g, or t
tcagtactctcgtgcacgaccggtgctcgatttagagtatacatattgggtttgggggtagctcaggaagcagagcctggagcatctccactatggcctgggctccactacttctcaccctcctcgctcactgcacaggttcttgggccaactttatgctgactcagcccactctgtgtcggagtctccggggaagacggtaaccatcttttgcacccacaacagtggcaaacattgccagcaaatttttgngcagtgtacagcagcgccggcacgtccccacatgnatctangagaataanacaaaagccgtcgtcggggtcctgatcgtctctcgctccagtcgacagctcctacctaactctcgccctccctccaccactctctcgacgtagaaagaacgtagaaggaacggaacggacgtacgtaactaactaacttacgttacgtagttacttagtagtagtacgtccggcggtacgtagtcgtggtcgttcgggtacgggacgggaacgaacgacgtacgtaccgtaccgtaacgtacgacgaccgaacggacgtccgtacccgtccg

SEQ ID NO: 320266 - DNA, 600 bp, Homo sapiens
  misc_feature: GZ8MTXP02FXU6Q.19.67.G01.1.454.CMB.2.raw
  modified_base (243)..(243): a, c, t, g, unknown or other
  misc_feature (243)..(243): n is a, c, g, or t
  modified_base (320)..(320): a, c, t, g, unknown or other
  misc_feature (320)..(320): n is a, c, g, or t
  modified_base (597)..(597): a, c, t, g, unknown or other
  misc_feature (597)..(597): n is a, c, g, or t
  modified_base (599)..(600): a, c, t, g, unknown or other
  misc_feature (599)..(600): n is a, c, g, or t
tcagtactctcgtgcacgaccggtgctcgatttagagtatacatattgggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagacttttcncagaacacactgtctcttcaaatgaacagcctggagggccgaggacacggccgtctattattgtgtgagtagtttanggcgagtgggctgggtgacagatcacgtggggccaggggaccctggtccaccgtctcctcacgccctccaaccgacggggccccagtccggtcccttcccccgtggccgcccctgcctccgagggacgccacccgtccgagacgccacacggccgggcccgtcggggcctcggcccgttcgggtaccgaaacgggtaccttaacccgttcccgacggaacggtaacggtacgttcggacgggccggggcgtcgggccgaaacgggccgacagtacgngnn

SEQ ID NO: 320267 - DNA, 609 bp, Homo sapiens
  misc_feature: GZ8MTXP02H7246.19.67.G01.1.454.CMB.2.raw
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaattttcaggaggtgtccagtgtgaggtgcaactggtggagactgggcggaggcttggtccagccgtgggtggtctctgagactgtcctgtcgaaccctctggggtctccgtcagcagcgactgtattgcctcgggtccgccgacggctccgaggggaagagggccgggaggtggggtcgcgaggttatttttagaggtgggacgacattcgtacggagactccagtgggagggcccgtagttccaccgatcctcccagacgtaccttttctacaagtaaaccactactgtccttacttaccaaaattcggaaaccagcccgtaggacggggaccggaggaccgaacgggtcccgtactagtttagttgtaggtgaagtagtttagacgggtcgtagtcggtgtgggtggaacgagacgtcgacggtggggacccgaaccggggg

SEQ ID NO: 320268 - DNA, 460 bp, Homo sapiens
  misc_feature: GZ8MTXP02JBIJ2.19.67.G01.1.454.CMB.2.raw
  modified_base (259)..(259): a, c, t, g, unknown or other
  misc_feature (259)..(259): n is a, c, g, or t
  modified_base (269)..(270): a, c, t, g, unknown or other
  misc_feature (269)..(270): n is a, c, g, or t
  modified_base (274)..(274): a, c, t, g, unknown or other
  misc_feature (274)..(274): n is a, c, g, or t
  modified_base (277)..(277): a, c, t, g, unknown or other
  misc_feature (277)..(277): n is a, c, g, or t
  modified_base (279)..(279): a, c, t, g, unknown or other
  misc_feature (279)..(279): n is a, c, g, or t
  modified_base (288)..(288): a, c, t, g, unknown or other
  misc_feature (288)..(288): n is a, c, g, or t
  modified_base (290)..(290): a, c, t, g, unknown or other
  misc_feature (290)..(290): n is a, c, g, or t
  modified_base (293)..(293): a, c, t, g, unknown or other
  misc_feature (293)..(293): n is a, c, g, or t
  modified_base (301)..(301): a, c, t, g, unknown or other
  misc_feature (301)..(301): n is a, c, g, or t
  modified_base (306)..(306): a, c, t, g, unknown or other
  misc_feature (306)..(306): n is a, c, g, or t
  modified_base (308)..(308): a, c, t, g, unknown or other
  misc_feature (308)..(308): n is a, c, g, or t
  modified_base (310)..(310): a, c, t, g, unknown or other
  misc_feature (310)..(310): n is a, c, g, or t
  modified_base (312)..(313): a, c, t, g, unknown or other
  misc_feature (312)..(313): n is a, c, g, or t
  modified_base (322)..(322): a, c, t, g, unknown or other
  misc_feature (322)..(322): n is a, c, g, or t
  modified_base (328)..(328): a, c, t, g, unknown or other
  misc_feature (328)..(328): n is a, c, g, or t
  modified_base (331)..(331): a, c, t, g, unknown or other
  misc_feature (331)..(331): n is a, c, g, or t
  modified_base (334)..(335): a, c, t, g, unknown or other
  misc_feature (334)..(335): n is a, c, g, or t
  modified_base (337)..(337): a, c, t, g, unknown or other
  misc_feature (337)..(337): n is a, c, g, or t
  modified_base (339)..(339): a, c, t, g, unknown or other
  misc_feature (339)..(339): n is a, c, g, or t
  modified_base (341)..(341): a, c, t, g, unknown or other
  misc_feature (341)..(341): n is a, c, g, or t
  modified_base (344)..(346): a, c, t, g, unknown or other
  misc_feature (344)..(346): n is a, c, g, or t
  modified_base (348)..(350): a, c, t, g, unknown or other
  misc_feature (348)..(350): n is a, c, g, or t
  modified_base (352)..(352): a, c, t, g, unknown or other
  misc_feature (352)..(352): n is a, c, g, or t
  modified_base (357)..(358): a, c, t, g, unknown or other
  misc_feature (357)..(358): n is a, c, g, or t
  modified_base (360)..(360): a, c, t, g, unknown or other
  misc_feature (360)..(360): n is a, c, g, or t
  modified_base (362)..(362): a, c, t, g, unknown or other
  misc_feature (362)..(362): n is a, c, g, or t
  modified_base (365)..(366): a, c, t, g, unknown or other
  misc_feature (365)..(366): n is a, c, g, or t
  modified_base (368)..(368): a, c, t, g, unknown or other
  misc_feature (368)..(368): n is a, c, g, or t
  modified_base (370)..(370): a, c, t, g, unknown or other
  misc_feature (370)..(370): n is a, c, g, or t
  modified_base (373)..(373): a, c, t, g, unknown or other
  misc_feature (373)..(373): n is a, c, g, or t
  modified_base (375)..(375): a, c, t, g, unknown or other
  misc_feature (375)..(375): n is a, c, g, or t
  modified_base (377)..(377): a, c, t, g, unknown or other
  misc_feature (377)..(377): n is a, c, g, or t
  modified_base (379)..(379): a, c, t, g, unknown or other
  misc_feature (379)..(379): n is a, c, g, or t
  modified_base (381)..(381): a, c, t, g, unknown or other
  misc_feature (381)..(381): n is a, c, g, or t
  modified_base (383)..(383): a, c, t, g, unknown or other
  misc_feature (383)..(383): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctgggcgtcgctggacacgtgcctgtgacctntgggctccgnncagnatntntgcgtggcncngcncgaggagnggcgngngngnngtattgtgngacganatnagnncngngngcnnncnnncnatctnnananacnntntntanananancncngagacgacgcgacgcgtctatatgtgtagtagtagtagtgacgtgcgtgtgtgagagacacgacgacggacggacgg

SEQ ID NO: 320269 - DNA, 596 bp, Homo sapiens
  misc_feature: GZ8MTXP02H2MCY.19.67.G01.1.454.CMB.2.raw
tcagtactctcgtgcacgaccggtgctcgatttagagtatacatattgggtttgggggagaggagcccagcactgggattccgaggtgtttccattcggtgctcagcactgaacacagaggactcaccatggagttttggctgaccttgggttttccttgctgcaatttcaggaggtgtccagtgtgaggtgcaaccggtggagactggcggaggcttggtccagccgtgggcgtctctgagactgtcctgtcgaaccctcgtgggtctccgtcagcagcgactgtattgcctgggtcccgcaggctccgagggaagaggccggaggtgggtcgcgtaggttattttaagtagggtggggacgacctattcgtacggagactccgaagtggggacgggccattccaacctatcctcccaagtacgtactttttccacaagaactacacttgtcctacttacaaaatgaaacagcctaggacgggccgaggacaccgggcttactaattagttgtagtagtaggtagttttaggacggtcgtagtcggcgtggtaggaacgacgacgtacgacggtacgggaccggacgggtaaccg

SEQ ID NO: 320270 - DNA, 586 bp, Homo sapiens
  misc_feature: GZ8MTXP02IRJOQ.19.67.G01.1.454.CMB.2.raw
  modified_base (297)..(297): a, c, t, g, unknown or other
  misc_feature (297)..(297): n is a, c, g, or t
  modified_base (534)..(534): a, c, t, g, unknown or other
  misc_feature (534)..(534): n is a, c, g, or t
tcagtactctcgtgcacgaccggtgctcgatttagagtatacatattgggtttgggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtcgaaccctctggggtctccgtcagcagcgactgtatgcctggtccnccaggctccgaggggaagagggccggagtggggtcgcgtaggttatttttagaggtggggaccgacattcgtacggagacctcagtgggaggcccgattccgaaccagtcctaccagtagtaccttttcactaagaaccacacttgtcctacttacaaaattgaaacacgtcctggacgggacccgaaggaccacggggcccgttactaagtttagttgtaggtgtaggtagtttangggtacgagtggtcgtggtggacgtagacgtcgacgtcggggaccgaacggg

SEQ ID NO: 320271 - DNA, 526 bp, Homo sapiens
  misc_feature: GZ8MTXP02ICU48.19.67.G01.1.454.CMB.2.raw
  modified_base (485)..(485): a, c, t, g, unknown or other
  misc_feature (485)..(485): n is a, c, g, or t
tcagtactctcgtgcacgaccggtgctcgatttagagtatacatattgggtttgggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtatgcctgggtccgcaggctccagggaagaggccggagtggggtcgcaggtatttttagaggtggaccgacattctacggagactccagtggagggccgattccgacatctccagagtactttctcagtaacacactgtctcttcaaatgaacagcctggagggccgaggacacggcgtctattatgtgtgagtagtttagnggacgagtggctggtgacagactcacgtcggggcaacgggg

SEQ ID NO: 320272 - DNA, 590 bp, Homo sapiens
  misc_feature: GZ8MTXP02FQLVZ.19.67.G01.1.454.CMB.2.raw
  modified_base (538)..(538): a, c, t, g, unknown or other
  misc_feature (538)..(538): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcgtctctgagctgtcctgtcgaaccctcgtgggtctccgtcagcagcgactgtattgcctgggtcccgccaggctccgaggggaagagggccggagtgggtcgcgtaggttattttagagggtgggaccgacagttcgtacggagacttccaggtgggacgggccgaattccaacctatcctaccagtacgtacttttcacaagaaacactactgtctacttacgaaaatcgaaacacgaccgtgggaacggggccgaacgggacgaccgggccgttactattagttggtagtagagtagtttacgnggacgtagtcggcgtaggaagacgagtacgcgacggtcggggaccgtaacgg

SEQ ID NO: 320273 - DNA, 635 bp, Homo sapiens
  misc_feature: GZ8MTXP02GKTHF.19.67.G01.1.454.CMB.2.raw
  modified_base (267)..(267): a, c, t, g, unknown or other
  misc_feature (267)..(267): n is a, c, g, or t
  modified_base (280)..(280): a, c, t, g, unknown or other
  misc_feature (280)..(280): n is a, c, g, or t
  modified_base (324)..(324): a, c, t, g, unknown or other
  misc_feature (324)..(324): n is a, c, g, or t
  modified_base (339)..(339): a, c, t, g, unknown or other
  misc_feature (339)..(339): n is a, c, g, or t
  modified_base (374)..(374): a, c, t, g, unknown or other
  misc_feature (374)..(374): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttgggtccagcctggggcggtctctgagactgtcctgtgaaccctntggggtctccgtnagcagcgactgtattgcctgggtccgccaggctccgagggaagnggccggagtgggtcncgaggtatttttagaggtggacgatattctagganctcagtggaggccgatcacatctccagagtactttactcacgaacactactgtaccttacttacaaagttcgaaacacgaccgttaggaccggggaccggaacgggaaccgaaccggggtcccggttaaccttaagtttaacgtttcgggttaggttagggtaacggtaaggtttttacgaaggggtccggtaagtttaggggccgttagggggttaacgggtacgaacgggtacttaccggtaacgggttacccgggggg

SEQ ID NO: 320274 - DNA, 547 bp, Homo sapiens
  misc_feature: GZ8MTXP02JNZHF.19.67.G01.1.454.CMB.2.raw
  modified_base (260)..(260): a, c, t, g, unknown or other
  misc_feature (260)..(260): n is a, c, g, or t
  modified_base (413)..(413): a, c, t, g, unknown or other
  misc_feature (413)..(413): n is a, c, g, or t
  modified_base (444)..(444): a, c, t, g, unknown or other
  misc_feature (444)..(444): n is a, c, g, or t
  modified_base (496)..(496): a, c, t, g, unknown or other
  misc_feature (496)..(496): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctntggggtctccgtcagcagcgactgtattgcctggtccgcaggctccgagggaagaggccggagtgggtcgcaggttatttttagagggtggaccgactattctaacggagaccttccagtgggaggccgattcacatctccagagtactttcncaagaacacactgtctcttacaaatgaaacngcctaggacgggccgaggacacgggcgtctattagtgtgtagagtagtttangggacagtggcgtggtaaggactagactcgacggtcggggacctaacgggg

SEQ ID NO: 320275 - DNA, 603 bp, Homo sapiens
  misc_feature: GZ8MTXP02JN50N.19.67.G01.1.454.CMB.2.raw
  modified_base (423)..(423): a, c, t, g, unknown or other
  misc_feature (423)..(423): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccaggccgtgggcggtctctgagactgtcctgtgaaccctcgtggggtctccgtcagcagcgactgtatgctggtccgcaggctcgagggagaggccggagtgggtcgcgtaggtatttttagaggtgggaccgacgtattctacggagacctccgagtgggagggcccgtattccgaccatcctccagtacgtactttacncaagaacactactcgtactcttacaaatcgaaacacgtccctagggacggggacccgaaggaccgaacgggtcccgtacttagtttaagttggttagtggtaggtagtttaagtgggtacgtagtgggtcgttgggtaaggaccaggacgtcgaccggtcgggggacccgaaaccggggg

SEQ ID NO: 320276 - DNA, 563 bp, Homo sapiens
  misc_feature: GZ8MTXP02F925Q.19.67.G01.1.454.CMB.2.raw
tcagtactctcgtgcacgaccggtgctcgatttagagtatacatattgggtttggggtctgggagaggagcccagcactgggattccgaggtgtttccattcggtgctcagcactgaacacagaggactcaccatggagtttggctgacctgggttttccttgctgcaatttcaggaggtgtccggtgtgaggtgcaactggtggagactggcggaggcttggtccagcctgggcggtctctgagactgtcctgtgaaccctctggggtctccgtcagcagcgactgtattgcctggggtccgccaggctccaggggaagagggccggaggtgggtcgctaggtattttagtaggtgggacgacattctacggagactccagtggagggccgattcaccatcctccagagtactttcacagaacacactgtactcttacaaaattgaaactagccctaggacggggacccgagggaccacggccgtctaattatgtgtgagtaggtttatgggcgtagtgggactgggtggaacgaggacgtcgaacggtcgggggaacccgg

SEQ ID NO: 320277 - DNA, 555 bp, Homo sapiens
  misc_feature: GZ8MTXP02JSPVD.19.67.G01.1.454.CMB.2.raw
  modified_base (516)..(516): a, c, t, g, unknown or other
  misc_feature (516)..(516): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttcctgctgcaatttcaggaggtgtccagtgtgaggtgcaactgggtggagactgggcggaggcttggccagcctggggcggtctctgagactgtcctgtcgaaccctctggggtctccgtcagcagcgactgtatgcctgggtccgccaggctccgagggaagaggccggaggtgggtcgcgaggttagtttttagtaggttgggaccgacgattcgtacggagactcagtggagggccgattcacgatctccagagtactttctctagaacacactgtctctactaaatgaacagccgtagacgggacgacggacgacggcgtctattagtgtgtgtagtagtttagtggcgtagtcggngtgggtgacgagacacgtacgtcggggaccaaccggggg

SEQ ID NO: 320278 - DNA, 568 bp, Homo sapiens
  misc_feature: GZ8MTXP02IDBCJ.19.67.G01.1.454.CMB.2.raw
  modified_base (378)..(378): a, c, t, g, unknown or other
  misc_feature (378)..(378): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttgggtccagccgtgggcggtctctgagactgtcctgtcgaaccctgtggggtctccgtcagcagcgactgtatgcctggtccgcaggctccgaggggaagaggccggagtgggtcgcgtaggttattttagagggtgggacgacattcgtacgganactccaagtgggacgggcctaattcaacctatctaccagacgtactttctcaagaaacacactgtctacttacaaattacgaacagccctaggacgggaccgaaggacgacggtcccgtactaagttattggtgttagagtacggtttagcggacgtagtggcgtggacgacagtactacgacggtcggg

SEQ ID NO: 320279 - DNA, 550 bp, Homo sapiens
  misc_feature: GZ8MTXP02GOH7M.19.67.G01.1.454.CMB.2.raw
  modified_base (372)..(372): a, c, t, g, unknown or other
  misc_feature (372)..(372): n is a, c, g, or t
  modified_base (445)..(445): a, c, t, g, unknown or other
  misc_feature (445)..(445): n is a, c, g, or t
  modified_base (499)..(499): a, c, t, g, unknown or other
  misc_feature (499)..(499): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtatgcctgggtccgccaggctccgaggggaagaggccggagtggggtcgcgtaggttattttagagggtggaccgacattctacgganactcagtgggagggccgattcaccatctccagagtacttttcacagaacacactgtctcttacaaatgaaacngcctggacgggccaaggacacgggccgtactattattgtgtaggagtagtttangggcgtagtcggactgggtgaacagactcgacgtcggggacctaacggggg

SEQ ID NO: 320280 - DNA, 556 bp, Homo sapiens
  misc_feature: GZ8MTXP02HU8AC.19.67.G01.1.454.CMB.2.raw
  modified_base (367)..(367): a, c, t, g, unknown or other
  misc_feature (367)..(367): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcgtctctgagactgtcctgtcgaaccctcgtggggctccggtcagcagcgactgtatgctggtccgcaggctccgagggaagaggcgaggtggcgctaggttattttagagggtgggactacattcacgganctccatggaggccattccaccatccaccagacgtacttttcacaacgaaacacaacctgtacttacttacaaaatcgaaacagcctaggaggggacccgaaggaaccgtacggcccgttataaattagttgtagtggaagtacgtttagtcggacgtagtggcgtggacgacagactacgacggtcggg

SEQ ID NO: 320281 - DNA, 534 bp, Homo sapiens
  misc_feature: GZ8MTXP02HHJ94.19.67.G01.1.454.CMB.2.raw
  modified_base (412)..(412): a, c, t, g, unknown or other
  misc_feature (412)..(412): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccgagggagaggccggagtgggtcgcaggtatttttataggtgggaccgacattctacggagactccagtgggagggccgagttcaccatctccagagtactttcncagaacacactgtctcttcaaatgaaacagccgtgacgggccgaggacacggccgtctattatgtgtgagtagtttatggcgagtggcgtggtggacagatcgacgtcgggacgtaacgggg

SEQ ID NO: 320282 - DNA, 526 bp, Homo sapiens
  misc_feature: GZ8MTXP02GA6CL.19.67.G01.1.454.CMB.2.raw
  modified_base (491)..(491): a, c, t, g, unknown or other
  misc_feature (491)..(491): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttgggtccagcctgggcggtctctgagactgtcctgtgaaccctctggggtctccgtcagcagcgactgtatgcctggtccgccaggctccagggagaggccggagtggggtcgcgaggtatttttagtagggtggggacgacattctacggagctccagtggagggccgattcaccatctccagagactttctcagaacacactgtctacttacaaatgaacagcctgacggcgaggacacggccgtctattattgtgtgagtagttagnggacgagtggcgtggtggacagatcgacgtcgggg

SEQ ID NO: 320283 - DNA, 765 bp, Homo sapiens
  misc_feature: GZ8MTXP02GSRAV.19.67.G01.1.454.CMB.2.raw
  modified_base (306)..(306): a, c, t, g, unknown or other
  misc_feature (306)..(306): n is a, c, g, or t
tcagtactctcgtgcacgaccggtgctcgatttagagtatacatattgggtttgggggagaggagcccagcactgggattccgaggtgtttccattcggtgctcagcactgaacacagaggactcaccatggagttttggctgacctgggttttccttgctgcaatttcaggagtgtccagtgtgaggtgcaacgtggtggagacgtgggcggaggcttggtccagcccgtggggcggtctctgagactgtcctgtcgaaccctgtggggtctccgtcagcagcgactgtatcgccgtgggtcccncgaggcctccggaaggggaacgcgggccggaggtcgggtcgacgtaggtttaatttttagaggggttgggaacccgtactagtttacgtaacggagtaccctacaggtggggacgggccgtattccgaacctacgttccctacccgtaaggtactttaccttttcctacgaaacgtaaaccacctaacgttcgttaccttaccgttaaacctaaaagttacgaaaaccgtcggtacccgtaggggaaccgggggacccggaaaccgggtaacccggacccggggtacccggttaactttaaagtttaacggtttgggttaggttaacggtaaagggttttaaggttttaaagggtccggggtacggttaacggttcggggtccggtttaggggtaaggggaaacctaagggtacgttaccggaaacggggttccgggggaacccggtaaaacccggggg

SEQ ID NO: 320284 - DNA, 556 bp, Homo sapiens
  misc_feature: GZ8MTXP02F1PH4.19.67.G01.1.454.CMB.2.raw
  modified_base (425)..(425): a, c, t, g, unknown or other
  misc_feature (425)..(425): n is a, c, g, or t
  modified_base (499)..(499): a, c, t, g, unknown or other
  misc_feature (499)..(499): n is a, c, g, or t
  modified_base (512)..(512): a, c, t, g, unknown or other
  misc_feature (512)..(512): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccaggcctgggcggtctctgagactgtcctgtgaaccctctggggtctccgtcagcagcgactgtattgcctgggtccgccaggctccgagggaagaggccggagtgggtcgcgtaggttatttttagaggtgggaccgacattcgtacggagaccttccagtgggagggccgtattccaccgatctaccagacgtacttttcncaagaacacactgtctacttacaaatcgaaacacgcctaggacgggccgaggtacacggtccgtctattattgngtgagtagtttanggcagtggctgggtgacgagatcgacgtcggggacctaacgggg

SEQ ID NO: 320285 - DNA, 555 bp, Homo sapiens
  misc_feature: GZ8MTXP02HY9F0.19.67.G01.1.454.CMB.2.raw
  modified_base (446)..(446): a, c, t, g, unknown or other
  misc_feature (446)..(446): n is a, c, g, or t
  modified_base (491)..(491): a, c, t, g, unknown or other
  misc_feature (491)..(491): n is a, c, g, or t
  modified_base (513)..(513): a, c, t, g, unknown or other
  misc_feature (513)..(513): n is a, c, g, or t
  modified_base (525)..(525): a, c, t, g, unknown or other
  misc_feature (525)..(525): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctggggcggtctctgagactgtcctgtgaaccctctggggtctccgtcagcagcgactgtattgctggtccgcaggctccaggagaggccggagtgggtcgcgaggtatttttagaggtgggacgacattctacgggagaccttccaatcgggaagggcccgatttcacccattcaccagacgtactttctacaagaacacacttgtctactttnaaaacttgaaacagccgtgaacgggcgaaggccgtaacggccgtntattatgtgtggataggtttancggacgtatggngttgggacggaacagtactcgacggtcggg

SEQ ID NO: 320286 - DNA, 559 bp, Homo sapiens
  misc_feature: GZ8MTXP02I8V6M.19.67.G01.1.454.CMB.2.raw
  modified_base (305)..(305): a, c, t, g, unknown or other
  misc_feature (305)..(305): n is a, c, g, or t
  modified_base (437)..(437): a, c, t, g, unknown or other
  misc_feature (437)..(437): n is a, c, g, or t
  modified_base (516)..(516): a, c, t, g, unknown or other
  misc_feature (516)..(516): n is a, c, g, or t
  modified_base (526)..(526): a, c, t, g, unknown or other
  misc_feature (526)..(526): n is a, c, g, or t
  modified_base (531)..(531): a, c, t, g, unknown or other
  misc_feature (531)..(531): n is a, c, g, or t
  modified_base (541)..(541): a, c, t, g, unknown or other
  misc_feature (541)..(541): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgcaactggtggagactgggcggaggcttggtccagccgtggggcggtctctgagactgtcctgtcgaaccctcgtggggtctccgtcagcagcgactgtatgcctgggtccncaggctccgagggagaggccggagtgggtcgcgtaggttatttttagagggttgggaccgactagttctacggggagaccttccagtgggacggggccgtatttccacctatcctccagtacgtacttttcncagaacacactgtctctacaaatgaacagcctggagggccgaaggacacggcgtactattatgtgtgagtagtttaggngacgagtcgngtggngacgagtacncgacggcgggaccgacgg

SEQ ID NO: 320287 - DNA, 579 bp, Homo sapiens
  misc_feature: GZ8MTXP02GIDTC.19.67.G01.1.454.CMB.2.raw
  modified_base (443)..(443): a, c, t, g, unknown or other
  misc_feature (443)..(443): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtcgaaccctctggggtctccgtcagcagcgactgtattgcctgggtccgccaggctccgaggggaagagggccgggagtggggtcgcgtaggttatttttagaggttggggaccgacattcgaacgggagacttccagtgggaaggggccgattccgaccatcctacccagtacgtacttttcacagaaacncactgtctcttacaaatgaaacagccctggacggggaccgaggaccgacgggccgtctagttagttgtgtgagtagtttagtggcgtagtcggcgtgggtggactaggatccgagtcgggggaccgtaaaccgggg

SEQ ID NO: 320288 - DNA, 577 bp, Homo sapiens
  misc_feature: GZ8MTXP02FL8PW.19.67.G01.1.454.CMB.2.raw
  modified_base (432)..(432): a, c, t, g, unknown or other
  misc_feature (432)..(432): n is a, c, g, or t
  modified_base (465)..(465): a, c, t, g, unknown or other
  misc_feature (465)..(465): n is a, c, g, or t
  modified_base (517)..(517): a, c, t, g, unknown or other
  misc_feature (517)..(517): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctgggcggtctctgagactgtcctgtcgaaccctcgtggggtctccgtcagcagcgactgtattgcctgggtccgccaggctccgagggaagaggccggaggtgggtcgctaggttatttttagaggggtgggaccgactagttcgtacgggagacttccagtggggaacgggccgattccaccatcctaccagagtacttttcncaagaacactactgtctcttacaaaatgaaacngcctggacgggccgaggacacggccgtctattagtgtgtggagtagtttagngggacgtagtgggcttgggtaagggacaggtactcgacggtcgggggacccaaacggggg

SEQ ID NO: 320289 - DNA, 526 bp, Homo sapiens
  misc_feature: GZ8MTXP02G7FI6.19.67.G01.1.454.CMB.2.raw
  modified_base (180)..(180): a, c, t, g, unknown or other
  misc_feature (180)..(180): n is a, c, g, or t
  modified_base (244)..(244): a, c, t, g, unknown or other
  misc_feature (244)..(244): n is a, c, g, or t
  modified_base (299)..(299): a, c, t, g, unknown or other
  misc_feature (299)..(299): n is a, c, g, or t
  modified_base (320)..(320): a, c, t, g, unknown or other
  misc_feature (320)..(320): n is a, c, g, or t
  modified_base (413)..(413): a, c, t, g, unknown or other
  misc_feature (413)..(413): n is a, c, g, or t
  modified_base (418)..(418): a, c, t, g, unknown or other
  misc_feature (418)..(418): n is a, c, g, or t
  modified_base (498)..(498): a, c, t, g, unknown or other
  misc_feature (498)..(498): n is a, c, g, or t
  modified_base (507)..(507): a, c, t, g, unknown or other
  misc_feature (507)..(507): n is a, c, g, or t
  modified_base (521)..(521): a, c, t, g, unknown or other
  misc_feature (521)..(521): n is a, c, g, or t
  modified_base (524)..(526): a, c, t, g, unknown or other
  misc_feature (524)..(526): n is a, c, g, or t
tcagtactctcgtgcacgaccggtgctcgatttagagtatacatattgggcttggtccagcctgggcggtctctgagactgtcctgtgaaccctctggggtctccgtcagcagcgactgtattgcctgggtccgccaggctccagggaagaggccggagtgggtcgcaggttatttttanaggtgggacgacattctacggagactccatggagggccattcaccatctccagagactttttcncagaacacactgtctcttcaaaatgaacagcctgagggccgaggacacggccgtntattattgtgtgagagtttanggcgatgggctgggtggacagatcacgtggggccaggggaccctggtccacgtctcctcagccctccacgaagggcccatcggtccttccccnggccnccctgcctccaggacgcacctccgagacgcacagccggccctgggctgcctaggtcaaggctactcccagacgagtacgngacgcggcnggcgacggcgacanagnnn

SEQ ID NO: 320290 - DNA, 545 bp, Homo sapiens
  misc_feature: GZ8MTXP02ISPBF.19.67.G01.1.454.CMB.2.raw
  modified_base (298)..(298): a, c, t, g, unknown or other
  misc_feature (298)..(298): n is a, c, g, or t
  modified_base (372)..(372): a, c, t, g, unknown or other
  misc_feature (372)..(372): n is a, c, g, or t
  modified_base (413)..(413): a, c, t, g, unknown or other
  misc_feature (413)..(413): n is a, c, g, or t
  modified_base (506)..(506): a, c, t, g, unknown or other
  misc_feature (506)..(506): n is a, c, g, or t
  modified_base (518)..(518): a, c, t, g, unknown or other
  misc_feature (518)..(518): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggagtgtccagtgtgaggtgcaactggtggagactggcggaggcttggtccagcctgggcgtctctgagactgtcctgtcgaaccctctggggtctccggtcagcagcgactgtattgcctggtccncaggctccgagggaagaggccggagtgggtcgcaggtatttttagaggtggaccgacattctacggagactccngtgggagggccgattcaccagtcctacagacgtacttttcncaagaacacactagtctcttacaaatgaaacagcctaggacgggaccgaggacaccggcgtactattatgtgtgagtgtttagtggacgtagnggactgggtganagactacacggtacgggacaaccgggg

SEQ ID NO: 320291 - DNA, 534 bp, Homo sapiens
  misc_feature: GZ8MTXP02G4X6A.19.67.G01.1.454.CMB.2.raw
  modified_base (498)..(498): a, c, t, g, unknown or other
  misc_feature (498)..(498): n is a, c, g, or t
  modified_base (508)..(508): a, c, t, g, unknown or other
  misc_feature (508)..(508): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcgtctctgagactgtcctgtgaaccctctgggtctccgtcagcagcgactgtatgcctgggtccgccaggctccgagggaagaggccggagtgggtcgcgtaggtatttttagaggttgggacgacattctacggagactccagtgggagggccgagttcaccatctccagagtactttctacgacaacacactgtctacttcaaatgaacacgccgtagacggccgaggacgacggccgtctattattgtgtgagtagttanggcgagtggngtgggtgacgagactcgacgacgggg

SEQ ID NO: 320292 - DNA, 579 bp, Homo sapiens
  misc_feature: GZ8MTXP02I1WJU.19.67.G01.1.454.CMB.2.raw
  modified_base (328)..(328): a, c, t, g, unknown or other
  misc_feature (328)..(328): n is a, c, g, or t
  modified_base (523)..(523): a, c, t, g, unknown or other
  misc_feature (523)..(523): n is a, c, g, or t
  modified_base (536)..(536): a, c, t, g, unknown or other
  misc_feature (536)..(536): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttcctgctgcaatttcaggaggtgtccagtgtgaggtgcaacgtgggtggagacgtggcggaggcttgggtccagccgtggggcggtctcgtgagactgtcctgtcgaaccctcgtggggtctccgtcagcagcgactgtattgccgtgggtccgccaggctccgagggaaggngggccggaggtgggtcgcgtaggttatttttagagggtggaccgactattcgacggagactcagtgggacggccgattcgaccatctaccagacgtacttttcacaagaaccacactgtctacttacaaatgaaacacgcctaggacgggccgaacggacgacggccgtactattatgtgtagagttacgttagnggacgtagtcggngtggtaacggagagactacgacggtcggggaccgtaaccgggg

SEQ ID NO: 320293 - DNA, 566 bp, Homo sapiens
  misc_feature: GZ8MTXP02G32B5.19.67.G01.1.454.CMB.2.raw
  modified_base (424)..(424): a, c, t, g, unknown or other
  misc_feature (424)..(424): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccgaggggaagaggccggagtgggtcgctaggttatttttagagggttgggaccgacattcgtacggagactccgagtgggaagggccgagttccaccatcctccagagtacttttcncagaacacactgtctcttacaaatcgaaacacgccgtggacggggccgaaggaccgacgggccgtacttattagttgtgtagagtagtttagtggcgtagtggcgtgggtggacaggactcgacgtcggggaccgaacgggg

SEQ ID NO: 320294 - DNA, 564 bp, Homo sapiens
  misc_feature: GZ8MTXP02GY3NV.19.67.G01.1.454.CMB.2.raw
  modified_base (299)..(299): a, c, t, g, unknown or other
  misc_feature (299)..(299): n is a, c, g, or t
  modified_base (425)..(425): a, c, t, g, unknown or other
  misc_feature (425)..(425): n is a, c, g, or t
  modified_base (463)..(463): a, c, t, g, unknown or other
  misc_feature (463)..(463): n is a, c, g, or t
  modified_base (522)..(522): a, c, t, g, unknown or other
  misc_feature (522)..(522): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttgatccagcctgggcgtctctgagactgtcctgtgaaccctcgtggggtctccgtcagcagcgactgtatgcctgggtcccncaggctccgaggggaagcgggccggaggtgggtcgctaggttattttagagggtgggacgacagttcgtacggagactccagtgggacgggccgattcgaacctatcctccaagtagtaccttttnacaagaaccaacactgtactacttacaaaatcgaaacngcctaggacggaccgaggaccgacggcccgtatattagtggtcgtggaagtagtttagngggacgagtggtcgtggtagacgagatcgacggtgggacccg

SEQ ID NO: 320295 - DNA, 538 bp, Homo sapiens
  misc_feature: GZ8MTXP02G6ZT8.19.67.G01.1.454.CMB.2.raw
  modified_base (503)..(503): a, c, t, g, unknown or other
  misc_feature (503)..(503): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttgggtccagcctgggcggtctctgagactgtcctgtgaacccctctggggtctccgtcagcagcgactgtattgcctgggtccgccaggctcccaggggaagaggccgggagtggggtcgcgaggtatttttagtagggtggggacgacattctacggagcctccaatggaggccgattcaccatctaccagacgtactttctcagaacacactgtctacttcaaatgaacagcctgacgggccgaggacgacggctactattattgtgtgagtagtttanggtcgatggcgtggtaggacagactcacgtcgggg

SEQ ID NO: 320296 - DNA, 580 bp, Homo sapiens
  misc_feature: GZ8MTXP02G9CJO.19.67.G01.1.454.CMB.2.raw
  modified_base (262)..(262): a, c, t, g, unknown or other
  misc_feature (262)..(262): n is a, c, g, or t
  modified_base (316)..(316): a, c, t, g, unknown or other
  misc_feature (316)..(316): n is a, c, g, or t
  modified_base (429)..(429): a, c, t, g, unknown or other
  misc_feature (429)..(429): n is a, c, g, or t
  modified_base (451)..(451): a, c, t, g, unknown or other
  misc_feature (451)..(451): n is a, c, g, or t
  modified_base (499)..(499): a, c, t, g, unknown or other
  misc_feature (499)..(499): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctgggcggtctctgagactgtcctgtcgaaccctntggggtctccgtcagcagcgactgtatgcctgggtccgcaggctccgagggagnggccggagtggggtcgcgaggttatttttagagggtggaccgacagttcgtacggagacttccgagtcgggaggggcccgattccgaaccatcctccaagtacgtacttttcncgaagaacacacttgtctcttnaaaattgaaacagcctagacgggaccgaggacacggcgtctattatgngtagagtacgtttatgggacgtagtgggcttggggtaacgggactaggtagtacgaacggtcgggggacccgtaaacgggg

SEQ ID NO: 320297 - DNA, 590 bp, Homo sapiens
  misc_feature: GZ8MTXP02I6UXG.19.67.G01.1.454.CMB.2.raw
  modified_base (316)..(316): a, c, t, g, unknown or other
  misc_feature (316)..(316): n is a, c, g, or t
  modified_base (425)..(425): a, c, t, g, unknown or other
  misc_feature (425)..(425): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtcgaaccctcgtggggtctcgtcagcagcgactgtatgcctgggtccgcaggctccgagggaagnggccggaggtgggtcgcgtagggttatttttagagggtgggaccgactagttcgtaacgggagtactccagtgggagggccgattccacatcctccagagtacttttcncagaacacactgtctcttcaaattgaaacagtccgtgacggggccaggacacgggctctattattggtgtagtagtagtttagtcgggtacgtagtgggtcgttagggggtcggtaaccgaagggtacttaccggaacggttcgggggaacccgtaaaccggggg

SEQ ID NO: 320298 - DNA, 532 bp, Homo sapiens
  misc_feature: GZ8MTXP02GXEAQ.19.67.G01.1.454.CMB.2.raw
  modified_base (237)..(237): a, c, t, g, unknown or other
  misc_feature (237)..(237): n is a, c, g, or t
  modified_base (419)..(419): a, c, t, g, unknown or other
  misc_feature (419)..(419): n is a, c, g, or t
  modified_base (422)..(422): a, c, t, g, unknown or other
  misc_feature (422)..(422): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacatttcnccacctccaagaacaaaacttctagcctggtaccaacagagaccaggacagcctcctaaagttcgctctatttactgggtctttcgtacgcgcgtaagttcggggtccctgaccccgagttccggggcaggcgggtctgggcagtatttcactctcaccatcagcagcctgcagctgaaagntgnggactagtttatactgtcagtctaatttcttttctatcctcgtgtacgttcggacaagggccagggtagaaactcgacgacgaacgtgtcggctcgccaccatcgttacg

SEQ ID NO: 320299 - DNA, 541 bp, Homo sapiens
  misc_feature: GZ8MTXP02HTZNR.19.67.G01.1.454.CMB.2.raw
  modified_base (395)..(395): a, c, t, g, unknown or other
  misc_feature (395)..(395): n is a, c, g, or t
  modified_base (409)..(409): a, c, t, g, unknown or other
  misc_feature (409)..(409): n is a, c, g, or t
  modified_base (492)..(492): a, c, t, g, unknown or other
  misc_feature (492)..(492): n is a, c, g, or t
tcagtactctcgtgcacgaccggtgctcgatttagagtatacatattgggtttgggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaacccctctggggtctccgtcagcagcgactgtattgcctgggtccgccaggctccaggggaagaggccggagtggggtcgcgaggtatttttataggtgggaccgacattctacggagactcatgggaggccattcacatcnccagagacttttcncagaacacactgtactcttacaaatgaaacagcctagacgggccgaggacacggccgtactattattgtagtgagtagtttanggtacgagtggctgggtggacaggatcgaacgtcgggggcctaacgggg

SEQ ID NO: 320300 - DNA, 580 bp, Homo sapiens
  misc_feature: GZ8MTXP02HQTM9.19.67.G01.1.454.CMB.2.raw
  modified_base (246)..(246): a, c, t, g, unknown or other
  misc_feature (246)..(246): n is a, c, g, or t
  modified_base (299)..(299): a, c, t, g, unknown or other
  misc_feature (299)..(299): n is a, c, g, or t
  modified_base (321)..(321): a, c, t, g, unknown or other
  misc_feature (321)..(321): n is a, c, g, or t
  modified_base (554)..(554): a, c, t, g, unknown or other
  misc_feature (554)..(554): n is a, c, g, or t
  modified_base (578)..(580): a, c, t, g, unknown or other
  misc_feature (578)..(580): n is a, c, g, or t
tcagtactctcgtgcacgaccggtgctcgatttagagtatacatattgggcttggtccagcctgggcggtctctgagactgtcctgtgaaccctctggggtctccgtcagcagcgactgtattgcctgggtccgccaggctccagggaagaggccggagtgggtcgcaggttatttttataggtgggacgacatttctacggagactccatggaggccgattcaccatctccagagtactttttcncagaacacactgtctcttcaaatgaacagcctgagggccaggacacggccgtntatttatgtgtgagtagtttanggcgatgggctgggtgacagatcgacgtggggccaggggaccctggtcccacgtctcctcacgccctaccaaccgaagggccccagtccggtcccttcccccgtggcccgccctgcctccgacggacgccacctccggagacgcacgacggccgggccccgtggggcctcggccgtgggtaccaacggtacctaaccgttcccgaacgtagacgttacgcggacggcgggcgngggaacgaacggcgacgagtacgnnn

SEQ ID NO: 320301 - DNA, 610 bp, Homo sapiens
  misc_feature: GZ8MTXP02JXCV0.19.67.G01.1.454.CMB.2.raw
  modified_base (246)..(246): a, c, t, g, unknown or other
  misc_feature (246)..(246): n is a, c, g, or t
  modified_base (302)..(302): a, c, t, g, unknown or other
  misc_feature (302)..(302): n is a, c, g, or t
tcagtactctcgtgcacgaccggtgctcgatttagagtatacatattgggcttggtccagcctgggcggtctctgagactgtcctgtgaaccctctggggtctccgtcagcagcgactgtattgcctgggtccgccaggctccagagaagaggccggagtgggtcgcaggtatttttataggtgggacgacattctacggagactccatggagggccgattcaccatcctccagagtactttttcncagaacacactgtctcttacaaatgaacagcctgagggcccgaggacacggccgtntattattgtgtgagtagtttatggcgatggctgggtggacaggatcccgacgtggggcccaggggacccctgggtcacccggtctccgtcacgccctccgaaccgaaacggggccccagttcccggtcccttcccccgtggcccgcccctgcctaccgaggacgccaccgtccgagacgcacgcggccggcccgtggggctacggcctgggtacaacgggaccttaccgttcccgaacgacggtacggtaacctgggacggccggggtcctaaggggaccaaacgggggccaccgtaacgtacgcgcg

SEQ ID NO: 320302 - DNA, 566 bp, Homo sapiens
  misc_feature: GZ8MTXP02IKYQW.19.67.G01.1.454.CMB.2.raw
  modified_base (512)..(512): a, c, t, g, unknown or other
  misc_feature (512)..(512): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctcgtgggtctccgtcagcagcgactgtattgcctggtccgccgaggctccgagggaagaggccggagtgggtcgcgaggttatttttagagggtgggaccgacgattctaacgggagactccagtgggagggcccgtagttccaccatcctcccagagtactttctacaagaacacactgtactcttacaaatgaaatagccttaggacgggaccgaggaaccacggccgtctaattatgtgtgagtagtttanggtacgagtcggcgtgggtggacgagtatacgaccggtcggggaccgaacgggg

SEQ ID NO: 320303 - DNA, 566 bp, Homo sapiens
  misc_feature: GZ8MTXP02IHH8R.19.67.G01.1.454.CMB.2.raw
  modified_base (261)..(261): a, c, t, g, unknown or other
  misc_feature (261)..(261): n is a, c, g, or t
  modified_base (300)..(300): a, c, t, g, unknown or other
  misc_feature (300)..(300): n is a, c, g, or t
  modified_base (318)..(318): a, c, t, g, unknown or other
  misc_feature (318)..(318): n is a, c, g, or t
  modified_base (416)..(416): a, c, t, g, unknown or other
  misc_feature (416)..(416): n is a, c, g, or t
  modified_base (509)..(509): a, c, t, g, unknown or other
  misc_feature (509)..(509): n is a, c, g, or t
  modified_base (530)..(530): a, c, t, g, unknown or other
  misc_feature (530)..(530): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctgggcggtctctgagactgtcctgtgaaccctntggggtctccgtcagcagcgactgtattgcctgggtccnccaggctccaggggaagnggccggagtgggtcgcagggttatttttagaggtggggaccgactattcgtacggagactccagtgggagggccgattccacatctccagctactttnacagacacactgtctactcaaatcgaaacagccctggacggggccgaggaccacggccgtactagtttagttggtgtcggagtagttttacgngggacgtagtcgggcttgggnggacaggactcgacggtcgggggacctaaccggggg

SEQ ID NO: 320304 - DNA, 567 bp, Homo sapiens
  misc_feature: GZ8MTXP02F1ARQ.19.67.G01.1.454.CMB.2.raw
  modified_base (521)..(521): a, c, t, g, unknown or other
  misc_feature (521)..(521): n is a, c, g, or t
  modified_base (534)..(534): a, c, t, g, unknown or other
  misc_feature (534)..(534): n is a, c, g, or t
  modified_base (538)..(538): a, c, t, g, unknown or other
  misc_feature (538)..(538): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctcgtggggtctccgtcagcagcgactgtattgcctgggtcccgccagggctccgaggggaagaggcccggagtggggtcgcgtagggttattttagtagggtggggaccgacattctacggagacctcagtgggagggccgattccaccatctcccagtacgtacttttctcaagtaaccacactgtctcttacaaatgaaacagcctggaacgggccgacggacgacggccgtactacgttattgtgtagtagtagtttagnggtacgagtcggntggngtacagactcgacgtcggggactaacggg

SEQ ID NO: 320305 - DNA, 596 bp, Homo sapiens
  misc_feature: GZ8MTXP02JYQOM.19.67.G01.1.454.CMB.2.raw
  modified_base (389)..(389): a, c, t, g, unknown or other
  misc_feature (389)..(389): n is a, c, g, or t
  modified_base (396)..(396): a, c, t, g, unknown or other
  misc_feature (396)..(396): n is a, c, g, or t
  modified_base (465)..(465): a, c, t, g, unknown or other
  misc_feature (465)..(465): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctggggcgtctctgagactgtcctgtcgaaccctcgtggggtctccgtcagcagcgactgtattcgccgtcgggtccgccaggcctccgaggggaagacgggccgggaggtggggtcgcgtaggttatttttaggagggtggaccgactagttcgtacggganacctcgngtgggagggccattccaccatctccagagtaccttttcacaagaacacacttgtctctacaaatgaacngcctggacgggccgaggaccgacgggccttactatttagttgtgttcggaagttaggttagtcgggacgagtcggggtcgttggggtaaggacgaggtactccggacggtcgggggacccgaaaccggggg

SEQ ID NO: 320306 - DNA, 572 bp, Homo sapiens
  misc_feature: GZ8MTXP02G015B.19.67.G01.1.454.CMB.2.raw
  modified_base (393)..(393): a, c, t, g, unknown or other
  misc_feature (393)..(393): n is a, c, g, or t
  modified_base (433)..(433): a, c, t, g, unknown or other
  misc_feature (433)..(433): n is a, c, g, or t
  modified_base (462)..(462): a, c, t, g, unknown or other
  misc_feature (462)..(462): n is a, c, g, or t
  modified_base (515)..(515): a, c, t, g, unknown or other
  misc_feature (515)..(515): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtgggcggaggcttggtccaggcccgtggggcggtctctgagactgtcctgtcgaaccctcgtggggtctccgtcagcagcgactgtatgcctgggtccgccaggctccgaggggaagagggccggaggtggggtcgcgtaggttatttttagagggttgggaccgacagttcacgggagactcngtgggagggccgattcaccatcctaccagtacgtctttcncaagaacacactgtctctacaaatgaacngcgtaggacggggaccgaggacacgggctctattagtgtgtgagtagtttagnggtacgagtggcgtggtaacggagagtactcgacggtcgggggacctaaaccggggg

SEQ ID NO: 320307 - DNA, 616 bp, Homo sapiens
  misc_feature: GZ8MTXP02G0R6O.19.67.G01.1.454.CMB.2.raw
  modified_base (558)..(558): a, c, t, g, unknown or other
  misc_feature (558)..(558): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtgggcggaggcttggtccagccgtgggcggtctctgagactgtcctgtcgaccctgtggggtctccgtcagcaggcgactgtatcgccgtgggtcccgccaggcctaccgaaggggaacgaacggccgggaggtcggggtcgacgtagggttaatttttagagggtggaccgtactagttacgtacggagacctcagtcgggacgggccgattccgaccatcctaccgagtacgttacttttcgacaagaacacgtactgtacctactacaaatcgaaacacgccgtaggaccgggacgaacggaccgaccggtccgttattagttagttgtagtagtagtagtttacggnggtacgtagtcggtacgtggaagacgagtacgtacggacggtcggggaccgtaacggg

SEQ ID NO: 320308 - DNA, 539 bp, Homo sapiens
  misc_feature: GZ8MTXP02HR5RT.19.67.G01.1.454.CMB.2.raw
  modified_base (260)..(260): a, c, t, g, unknown or other
  misc_feature (260)..(260): n is a, c, g, or t
  modified_base (297)..(297): a, c, t, g, unknown or other
  misc_feature (297)..(297): n is a, c, g, or t
  modified_base (328)..(328): a, c, t, g, unknown or other
  misc_feature (328)..(328): n is a, c, g, or t
  modified_base (341)..(341): a, c, t, g, unknown or other
  misc_feature (341)..(341): n is a, c, g, or t
  modified_base (367)..(367): a, c, t, g, unknown or other
  misc_feature (367)..(367): n is a, c, g, or t
  modified_base (414)..(414): a, c, t, g, unknown or other
  misc_feature (414)..(414): n is a, c, g, or t
  modified_base (506)..(506): a, c, t, g, unknown or other
  misc_feature (506)..(506): n is a, c, g, or t
  modified_base (508)..(508): a, c, t, g, unknown or other
  misc_feature (508)..(508): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagtttggctgacctgggtttcctgctgcaatttcaggaggtgtccagtgtgaggtgcaactggtggagactgggcggaggcttggccagcctggggcgtctctgagactggtcctgtgaacccctgnggggtctccgcagcagcgactgtattgcctgggtccnccaggctccagggagaggccggagtgggtcncaggtatttttanagggtgggaccacatttcaacggganactcgagtggaggcgactacacactctacacgagtacttactacaanaacaacactgtctactactaaatagaacacgacgacggacgggacggacggacgacgcgtactattattgtgtgtagtagttagtgacgagngngtgtgacgagacgacgacgacggacggacgg

SEQ ID NO: 320309 - DNA, 601 bp, Homo sapiens
  misc_feature: GZ8MTXP02FI5CE.19.67.G01.1.454.CMB.2.raw
  modified_base (298)..(298): a, c, t, g, unknown or other
  misc_feature (298)..(298): n is a, c, g, or t
  modified_base (424)..(424): a, c, t, g, unknown or other
  misc_feature (424)..(424): n is a, c, g, or t
  modified_base (454)..(454): a, c, t, g, unknown or other
  misc_feature (454)..(454): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctgtgggtctccgtcagcagcgactgtattgcctgggtccncaggcctccgagggaagaggccggaggtgggcgcgtaggttattttagtagggtgggaccgtactattcgtaacggagactccagtgggagggccgattcacctatcctccagtacgtacttttcnaagaacacactgtctactacaaatgaaacncgccgtaggacggggccgaacggacgaccgggtccgtactagtttaagttgttagtggtaagttagtttaacgtgggacgtacgttggggcgttggggtaaggactaaggtactaccgtaacggtcgggggacccgtaaaccggggg

SEQ ID NO: 320310 - DNA, 558 bp, Homo sapiens
  misc_feature: GZ8MTXP02GB0TD.19.67.G01.1.454.CMB.2.raw
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtatgcctggtccgccaggctccgagggaagaggccggagtgggtcgcgtaggtattttagagggtgggaccgactattcgtacggagacttccgagtgggacgggccgattccacatctccagtagtacttttcacagaaacacactgtctacttacaaaatgaaacagcctaggacgggccgaggacgacggccgtctattagtgtgtagtagtagtttagtggcgagtcggcgtgggtggaacagactcgacggtcgggggacctaacgggg

SEQ ID NO: 320311 - DNA, 599 bp, Homo sapiens
  misc_feature: GZ8MTXP02IGIQI.19.67.G01.1.454.CMB.2.raw
  modified_base (291)..(291): a, c, t, g, unknown or other
  misc_feature (291)..(291): n is a, c, g, or t
  modified_base (308)..(308): a, c, t, g, unknown or other
  misc_feature (308)..(308): n is a, c, g, or t
  modified_base (454)..(454): a, c, t, g, unknown or other
  misc_feature (454)..(454): n is a, c, g, or t
tcagtactctcgtgcacgaccggtgctcgatttagagtatacatattgggtttgggggagaggagcccagcactgggattccgaggtgtttccattcggtgctcagcactgaacacagaggactcaccatggagttttggctgacctgggtttcctgctgcaatttcaggaggtgtccagtgtgaggtgcaactggtggagactgggcgaggcttggccagcctgggcgtctctgagactgtcctgtgaaccctgtgggtctcgtcagcagcgactgtatgcctgggtccncaggctccgagggaagnggccggagtgggtcgcgaggttatttttagaggtggggacccgtacagttcgtacgggagtacctccagtgggaagggccgattccaccatctccagagtactttctacaagaacactactgtctacttacaaaacttgaaaaccncgtaccgtaggacgggaccgacggacgacggtccgttacgttattagttgtaggtaggtaggttaggtttagcgggtacggtagtcgggtcgtaggggtaacggaacgtaggtacgtaccgacgggtcgggggacccgaacgggg

SEQ ID NO: 320312 - DNA, 521 bp, Homo sapiens
  misc_feature: GZ8MTXP02JNM74.19.67.G01.1.454.CMB.2.raw
  modified_base (237)..(237): a, c, t, g, unknown or other
  misc_feature (237)..(237): n is a, c, g, or t
  modified_base (274)..(274): a, c, t, g, unknown or other
  misc_feature (274)..(274): n is a, c, g, or t
  modified_base (305)..(305): a, c, t, g, unknown or other
  misc_feature (305)..(305): n is a, c, g, or t
  modified_base (407)..(407): a, c, t, g, unknown or other
  misc_feature (407)..(407): n is a, c, g, or t
  modified_base (437)..(437): a, c, t, g, unknown or other
  misc_feature (437)..(437): n is a, c, g, or t
  modified_base (479)..(479): a, c, t, g, unknown or other
  misc_feature (479)..(479): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagactatttcnccactcaagaacaaaacttctagctgtaccaacaganaccaggacagcctactaagtgctcatttacngggtcttctacgcgcgtaattcggggtccctggaccccgagttccggggcaggcgggtctgggcagtatttcactctcacatcagcagcctgcagctgaagntgtgatagtttatactgtcagtataatttntttctactccgtcgtagtcgtcggacgtaagggacagggtanaaactcgaacgacgacgtgtcgacgtcgacctactactctcg

SEQ ID NO: 320313 - DNA, 560 bp, Homo sapiens
  misc_feature: GZ8MTXP02HT0PV.19.67.G01.1.454.CMB.2.raw
  modified_base (307)..(307): a, c, t, g, unknown or other
  misc_feature (307)..(307): n is a, c, g, or t
  modified_base (444)..(444): a, c, t, g, unknown or other
  misc_feature (444)..(444): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgaccttgggttttccttgctgcaatttcaggaggtgtccagtgtgaggtgcaactggtggagacgtgggcggaggcttgggtccaggccgtgggcggtctctgagactgtcctgtcgaaccctgtggggtctccgtcagcagcgactgtattcgcctgggtccncaggctccgaggggaagaggccggagtgggtcgctaggttatttttagacggtggaccgactagttcgacggagactaccgagtgggaacggccgtacttaccaccattcaccagtagtactttctcagacacactntctactacaaatgacacgacgtagacggacgacgacgacgacgtcgtattatagtgtgtagtagtagtgacgagtgtgtggtggacgacgagtacgtacgtacggacggaaccggg

SEQ ID NO: 320314 - DNA, 540 bp, Homo sapiens
  misc_feature: GZ8MTXP02IG14R.19.67.G01.1.454.CMB.2.raw
  modified_base (258)..(258): a, c, t, g, unknown or other
  misc_feature (258)..(258): n is a, c, g, or t
  modified_base (341)..(341): a, c, t, g, unknown or other
  misc_feature (341)..(341): n is a, c, g, or t
  modified_base (500)..(500): a, c, t, g, unknown or other
  misc_feature (500)..(500): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcgtctctgagactgtcctgtgaccctntgggtctccgtcagcagcgactgtatgcctggtccgcaggctccaggggaagaggccggagtggggtcgcgaggtatttttanaggtgggaccgacagttctacggagactccagtgggaggggccgattccacatctccagagtactttctcagaacacactgtctctcaaatgaacagcctgagggccgaggacgacggcgtactattatgtgtagagtagtttagtggcgtagtcggtntgggtggacaggactacgacggtcgggggacccaacgggg

SEQ ID NO: 320315 - DNA, 555 bp, Homo sapiens
  misc_feature: GZ8MTXP02GI3WS.19.67.G01.1.454.CMB.2.raw
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctgggcggtctctgagactgtcctgtgaaccctctggggtctccgtcagcagcgactgtatgccgtgggtccgccaggctccgaggggaagaggcccgggagtggggtcgcgtaggttatttttagagggtgggacgacattcacggagcctccagtgggaggccgattccaccatctacccagtacgtacttttcactagaacactactcgtctacttacaaattcgaaacagccgtaggacggccgaggacgacggcgtactagttattgtgtgagtagtttagcggcgagtggcgtggtggacagactcgacggtacgggg

SEQ ID NO: 320316 - DNA, 574 bp, Homo sapiens
  misc_feature: GZ8MTXP02GS4GN.19.67.G01.1.454.CMB.2.raw
  modified_base (472)..(472): a, c, t, g, unknown or other
  misc_feature (472)..(472): n is a, c, g, or t
  modified_base (528)..(528): a, c, t, g, unknown or other
  misc_feature (528)..(528): n is a, c, g, or t
  modified_base (539)..(539): a, c, t, g, unknown or other
  misc_feature (539)..(539): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtcgaaccctcgtggggtctccgtcagcagcgactgtattgcctgggtccgccaggcctccgaggggaagaggccgggaggtgggtcgcgtaggttatttttagagggtgggaccgactattcgtacggagaccttccgagtgggacgggccgtattccacctatcctacccagtacgtacttttcacaagaacactactgtcctacttacaaatcgaaacngcctaggacgggccgaggaccgacggccgtactattagtgtgtagagtagtttagnggcgagtcggntgggtgacgagatcgacgtcggggacctaacgggg

SEQ ID NO: 320317 - DNA, 595 bp, Homo sapiens
  misc_feature: GZ8MTXP02GDMKB.19.67.G01.1.454.CMB.2.raw
  modified_base (385)..(385): a, c, t, g, unknown or other
  misc_feature (385)..(385): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcactatggagttttggctgacctgggttttcctgctgcaatttcaggaggtgtccagtgtgaggtgcaactggtggagactgggcggaggcttggtccagccgtggggcggtctctgagactgtcctgtcgaccctcgtggggtctccgtcagcagcgactgtatgcctggtccgccaggctccgagggaagaggccggaggtgggtcgcgtaggttatttttagagggtgggaccgactattctacggagaccttccngtgggacgggccgagttccaccatcctacccagtacgtaccttttcacaagtaaccacgtactcgttactcttacaaatacgaaacacggtcctaggacggggccgaacggacgtaccggccgttactattagttgtgtaggagtagtttagtggcgtacgtggtcgtgggtggacgaggtactcggacgtcgggggacctaaccggggg

SEQ ID NO: 320318 - DNA, 600 bp, Homo sapiens
  misc_feature: GZ8MTXP02FV5UF.19.67.G01.1.454.CMB.2.raw
  modified_base (300)..(300): a, c, t, g, unknown or other
  misc_feature (300)..(300): n is a, c, g, or t
  modified_base (553)..(553): a, c, t, g, unknown or other
  misc_feature (553)..(553): n is a, c, g, or t
  modified_base (562)..(562): a, c, t, g, unknown or other
  misc_feature (562)..(562): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagccgtgggcggtctctgagactgtcctgtcgaccctcgtggggtctccgtcagcagcgactgtatgcctgggtccncaggctccgagggagagggccggagtgggtcgcgtaggttattttagaggtggacgactattcgtacggagactcgagtgggaggggccgtattccgaccctatcctaccagtacgtacttttcactaacgaacactactgtcctacttacaaattacgaaactacgccgtggaacggggccgaacggaccgacgggccttacgttagttagttgtaggtacggagttaggtttagtgggtacgtagtcgggngttaggggngaacgagtactacgtacggcggggaccgtaaccggggg

SEQ ID NO: 320319 - DNA, 613 bp, Homo sapiens
  misc_feature: GZ8MTXP02GO545.19.67.G01.1.454.CMB.2.raw
  modified_base (383)..(383): a, c, t, g, unknown or other
  misc_feature (383)..(383): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttgggtccagcctggggcggtctctgagactgtcctgtgaaccctcgtggggtctccgtcagcagcgactgtattgcctgggtccgccaggctccgaggggaagagggccggaggtggggtcgcgtaggttatttttagagggtgggaccgacagttctacggganactcgagtcgggagggcccgtattccaacctatcctaccgagtacgtaccttttctacaagaaccactactcgttactacttacaaaattgaaacagcctaggacggggaccgaaggaccgaccgggtccgtacgttattagttgtagtagtacggttagtttacgtcgggacgtagtcgggtcgttgggtaagacgagtacgtcgtacggtcgggggacctaaccgggg

SEQ ID NO: 320320 - DNA, 537 bp, Homo sapiens
  misc_feature: GZ8MTXP02IR7S7.19.67.G01.1.454.CMB.2.raw
  modified_base (260)..(260): a, c, t, g, unknown or other
  misc_feature (260)..(260): n is a, c, g, or t
  modified_base (413)..(413): a, c, t, g, unknown or other
  misc_feature (413)..(413): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttcctgctgcaatttcaggaggtgtccagtgtgaggtgcaactgggtggagactgggcggaggcttggtccagcctggggcgtctctgagactgtcctgtgaccctntggggtctccgtcagcagcgactgtattgcctgggtccgcaggctccgagggaagaggccggagtggggtcgcagggttatttttagaggtgggaccgacattctacggagactccagtggagggccgattcaccatctccagagtactttcncagaacacactgtctcttcaaaattgaacagactgagggacgacggacgacggcgtctattatgtgtgagtagttagtggcgagtggtgtggtggacgagatacgacgtcgggacgaaccgggg

SEQ ID NO: 320321 - DNA, 565 bp, Homo sapiens
  misc_feature: GZ8MTXP02JA9AQ.19.67.G01.1.454.CMB.2.raw
  modified_base (461)..(461): a, c, t, g, unknown or other
  misc_feature (461)..(461): n is a, c, g, or t
  modified_base (514)..(514): a, c, t, g, unknown or other
  misc_feature (514)..(514): n is a, c, g, or t
  modified_base (528)..(528): a, c, t, g, unknown or other
  misc_feature (528)..(528): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttcctgctgcaatttcaggaggtgtccagtgtgaggtgcaactggtggagactggcggaggcttggtccagcctgggcgtctctgagactgtcctgtcgaccctctggggtctccgtcagcagcgactgtattgcctgggtccgccaggctccgaggggaagagggccggaggtgggtcgcgtaggttatttttagaggtgggaccgactattcgtacggagaccttccgagtgggacgggccgaattcgacctatcctaccagtagtactttctacagtaacacactgtctcttacaaattgaaacngcctaggacgggaccgaggacacgggcgtactagttatgtgtgagtagtttangggacgtatcgggntgggtgactagactcgacggtacggggcctaacgggg

SEQ ID NO: 320322 - DNA, 622 bp, Homo sapiens
  misc_feature: GZ8MTXP02I9QXH.19.67.G01.1.454.CMB.2.raw
  modified_base (303)..(303): a, c, t, g, unknown or other
  misc_feature (303)..(303): n is a, c, g, or t
  modified_base (322)..(322): a, c, t, g, unknown or other
  misc_feature (322)..(322): n is a, c, g, or t
  modified_base (340)..(340): a, c, t, g, unknown or other
  misc_feature (340)..(340): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttcctgctgcaatttcaggaggtgtccagtgtgaggtgcaacgtggtggagactgggcggaggcttggtccagccgtgggcgtctcgtgagactgtcctgtcgaccttcgtgggtctcgtcagcagcgactgtatcgccgtggccncgaggctaccgagggaagnggccgggagtcgggtcgngtaggttagttttagaggggtaggacgtatacgttcgacggagccgtccgagtgggacgggccgtagttcaacctatcctaccagtacgttactttcacgtaacgactacctaacgttcgtaccttacttaaccaaagttacgaaccgtacgaccgttagggacggggaccggaacgggaaccgtacgggtacccgttacgttattaagttcggtggttaggtacggttagttagtcggtaacgtgtcggtgtgggtagacaggactcggtacggtccgggg

SEQ ID NO: 320323 - DNA, 580 bp, Homo sapiens
  misc_feature: GZ8MTXP02GBX9E.19.67.G01.1.454.CMB.2.raw
  modified_base (320)..(320): a, c, t, g, unknown or other
  misc_feature (320)..(320): n is a, c, g, or t
  modified_base (463)..(463): a, c, t, g, unknown or other
  misc_feature (463)..(463): n is a, c, g, or t
  modified_base (521)..(521): a, c, t, g, unknown or other
  misc_feature (521)..(521): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctggggcggtctctgagactgtcctgtcgaaccctcgtggggtctccgtcagcagcgactgtatgcctggtccgccaggctccgaggggaagnggccggaggtgggtcgcgtaggttattttagagggtgggaccgactattcgtacggagactccgagtcgggacgggccgattccacctatctaccgagtacgtactttcacacgaacactactgtctactacaaatcgaaacncgactaggacgggccgaggacgacggtccgtactattagtgtgtagagttagtttagnggtcgagtacggtcgtaggggtgacgagtactcgacggtcgggggacccgtaaccgggg

SEQ ID NO: 320324 - DNA, 561 bp, Homo sapiens
  misc_feature: GZ8MTXP02GJFAF.19.67.G01.1.454.CMB.2.raw
  modified_base (455)..(455): a, c, t, g, unknown or other
  misc_feature (455)..(455): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttgggtccagcctgggcggtctctgagactgtcctgtgaccctctggggtctccgtcagcagcgactgtattgcctgggtccgccaggctccgaggggaagacggcccgggagtgggtcgcgaggtatttttagaggtgggacgacattctacggagctccagtgggaggccgattcgacatctccagacgtactttctcacgaacactactagtctacttacaaattgaaacncgacctagacggccgaggacacggccgtcgtattattaggtgtaggtagtagtttagtcggacgtagtgggtcgtgggtagacgagtacgtacgaacggtcggggg

SEQ ID NO: 320325 - DNA, 549 bp, Homo sapiens
  misc_feature: GZ8MTXP02GHPS3.19.67.G01.1.454.CMB.2.raw
  modified_base (369)..(369): a, c, t, g, unknown or other
  misc_feature (369)..(369): n is a, c, g, or t
  modified_base (504)..(504): a, c, t, g, unknown or other
  misc_feature (504)..(504): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctggggcggtctctgagactgtcctgtcgaaccctgtggggtctccgtcagcagcgactgtattgcctggtccgcaggctccgagggaagaggccggagtgggtcgcgtaggttattttagaggtggacgacattcacgganactcagtgggaggccgattcaacatctcagtacgtactttcacaagaacacactgtctacttacaaaatcgaaacagccgtaggacgggccgaacggacgacggccgtactagttagtgtagtgagtagtttagnggacgtagtggcgtgggtaagacagactcacgtcggacgacccgg

SEQ ID NO: 320326 - DNA, 565 bp, Homo sapiens
  misc_feature: GZ8MTXP02ICX1J.19.67.G01.1.454.CMB.2.raw
  modified_base (374)..(374): a, c, t, g, unknown or other
  misc_feature (374)..(374): n is a, c, g, or t
  modified_base (419)..(419): a, c, t, g, unknown or other
  misc_feature (419)..(419): n is a, c, g, or t
  modified_base (438)..(438): a, c, t, g, unknown or other
  misc_feature (438)..(438): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtggcggaggcttggtccagccgtgggcggtctctgagactgtcctgtcgaaccctgtgggtctccgtcagcagcgactgtatgcctggtccgccaggctccgagggagaggccggagtgggtcgcgtaggttatttttagagggtgggaccgacattcgtacggganactccagtcgggaggccgattccgctatcctccagagtactttcncaagacacactgtctctanaaatgaacagccgtagacgggaccgacggacacggccgtacttattagtgtgtagagtagtttacgtgggacgtagtcgggtctgggtaaggacagtacgtcgtacggtcggggacctaaccggggg

SEQ ID NO: 320327 - DNA, 564 bp, Homo sapiens
  misc_feature: GZ8MTXP02IIL24.19.67.G01.1.454.CMB.2.raw
  modified_base (261)..(261): a, c, t, g, unknown or other
  misc_feature (261)..(261): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagccgtgggcggtctctgagactgtcctgtgaaccctntggggtctccgtcagcagcgactgtatgcctgggtccgccaggctccgaggggaagaggccggattggggtcgctaggttattttagaggtggaccgacattctacggagacctccagtgggagggcccgtattaccgaccatcctaccagagtactttcacagaacacactgtctacttacaaatcgaacagccgtgagggaccgaggacgacggcgtctattatgtgtgagtagtttagtgggacgtagtcggtcgtgggtaaggacagacgtacgacggtacggggaccgtaaccggggg

SEQ ID NO: 320328 - DNA, 673 bp, Homo sapiens
  misc_feature: GZ8MTXP02GQJBQ.19.67.G01.1.454.CMB.2.raw
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaccctcgtgggtctccgtcagcagcgactgtattgccgtgggtccgccagggcctccgaaggggaagagtcggccggagtggggtcgcgtaggttatttttagtagggtggggaacgactagttcgtacgggagaacctccgaagttggggaacggggccctaatttcccgaacctaattcctacccgaaggtacgttaactttttcacaagaaaccactaacttgtaccttacttaacaaaacttacgaaactacgacccgttagggaacggggacccggaagggaccgtaccgggtcccgttacttaagtttaagttggtaggtagtaaggttacggtttttaaggcgggtacgtagtcgggtacggttaaggggtacggaacgtacggtacgtaccggtaccgggtacgggggaccg

SEQ ID NO: 320329 - DNA, 570 bp, Homo sapiens
  misc_feature: GZ8MTXP02FLTK6.19.67.G01.1.454.CMB.2.raw
  modified_base (518)..(518): a, c, t, g, unknown or other
  misc_feature (518)..(518): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagccgtgggcggtctctgagactgtcctgtcgaaccctcgtggggtctccgtcagcagcgactgtatgcctgggtccgccaggctccgaggggaagacggccggaggtgggtcgcgtaggtttatttttagtagggtgggacccgactattcgtacgggagacctccgagtgggacgggccgattccaccatcctaccagagttaccttttcacaagaaccacactgtctacttacaaatgaacagccgtggacgggaccgagacacggctactattatgtgtgagtagtttagnggctagtcggcgtgggtaagacaggtactcgacggtcggggaccgaacgggg

SEQ ID NO: 320330 - DNA, 539 bp, Homo sapiens
  misc_feature: GZ8MTXP02F3ARD.19.67.G01.1.454.CMB.2.raw
  modified_base (261)..(261): a, c, t, g, unknown or other
  misc_feature (261)..(261): n is a, c, g, or t
  modified_base (374)..(374): a, c, t, g, unknown or other
  misc_feature (374)..(374): n is a, c, g, or t
  modified_base (418)..(418): a, c, t, g, unknown or other
  misc_feature (418)..(418): n is a, c, g, or t
  modified_base (474)..(474): a, c, t, g, unknown or other
  misc_feature (474)..(474): n is a, c, g, or t
  modified_base (482)..(482): a, c, t, g, unknown or other
  misc_feature (482)..(482): n is a, c, g, or t
  modified_base (510)..(510): a, c, t, g, unknown or other
  misc_feature (510)..(510): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctggggcggtctctgagactgtcctgtgaaccctntggggtctcgtcagcagcgactgtattgcctgggtccgcagggctccaggggaagaggccggagtggggtcgcgtaggttatttttagagggtgggaccacattcgtacgganacctccagtgggagggccgattcaccatctccagatacttttcncagaacactactgtctacttcaaatgaacagcctgaagggccaggacacggccgtntattatgngtgagtagtttactggcagtggctgggnggacaggatcgacgtcggggccaacgggg

SEQ ID NO: 320331 - DNA, 554 bp, Homo sapiens
  misc_feature: GZ8MTXP02G9CC0.19.67.G01.1.454.CMB.2.raw
  modified_base (422)..(422): a, c, t, g, unknown or other
  misc_feature (422)..(422): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagccgtgggcggtctctgagactgtcctgtcgaaccctctggggtctccgtcagcagcgactgtattgcctggtccgccaggctccgaggggaagaggccgggagtggggtcgcgaggttatttttagtagggttggggaccgacattctacggagactccagtgggaggccgattccacatctccagagtactttcncagaacacactgtctctcaaatgaaacagcctggagggccgacggacgacggccgtctattattagtgttagagtagtttagtggcgtatggcgtagggtggacagactcgacgtcggggacgtaaccgggg

SEQ ID NO: 320332 - DNA, 606 bp, Homo sapiens
  misc_feature: GZ8MTXP02JBST2.19.67.G01.1.454.CMB.2.raw
  modified_base (434)..(434): a, c, t, g, unknown or other
  misc_feature (434)..(434): n is a, c, g, or t
  modified_base (540)..(540): a, c, t, g, unknown or other
  misc_feature (540)..(540): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctgggcggtctctgagactgtcctgtgaaccctcgtggggtctccgtcagcagcgactgtattgcctgggtccgcaggctccgaggggaagaggccggaggtggggtcgcgtaggttatttttagagggtgggaccgactattcgtacggagaccttccagtgggacggggccgtagttccaccatcctccgagtacgtacttttcncaagaaacaccacttgtactactttacgaaaattgaaacacgccctagggacggggacccgagggaccgacggccgttactagtttagtgtgtagagtagtttagngggacgtagtcgggcgttagggtaaggtacgaagtactacgacggtcgggggacccgtaaacgggg

SEQ ID NO: 320333 - DNA, 629 bp, Homo sapiens
  misc_feature: GZ8MTXP02JSYFR.19.67.G01.1.454.CMB.2.raw
  modified_base (299)..(299): a, c, t, g, unknown or other
  misc_feature (299)..(299): n is a, c, g, or t
  modified_base (317)..(317): a, c, t, g, unknown or other
  misc_feature (317)..(317): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctggggcggtctctgagactgtcctgtcgaccctcgtggggtctccgtcagcagcgactgtatgcctggccncgaggctccgagggaagnggccggaggtcgggtcgcgtaggttatttttagagggtgggaccgacattcgtacggagactccagtcggggagggccgtattccaccgtacttccgtaccgagtacgtacttttcgtacagaaacctacacttcgtaccttacttacaaaattcgaaactacgccgtagggacggggaccgacgggacgaccgggtccgtacttagtttacgttgtggtaggtaggttaggtttacgtgggtacgtagttcgggacgttggggtaaggacgtaggtacgtaccgacggtacgggggaccgtaacccggggg

SEQ ID NO: 320334 - DNA, 568 bp, Homo sapiens
  misc_feature: GZ8MTXP02IMKC2.19.67.G01.1.454.CMB.2.raw
  modified_base (299)..(299): a, c, t, g, unknown or other
  misc_feature (299)..(299): n is a, c, g, or t
  modified_base (418)..(418): a, c, t, g, unknown or other
  misc_feature (418)..(418): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtcgaaccctctggggtctccgtcagcagcgactgtatgcctgggtccnccaggctccaggggaagaggccggagtggggtcgcgaggtatttttagagggtgggaccgacagttctacgggagactccagtgggagggccgattccaccatctccagagacttttcncagaacacactgtctctacaaatgaacacgcctaggacgggaccgaggacacggccgtctattatgtgtgagtagtttatgggcgtagtcggacgttggggttaaggacgtaggtactacgtaccggtcgggggacccgtaaaccggggg

SEQ ID NO: 320335 - DNA, 837 bp, Homo sapiens
  misc_feature: GZ8MTXP02JTXF4.19.67.G01.1.454.CMB.2.raw
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttcctgctgcaatttcaggaggtgtccagtgtgaggtgcaacgtggtggagactgggcggaggcttggtccagccgtgggcggtctctgagactgtcctgtgaaccctcgtggggtctccgtcagcagcgactgtattgccgtggtccgccaggcctccgagggaagacggcccgggaggtgggtcgcgtaggttatttttagtaggggtgggacgactagttcgtacggagtaccgtccgaagttcggggaacggggtccgtacgtttaccaacccgtaacttcccgtaccgtaacggtaacggttaacctttttcccgttaccgaacggtaaaacccgtaacctaaacccgttcggttacctttaaccggtttacctaaaaacgtttaacgggaaaacctaaccgggtaccccggtttacggggaaacccgggggtacccggggaaaacgggggtacccggaaacccgggggttacccccggtttacccggttttaaaacggttttaacgtttttcgggggtttacgggtttagggtaaacggggtttaaacggtttttaacgggtttacgggggtacccggggtttaaacgggtttacgggggtcgggtttagggggttaacgggggacccgtaaaggtaaaccggtttccggaccggggtttaaaccccggggggg

SEQ ID NO: 320336 - DNA, 544 bp, Homo sapiens
  misc_feature: GZ8MTXP02I7C8H.19.67.G01.1.454.CMB.2.raw
  modified_base (260)..(260): a, c, t, g, unknown or other
  misc_feature (260)..(260): n is a, c, g, or t
  modified_base (496)..(496): a, c, t, g, unknown or other
  misc_feature (496)..(496): n is a, c, g, or t
  modified_base (507)..(507): a, c, t, g, unknown or other
  misc_feature (507)..(507): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctntggggtctccgtcagcagcgactgtattgcctgggtccgccaggctccgaggggaagaggccggagtgggtcgcaggttatttttagaggtgggaccgacattctaacggagactcagtgggagggccgatcacatctccagagacttttcacagaacacactgtctcttacaaatgaaacagcctggacgggaccgaggacgacggccgtctattagtgtgtgagtagtttacgnggcgatcgggngtgggaagacgagactcgacggtcggggaccgacggg

SEQ ID NO: 320337 - DNA, 578 bp, Homo sapiens
  misc_feature: GZ8MTXP02G6PHY.19.67.G01.1.454.CMB.2.raw
  modified_base (240)..(240): a, c, t, g, unknown or other
  misc_feature (240)..(240): n is a, c, g, or t
  modified_base (250)..(250): a, c, t, g, unknown or other
  misc_feature (250)..(250): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctcgtgggcgagacggccaacaatcaactgcaggtccagccagaactatttcnccactcaaanaacaaactctagctagtaccaacagagaccagacagcctacctaagttcgctactatttacgtgggtctttaccgtacgcgacgtaacgttccggggtccctggaccccgtagttcccggggcacggcgggtctgggacagtactttccactctacaccatcagcacgcctgcgacggccgaaagcgtggtggacttaagtttacttacgtgtacagtacttaaatttacttttctactcccgtacggtggtaccgttacggaccgaaacgggaccgtagggtacgaaactcgaacgacgacttggcggactcgacactatcgtcttc

SEQ ID NO: 320338 - DNA, 575 bp, Homo sapiens
  misc_feature: GZ8MTXP02GBYRK.19.67.G01.1.454.CMB.2.raw
  modified_base (300)..(300): a, c, t, g, unknown or other
  misc_feature (300)..(300): n is a, c, g, or t
  modified_base (382)..(382): a, c, t, g, unknown or other
  misc_feature (382)..(382): n is a, c, g, or t
  modified_base (421)..(421): a, c, t, g, unknown or other
  misc_feature (421)..(421): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtcgaaccctctggggtctccgtcagcagcgactgtattgcctgggtccnccaggctccaggggaagaggccggagtggggtcgcgtaggtatttttatagggtgggaccgacagttctacgggagactccngtgggagggccgattccactatcctcagagtacttttcnctagaacacactgtctacttacaaatgaaacacgccgtaggacggggccgaaggaccagtggccgtactattagttgtagttgaagtacggtttagtcggacgtagtggcgtggggtcggaacgtaggataccggacggtacggggaacccggg

SEQ ID NO: 320339 - DNA, 581 bp, Homo sapiens
  misc_feature: GZ8MTXP02F2SYC.19.67.G01.1.454.CMB.2.raw
  modified_base (300)..(300): a, c, t, g, unknown or other
  misc_feature (300)..(300): n is a, c, g, or t
  modified_base (315)..(315): a, c, t, g, unknown or other
  misc_feature (315)..(315): n is a, c, g, or t
  modified_base (329)..(329): a, c, t, g, unknown or other
  misc_feature (329)..(329): n is a, c, g, or t
  modified_base (374)..(374): a, c, t, g, unknown or other
  misc_feature (374)..(374): n is a, c, g, or t
  modified_base (500)..(500): a, c, t, g, unknown or other
  misc_feature (500)..(500): n is a, c, g, or t
  modified_base (524)..(524): a, c, t, g, unknown or other
  misc_feature (524)..(524): n is a, c, g, or t
  modified_base (539)..(539): a, c, t, g, unknown or other
  misc_feature (539)..(539): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactgggtggagactgggcggaggcttggtccagcctgggcggtctctgagactgtcctgtcgaccctcgtggggtctccgtcagcagcgactgtatgcctgggccncaggctcgagggagnggccggagtgggcncgtaggttattttagagggtgggaccgactagtttcgtaacgganaccttccagtcggggacggggtccgagttccaacctatccctaccagtacgtacttttcacaagtaacactactgtctactacaaaatcgaacacgtctggacgggccgaaggccgacggtccgtnttattagtgtagtgagttgtttangggactagtcgggtntaggggaagacgagacgtcacggtcggggacgtaaaccgggg

SEQ ID NO: 320340 - DNA, 537 bp, Homo sapiens
  misc_feature: GZ8MTXP02GZ4P3.19.67.G01.1.454.CMB.2.raw
  modified_base (410)..(410): a, c, t, g, unknown or other
  misc_feature (410)..(410): n is a, c, g, or t
  modified_base (490)..(490): a, c, t, g, unknown or other
  misc_feature (490)..(490): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtcgaaccctctggggtctccgtcagcagcgactgtattgcctgggtccgccaggctccagggaagaggccggagtgggtcgcaggtatttttagaggtggaccgacattctacggagactccagtgggaggccgattcgacatctccagagtactttcnctagaacacactgtctctacaaatgaaacagcctgacgggccgaggacacggcctcgtattagtgtgtgagtagtttagnggcgatggcgtggtggacaggactcgacgtcggggaccgtaacgggg

SEQ ID NO: 320341 - DNA, 561 bp, Homo sapiens
  misc_feature: GZ8MTXP02HD6FA.19.67.G01.1.454.CMB.2.raw
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtcgaaccctctggggtctccgtcagcagcgactgtattgcctgggtccgccaggctccgagggaagaggccggagtgggtcgcaggtatttttagagggtggaccgacattcgtacggagactccagtgggagggccgattccaccatcctccagagtactttctacagaacacactgtactcttacaaatgaaacacgtcctaggacgggccgaaggaccgacggccgtactagttattgtgtagagtagtttagtgggacgtagtcggctgggtggacaggactcgacggtcggggaccaaccggggg

SEQ ID NO: 320342 - DNA, 528 bp, Homo sapiens
  misc_feature: GZ8MTXP02FJBN4.19.67.G01.1.454.CMB.2.raw
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcgtctctgagactgtcctgtgaaccctctggggtctccgtcagcagcgactgtatgcctgggtccgccaggctccaggggaagaggcccggagtggggtcgcgaggtatttttataggtgggacgacattctacggagctccatggagggccgattcaccatctccagagacttttctcagaacacactgtctcttacaaatgaacagcctgacgggccgaggacgacggccgtctattattgtgtgagtagtttaagtgtacgagtggcgtggtgacagatcgagtcggggg

SEQ ID NO: 320343 - DNA, 553 bp, Homo sapiens
  misc_feature: GZ8MTXP02IPPKU.19.67.G01.1.454.CMB.2.raw
  modified_base (381)..(381): a, c, t, g, unknown or other
  misc_feature (381)..(381): n is a, c, g, or t
  modified_base (403)..(403): a, c, t, g, unknown or other
  misc_feature (403)..(403): n is a, c, g, or t
  modified_base (503)..(503): a, c, t, g, unknown or other
  misc_feature (503)..(503): n is a, c, g, or t
  modified_base (514)..(514): a, c, t, g, unknown or other
  misc_feature (514)..(514): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctgggcgtctatgagactgtcctgtgaaccctcgtggggtctccgtcagcagcgacttgattgcctggtccgccaggctccgaggggaagaggccggaggtgggtcgcgtaggttatttttagagggtgggaccgacgattctacggagactcntgggagggccgattcacgatcnccagagtactttcacagaacacactgtctcttacaaattgaaacagccctaggacgggccgaggacgacggccgtcgtattagtgtgtgagtagtttagnggcgagtcggngtggtggacgtagacgtcgacgtcggggccgaaccgggg

SEQ ID NO: 320344 - DNA, 553 bp, Homo sapiens
  misc_feature: GZ8MTXP02JU2RR.19.67.G01.1.454.CMB.2.raw
  modified_base (489)..(489): a, c, t, g, unknown or other
  misc_feature (489)..(489): n is a, c, g, or t
tcagtactctcgtgcacgaccggtgctcgatttagagtatacatattgggtttgggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctggtccgccaggctccgagggaagaggccggagtgggtcgcgaggtatttttagagggttgggaccgacattcgtaacggagactccagtcggggagggcccgattcaccatcctcccagagtacctttcactagaacacactgtctcttacaaaatgaacagcctggacgggccaggacacggccgtctattacgtgngtggagtgttatgggacgtagtggtctgggtaagacgagacgtcacgtcggggacgtaacgggg

SEQ ID NO: 320345 - DNA, 573 bp, Homo sapiens
  misc_feature: GZ8MTXP02HJWTK.19.67.G01.1.454.CMB.2.raw
  modified_base (219)..(219): a, c, t, g, unknown or other
  misc_feature (219)..(219): n is a, c, g, or t
  modified_base (223)..(223): a, c, t, g, unknown or other
  misc_feature (223)..(223): n is a, c, g, or t
  modified_base (250)..(250): a, c, t, g, unknown or other
  misc_feature (250)..(250): n is a, c, g, or t
  modified_base (274)..(274): a, c, t, g, unknown or other
  misc_feature (274)..(274): n is a, c, g, or t
  modified_base (315)..(315): a, c, t, g, unknown or other
  misc_feature (315)..(315): n is a, c, g, or t
  modified_base (336)..(336): a, c, t, g, unknown or other
  misc_feature (336)..(336): n is a, c, g, or t
  modified_base (350)..(350): a, c, t, g, unknown or other
  misc_feature (350)..(350): n is a, c, g, or t
  modified_base (352)..(352): a, c, t, g, unknown or other
  misc_feature (352)..(352): n is a, c, g, or t
  modified_base (366)..(366): a, c, t, g, unknown or other
  misc_feature (366)..(366): n is a, c, g, or t
  modified_base (372)..(372): a, c, t, g, unknown or other
  misc_feature (372)..(372): n is a, c, g, or t
  modified_base (377)..(377): a, c, t, g, unknown or other
  misc_feature (377)..(377): n is a, c, g, or t
tcagtactctcgtgcacgaccggtgctcgatttagagtatacatattgggtttgggggtagctcaggaagcagagcctggagcatctccactatggcctgggctccactacttctcaccctcctcgctcactgcacaggttcttgggccaactttatgctgactcagccccactctgtgtcggagtctcggggaagacggtaaccatctttgcacccanaacngtggcaacattgccagctaaattttgngcagtggtaccagcagcgccgggnacgtccccacatgtgatcatgaggataatcaaaagaccgtntggggtccctgatcggtctcncggactcatcgacncnctccacactctccncctccncaccntctctacgactagaacgtacgaggaacggacgaggtcgtacgtaactacttacgtgttacgtagtttacttagtagtacgtacggaccggcggttacgtacgttggttcggttccggtaccggggacgggaacggtaccgaacgtcgtacgtacccgtcgtaacgccgacgaccgacggccgtccgtaccccgtcg

SEQ ID NO: 320346 - DNA, 543 bp, Homo sapiens
  misc_feature: GZ8MTXP02F3O5G.19.67.G01.1.454.CMB.2.raw
  modified_base (482)..(482): a, c, t, g, unknown or other
  misc_feature (482)..(482): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctgggcggtctctgagactgtcctgtgaaccctcgtggggtctccgtcagaagcgactgtattgcctgggtccgcaggctccagggagaggccggagtgggtcgcagggttattttagaggtgggacgactattcgtacggagactccatgggaggccgattcgaccatctaccagagtactttctacagaactacactgtctcttacaaatgaacagcctggacggccgaggaccacggccgtactattattgngtgagagtttatggcgatggactggtgaacgagactcgacgtcggggacaggggtaacccg

SEQ ID NO: 320347 - DNA, 640 bp, Homo sapiens
  misc_feature: GZ8MTXP02GK5N8.19.67.G01.1.454.CMB.2.raw
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctgggcggtctctgagactgtcctgtcgaaccctcgtggggtctccgtcagcagcgactgtattgcctgggtccgccaggctccgagggaagagggccggagtggggcgcgtaggttatttttagagggtgggaccgactattcgtacggagaccttccagtgggacgggtccgattcaccatcctaccagtagtacttttctacaagtaaccacacttcgtccttacttacaaaattcgaaacacggtcctagggacggggacccgaacgggaaccgaccgggacccgttacttacgtttaattggttaggtacggtaggttaaggttttaacgtgggaccgtaagttcggggacgttggggtaagaaccgtaaggacttaccgaaccggttcgggggacccaaaccggggg

SEQ ID NO: 320348 - DNA, 590 bp, Homo sapiens
  misc_feature: GZ8MTXP02ILP37.19.67.G01.1.454.CMB.2.raw
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttcctgctgcaatttcaggaggtgtccagtgtgaggtgcaactggtggagactgggcggaggcttggccagccgtggggcgtctctgagactgtcctgtcgaaccctctggggtctccgtcagcagcgactgtattgcctgggtccgcaggctccgaggggaagaggccggaggtgggtcgcaggtttattttagagggtggggaccgacattcgtacgggagactccagttgggacggggccgtacttccggcctatcctaccgagacgtactttctacagaaacactactgtctacttacaaatgaaacagccctagggagggccgaggaccgacgggtcctctagtttatgtgtgtagtagtttagtggacgtagtgggtcgtagggtaaggacgtaggtactacgacggttcgggggacccgtaaaccggggg

SEQ ID NO: 320349 - DNA, 582 bp, Homo sapiens
  misc_feature: GZ8MTXP02FTRBI.19.67.G01.1.454.CMB.2.raw
  modified_base (300)..(300): a, c, t, g, unknown or other
  misc_feature (300)..(300): n is a, c, g, or t
  modified_base (330)..(330): a, c, t, g, unknown or other
  misc_feature (330)..(330): n is a, c, g, or t
  modified_base (526)..(526): a, c, t, g, unknown or other
  misc_feature (526)..(526): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactgggtggagactgggcggaggcttggtccagcctggggcggtctctgagactgtcctgtcgaaccctcgtggggtcctcgcagcagcgactgtatgcctggccncaggctccgagggagaggccggagtgggcncgtaggttattttagagggtggaccactagttcgtaacgggagacctccgagtgggacggggccattccaaccagtccctccaagtacgtactttcacaagaacacactgtcctacttacaaatgaaacagtcctaggacgggccgaaggaccaacgggtccgtatagttaagttgtgtacgtagttaggtttagnggacgtagtgggacttgggtaaggacagtactcgaacggtcgggggaccaacgggg

SEQ ID NO: 320350 - DNA, 557 bp, Homo sapiens
  misc_feature: GZ8MTXP02ILZR3.19.67.G01.1.454.CMB.2.raw
  modified_base (413)..(413): a, c, t, g, unknown or other
  misc_feature (413)..(413): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggccagccctggggcggtctctgagactgtcctgtcgaaccctctggggtctccgtcagcagcgactgtatgcctggtccgccaggctccgagggaagaggccggagtgggtcgcgaggttatttttagaggtgggaccgacattcaggagactcagtgggagggccgattcaccgatctccagagtactttcncaagaacacactgtctcttacaaatgaaacagcctggacgggaccgaggacaccgggcgtctagttatgtgtagagtagtttagtggcgtatcgggtcgtgggtcggacaggtacgtacgacggttcgggggaccaaccggggg

SEQ ID NO: 320351 - DNA, 573 bp, Homo sapiens
  misc_feature: GZ8MTXP02F5HC8.19.67.G01.1.454.CMB.2.raw
  modified_base (522)..(522): a, c, t, g, unknown or other
  misc_feature (522)..(522): n is a, c, g, or t
  modified_base (534)..(534): a, c, t, g, unknown or other
  misc_feature (534)..(534): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtcgaaccctgtggggtctccgtcagcagcgactgtatgcctggtccgccaggctccgaggggaagagggccggaggtggggtcgcgtaggttatttttagagggtgggaccgactagttcgtacgggagaccttccgagtcgggacgggccgtattccgaacctatcctaccagtagtacttttcactaagaacactactgtctactacaaatgaacagccgtggacgggccgaggacacggccgtctattagtgtgtagagtagtttagnggcgtagtcggngtggtgacgagtactcgacggtcggggaccgtaacgggg

SEQ ID NO: 320352 - DNA, 560 bp, Homo sapiens
  misc_feature: GZ8MTXP02H9FTV.19.67.G01.1.454.CMB.2.raw
  modified_base (297)..(297): a, c, t, g, unknown or other
  misc_feature (297)..(297): n is a, c, g, or t
  modified_base (424)..(424): a, c, t, g, unknown or other
  misc_feature (424)..(424): n is a, c, g, or t
  modified_base (505)..(505): a, c, t, g, unknown or other
  misc_feature (505)..(505): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctgtggggtctccgtcagcagcactgtatgcctgggtccnccaggctccgaggggaagaggccggagtggggtcgcgaggttatttttagaggtgggaccgacattcgtacggatacctccagtgggaggggcccgattccgacctatcctaccagagtacttttcncaagaacacactgtctcttacaaatgaaacagcctggagggccaaggacacggcgtactattattgtgtgagtagtttagnggacgtacgtcggtcgtgggaacgacacggtactcgacggtcggggaccgacggg

SEQ ID NO: 320353 - DNA, 570 bp, Homo sapiens
  misc_feature: GZ8MTXP02HRTS7.19.67.G01.1.454.CMB.2.raw
  modified_base (317)..(317): a, c, t, g, unknown or other
  misc_feature (317)..(317): n is a, c, g, or t
  modified_base (400)..(400): a, c, t, g, unknown or other
  misc_feature (400)..(400): n is a, c, g, or t
  modified_base (499)..(499): a, c, t, g, unknown or other
  misc_feature (499)..(499): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtggcggaggcttggtccagcctgggcgtctctgagactgtcctgtcgaaccctcgtgggtctccgtcagcagcgactgtattgcctggtccgccaggctccgagggaagnggccggagtgggtcgcgtaggttatttttagaggtgggaccgactattcgtacggagactccagtggagggccattcacatcncagacgtactttctcaagaacacacttcgtctcttacaaatgaacagcctggacgggccgaggacacggccgtactattagtgtgtgaggtagtttagngggtacgtagtcgggtcttagggtcggtaacgaggtactacgtaacggtcgggggtaccctaaaccggggg

SEQ ID NO: 320354 - DNA, 561 bp, Homo sapiens
  misc_feature: GZ8MTXP02HQCRM.19.67.G01.1.454.CMB.2.raw
  modified_base (519)..(519): a, c, t, g, unknown or other
  misc_feature (519)..(519): n is a, c, g, or t
  modified_base (538)..(538): a, c, t, g, unknown or other
  misc_feature (538)..(538): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagccgtgggcggtcgtctggagacgtgtcctgtcgaccctgtggggtctccgtcagcagcgactgtatgctggtccgcaggctcgaggagaggccggagtgggtcgcaggtatttttagagggtggaccgactagttctacgggatacttccagtgggaacgggccgaatttccaacctatcctccagagtactttcacagaacacactgtctctacaaatgaacacgtaccgtaggacgggccgaggacgtacggcgtacgttattagttgtagtgagtagttagtggacgtagnggtctggtggacgagtacncgacggtcggggacgaaccgggg

SEQ ID NO: 320355 - DNA, 556 bp, Homo sapiens
  misc_feature: GZ8MTXP02JC3SH.19.67.G01.1.454.CMB.2.raw
  modified_base (505)..(505): a, c, t, g, unknown or other
  misc_feature (505)..(505): n is a, c, g, or t
tcagtactctcgtgcacgaccggtgctcgatttagagtatacatattgggtttgggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagccctgggcggtctctgagactgtcctgtgaaccctctggggtctccgtcagcagcgactgtatgcctgggtccgccaggctccgagggaagaggccggagtgggtcgcagggtatttttagaggttgggaccgtacattcgtacggagactccagtggagggccgtattccaccatctccagtagtacttttctcaagaacacactgtcttcttacaaatcgaaacagtcctgacgggaccgaggacacggccgtacgtattatgtgtgaggtagtttagngggcgtagtcggcgtgggtggacagactcgacgtcggggacctaaacgggg

SEQ ID NO: 320356 - DNA, 585 bp, Homo sapiens
  misc_feature: GZ8MTXP02JT4NT.19.67.G01.1.454.CMB.2.raw
  modified_base (236)..(236): a, c, t, g, unknown or other
  misc_feature (236)..(236): n is a, c, g, or t
  modified_base (242)..(242): a, c, t, g, unknown or other
  misc_feature (242)..(242): n is a, c, g, or t
tcagtactctcgtgcacgaccggtgctcgatttagagtatacatattgggtttgggggagctacaacaggcaggcagggggcagcaagatggtgttgcagacccaggtcttcatttctctgttgctctggatctctggttcctgcggggacatcgtgatgacccagtacccagactcactggctgtgtctcgtgggcgagacggccaacaatcaactgcaggtccagccagaactnttttcnccactcaagaacaaaacttctagcctggtaccaacagagaccaggacagcctacctaagttcgctacatttactgggtcttctacgcgcgtaacgttccggggtccctggacccccgtagtcccggggcacggcggggtctgggaccaggtatttccgactctcacctatcgacgcagcctagcgaggtctagaaagtgtgtggacttagtttatactgtcagtactaaatttctttttactactccgttacggtggtaaccgttccgggaacaaagggggtacccgaaggggttacggaaaactcgaacgaaccgtagtcggtgactcgacacctgtcctcg

SEQ ID NO: 320357 - DNA, 712 bp, Homo sapiens
  misc_feature: GZ8MTXP02HOC7S.19.67.G01.1.454.CMB.2.raw
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgtgactgtcctgtcgaaccctctggggtctccgtcagcagcgactgtatgcctggtccgcaggctccagggagaggccggagtgggtcgcgaggtatttttagaggtgggaccgacattcgtacggagaccttccagttcggggaacggggcccgagtttaccgaccctaattcccttacccgaaacgtaggtaacctttttcctactaaaggaaaccctaacctaacttcggttaccttacctttaccaaaaattcggaaaccaacggtcccgtagggaccgggggacccggaacggggaaccgaaccggggtccccggttacctttaacgtttaacgtttaggtcgggtaccggtaaggttaggtttttaaacgtggggtaccggtaacggttggggtaccggttggggttgggtaaccgtaagggaacgttccggaccggtttacggggggaccccgtaaacccgggggg

SEQ ID NO: 320358 - DNA, 657 bp, Homo sapiens
  misc_feature: GZ8MTXP02H6YKD.19.67.G01.1.454.CMB.2.raw
  modified_base (325)..(325): a, c, t, g, unknown or other
  misc_feature (325)..(325): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgaccttgggtttccttgctgcaatttcaggaggtgtccagtgtgaggtgcaacgtggtggagacgtgggcggaggtcttggtccagccgtggggcggtctctgagtactgtcctgtcgaccctgtgggtctcgtcagcagcgactgtatcgccgtcgggtccgccaggctccgagggaaggnggccggaggtgggtcgcgtaggttatttttagagggtggaccgactagttcgacggacgacttccgagtcggggacgggcccggtattaccaacctattccctaccctaggacgttaccttttcacgaaacgtaaaccacctaacttgtaccttacttacaaaagttgaaaccacgtaccgtacgggacggggacccggaacgggaccgaccgggtcccgtattagttagttggtggtaggtaggttaacggttttagacggggcgttagtcgggtcgtaggggtaaggacgaggtacgtacgaccgggtacgggggacccgtaaccggggg

SEQ ID NO: 320359 - DNA, 667 bp, Homo sapiens
  misc_feature: GZ8MTXP02H8U47.19.67.G01.1.454.CMB.2.raw
  modified_base (322)..(322): a, c, t, g, unknown or other
  misc_feature (322)..(322): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactgggtggagactggcggaggcttggtccaggccgtgggcggtctctgagactgtcctgtcgaaccctcgtggggtctccgtcagcagcgactgtattgcctgggtccgccaggctccgagggaagnggccggagtgggtcgcgaggttatttttagagggtggaccgactagttcacggagactccatcggggaggccgattccaccatcctccagacgtacttttactacacgaaacacaactgtcttacttacaaatgaaacagtaccgtaggacggggaccgaacgggaaccgaacggggtacccgttacgttaaatttaagtttgggtaggttacggtaaaggtttagggttttaaagttccgggggtacggtaacggttcgggggtcgttacgggggttaagggtaaccgaaacgggtacgttaccggaaccgggttacggggggtaccccgtaaaacccgggggg

SEQ ID NO: 320360 - DNA, 576 bp, Homo sapiens
  misc_feature: GZ8MTXP02H8SQS.19.67.G01.1.454.CMB.2.raw
  modified_base (192)..(192): a, c, t, g, unknown or other
  misc_feature (192)..(192): n is a, c, g, or t
  modified_base (204)..(204): a, c, t, g, unknown or other
  misc_feature (204)..(204): n is a, c, g, or t
  modified_base (381)..(381): a, c, t, g, unknown or other
  misc_feature (381)..(381): n is a, c, g, or t
  modified_base (513)..(513): a, c, t, g, unknown or other
  misc_feature (513)..(513): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtncaactggtgganacgtgggcggaggcttggtccaggcctgggcggtctctgagctgtcctgtcgaaccctcgtggggtctccgtcagcagcgactgtatgcctgggtccgccaggctccgagggaagcggccggagtgggcgcgaggttagtttttagagggtgggaccgactattcgacggagactcngtcgggaggccgattccacgatcctaccagtacgtactttcacagaaacacatcgtctactacaattacgaacacgctaggacgggccgaggaacgacggcgtacttagttagttgtgtgagtaggtttacngggactagtcggtgtggggtaagtacgaagtacgtcgaacggtcggggacccgtaaccggggg

SEQ ID NO: 320361 - DNA, 587 bp, Homo sapiens
  misc_feature: GZ8MTXP02IEJQD.19.67.G01.1.454.CMB.2.raw
  modified_base (361)..(361): a, c, t, g, unknown or other
  misc_feature (361)..(361): n is a, c, g, or t
  modified_base (371)..(371): a, c, t, g, unknown or other
  misc_feature (371)..(371): n is a, c, g, or t
  modified_base (410)..(410): a, c, t, g, unknown or other
  misc_feature (410)..(410): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtggcggaggcttggtccagccgtgggcggtctctgagactgtcctgtgaaccctcgtgggtctccgtcagcagcgactgtattgcctgggtccgccaggctccaggggaagaggccggagtgggtcgcgaggttattttagagggtggaccganattcacgganactcatgggaggccgattcacatctccagagtactttcncagaacacactgtctcttacaaaatgaaacagtccgtaggacgggccgaggaccaaccgggccgttactaagttagttagtgttagagttaggtttaaacgtgggtcgtaagttgggccgttggggaagggaacaggtaaacgtccgaacggttcgggggacccgtaaacccggggg

SEQ ID NO: 320362 - DNA, 597 bp, Homo sapiens
  misc_feature: GZ8MTXP02IPP5U.19.67.G01.1.454.CMB.2.raw
  modified_base (277)..(277): a, c, t, g, unknown or other
  misc_feature (277)..(277): n is a, c, g, or t
  modified_base (303)..(303): a, c, t, g, unknown or other
  misc_feature (303)..(303): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagactggcggaggcttggtccagccgtgggcggtctctgagactgtcctgtcgaaccctcgtggggtctccgtnagcagcgactgtatcgcctgggtccnccaggctccgaggggaagaggccggagtgggtcgctaggttatttttagagggtggaaccgactattcgacggagaaccttccagtggggaacgggccgaattccacatcctccagagtacttttcacaagaaacacactcgtctacttactaaaatgtaaacacgtaccgtaggacggggacccgagggaaccacggggtacccgtacttaattagtgtggtagaagttagtttacgtagggacgtagtcggtcgtaggtaagacgagtacgtcgacggtcgggaccgaacgg

SEQ ID NO: 320363 - DNA, 628 bp, Homo sapiens
  misc_feature: GZ8MTXP02JWX7M.19.67.G01.1.454.CMB.2.raw
  modified_base (239)..(239): a, c, t, g, unknown or other
  misc_feature (239)..(239): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaactattttcnccacctccaagaacaaaacttctagcctaggtaccaacagacgaccaggacagcctacctaaagttcgctctatttaccgtgggtcctttctacggcgtacgtaaacgtttcccgggggtcccctggtaacccccgacgtttcccgggggcacgggccggggtcctaggggacctaggtacttttccacttctccaacctatccaagccagcccgtgccagggcctaggaaagtgtaggtcggacttaggtttacttactgactagactaatttacgtttttctagttccctccggttaggtacccgttcgggaccgaaagggggacctaagggggtacgaaaactcgaaacggacgtaacgtggtcgtctacgccaactactcgttcg

SEQ ID NO: 320364 - DNA, 596 bp, Homo sapiens
  misc_feature: GZ8MTXP02JO3D7.19.67.G01.1.454.CMB.2.raw
  modified_base (481)..(481): a, c, t, g, unknown or other
  misc_feature (481)..(481): n is a, c, g, or t
  modified_base (519)..(519): a, c, t, g, unknown or other
  misc_feature (519)..(519): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttcctgctgcaatttcaggaggtgtccagtgtgaggtgcaactggtggagactgggcggaggcttggtccagccgtgggcggtctctgagactgtcctgtcgaaccctcgtggggtctccgtcagcagcgactgtattgcctgggtccgccaggctccgaggggaagaggccgggaggtggggtcgcgtaggttatttttagagggtgggaccgacagttcgtacgggagactccgagtggggacggggacccggattccgaaccctagtcctacccgagtaacgtacttttctacaacgaacacactgtctacttacaaatgaaacngccgtaggagggccgaggacgacggcgtctattagtgngtgagtagttagtggcgtagtcggtgttagggaacgtaacgagacgttacgacggtacgggggaccgaaaccggggg

SEQ ID NO: 320365 - DNA, 531 bp, Homo sapiens
  misc_feature: GZ8MTXP02FHUD2.19.67.G01.1.454.CMB.2.raw
  modified_base (488)..(488): a, c, t, g, unknown or other
  misc_feature (488)..(488): n is a, c, g, or t
tcagtactctcgtgcacgaccggtgctcgatttagagtatacatattgggtttgggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagaggccggagtggggtcgcaggttattttagtaggtggggaccgacattctacggagactccatgggagggccgattcaccatctccagagacttttctcagaacacactgtctcttcaaatgaaacagcctgagggccgaggacacggccgtctatattgtgtgagtagtttanggcgagtggctggtggacaggactcacgtcggggccaacgggg

SEQ ID NO: 320366 - DNA, 569 bp, Homo sapiens
  misc_feature: GZ8MTXP02FO65X.19.67.G01.1.454.CMB.2.raw
  modified_base (376)..(376): a, c, t, g, unknown or other
  misc_feature (376)..(376): n is a, c, g, or t
  modified_base (521)..(521): a, c, t, g, unknown or other
  misc_feature (521)..(521): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttcctgctgcaatttcaggaggtgtccagtgtgaggtgcaactggtggagactgggcggaggcttggccagcctggggcggtctctgagactgtcctgtgaaccctcgtggggtctccgtcagcagcgactgtattgcctggtccgccaggctccgaggggaagaggccggagtgggtcgcgtaggttatttttagagggtgggaccgactattcgtacgganacctccagtgggagggccgattccgaccatcctaccagacgtacttttcacaagaaccactaactgtctacttacaaaatcgaaacacgcctaggacggggacccgaggaccgacggccgtactattatgtgtgagtagtttagnggacgtagtggctgggtgacgagactcgacgtcgggggactaacgggg

SEQ ID NO: 320367 - DNA, 586 bp, Homo sapiens
  misc_feature: GZ8MTXP02HC9HP.19.67.G01.1.454.CMB.2.raw
  modified_base (381)..(381): a, c, t, g, unknown or other
  misc_feature (381)..(381): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtgggcggaggcttggtccaggcccgtggggcggtctctgagactgtcctgtcgaaccctcgtggggtctccgtcagcagcgactgtattgcctggtccgccaggcctccgagggaagaggccggagtgggtcgcgtaggtatttttagaggtggaccgtactattcgtacgganactcgagtgggaggccgtattcaccatctccagtacgtactttcacaagaactacactgtctacttacaaatcgaaacagtcctaggacgggccgaggacgacggccgtcttagttagtacgtgtagagttagtttagtggcgagttcggcgttggtaaccggagaggtacgtacgtacggtacgggggaccgtaaacccggggg

SEQ ID NO: 320368 - DNA, 536 bp, Homo sapiens
  misc_feature: GZ8MTXP02GLQ7T.19.67.G01.1.454.CMB.2.raw
  modified_base (412)..(412): a, c, t, g, unknown or other
  misc_feature (412)..(412): n is a, c, g, or t
  modified_base (515)..(515): a, c, t, g, unknown or other
  misc_feature (515)..(515): n is a, c, g, or t
tcagtactctcgtgcacgaccggtgctcgatttagagtatacatattgggtttgggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagaggccggagtgggtcgcgtaggttattttagtaggtgggaccgacattctacggagactccgatgggaggccgattcaccatctccagagtactttcncagaacacactgtctactcaaatcgaaacagcctgacgggccgaggacgacggccgtctatattgtgtgagtagttatggcgagttcgcgtggtgacagtacncgacgtcggggacaaccgggg

SEQ ID NO: 320369 - DNA, 557 bp, Homo sapiens
  misc_feature: GZ8MTXP02GVM7Y.19.67.G01.1.454.CMB.2.raw
  modified_base (262)..(262): a, c, t, g, unknown or other
  misc_feature (262)..(262): n is a, c, g, or t
  modified_base (318)..(318): a, c, t, g, unknown or other
  misc_feature (318)..(318): n is a, c, g, or t
  modified_base (419)..(419): a, c, t, g, unknown or other
  misc_feature (419)..(419): n is a, c, g, or t
tcagtactctcgtgcacgaccggtgctcgatttagagtatacatattggggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtgggcggaggcttggtccagcctgggcggtctctgagctgtcctgtgaccctntggggtctccgtcagcagcgactgtatgcctgggtccgccaggctccgagggaagnggcgggagtgggtcgcgaggttatttttagagggtgggaccgtacattctacggacgactccagtgggagggccgagttcacatctccagacgtactttcncagaacacacttgtctcttacaaatgaacagctggacgggaccgaggaccgacggcgtctattattgtagtgtagtagtttagtggcgtagtcggtctggggtaagacgagactcgacgtcggggacgtaacccgggg

SEQ ID NO: 320370 - DNA, 544 bp, Homo sapiens
  misc_feature: GZ8MTXP02I9XT4.19.67.G01.1.454.CMB.2.raw
  modified_base (180)..(180): a, c, t, g, unknown or other
  misc_feature (180)..(180): n is a, c, g, or t
  modified_base (245)..(245): a, c, t, g, unknown or other
  misc_feature (245)..(245): n is a, c, g, or t
  modified_base (322)..(322): a, c, t, g, unknown or other
  misc_feature (322)..(322): n is a, c, g, or t
  modified_base (477)..(477): a, c, t, g, unknown or other
  misc_feature (477)..(477): n is a, c, g, or t
  modified_base (507)..(507): a, c, t, g, unknown or other
  misc_feature (507)..(507): n is a, c, g, or t
  modified_base (542)..(544): a, c, t, g, unknown or other
  misc_feature (542)..(544): n is a, c, g, or t
tcagtactctcgtgcacgaccggtgctcgatttagagtatacatattgggcttggtccagcctgggcggtctctgagactgtcctgtgaaccctctggggtctccgtcagcagcgactgtattgcctgggtccgccaggctccagggaagaggccggagtgggtcgcagggtatttttanagggtgggacgacatttctacggagactccatggaggccgattcaccatctccagagacttttcncagaacacactgtctcttcaaaatgaacagcctgacgggccaggacacggccgtctattattgtgtgagtagtttanggcgatgggctggtggacagatcaccgtggggccaggggaccctggtccaccgtctcctcacgccctaccacgaaacggggccccagtccggtccttcccccgtggcccgccctgcctccgaggacgccacctccgagacgcacgacgcggcccngggctgcctggtcaaggctaccgtccacgngacgtactggacgcgggctggcaaggcgcatacgnnn

SEQ ID NO: 320371 - DNA, 567 bp, Homo sapiens
  misc_feature: GZ8MTXP02G712F.19.67.G01.1.454.CMB.2.raw
tcagtactctcgtgcacgaccggtgctcgatttagagtatacatattgggtttggggtctgggagaggagcccagcactgggattccgaggtgtttccattcggtgctcagcactgaacacagaggactcaccatggagtttggctgacctgggttttccttgctgcaatttcaggaggtgtccagtgtgaggtgcaactggtggagactgggcggaggcttggtccagcctgggcggtctctgagactgtcctgtgaaccctcgtggggtctccgtcagcagcgactgtattcggcctgggtccgccgaggctccgaggggaagaggccgggaggtgggcgcgtaggtatttttagaggtggacgacattcgacggagctccagtggagggccgattcacactctccagacgtactttctcaagaacacactgtctacttacaaatagaacagcctaggacggaccgacgggaccgacggtcccgtactagttagtttgtggtaggtaagtagtttaagtggacgtagtgggtcgtgggtagacgagacgtacgaacggtcggggg

SEQ ID NO: 320372 - DNA, 556 bp, Homo sapiens
  misc_feature: GZ8MTXP02IR76O.19.67.G01.1.454.CMB.2.raw
  modified_base (504)..(504): a, c, t, g, unknown or other
  misc_feature (504)..(504): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctggggcggtctctgagactgtcctgtgaaccctctgggtctccgtcagcagcgactgtatgcctggtccgcaggctccagggaagaggccggagtgggtcgcaggtattttataggtgggacgacattctacggagacctccatgggaggggccgagttccaccatctcccagagtactttctcaagaacacactgtctctcaaatgaacagcctgagggccgaggacgacggccgtctattattgtgtagagtagtttagtggtacgtagtcggngttggggtggaacgacggtagtcgtaacggtcgggggaccgaaacccggggg

SEQ ID NO: 320373 - DNA, 543 bp, Homo sapiens
  misc_feature: GZ8MTXP02I4EQK.19.67.G01.1.454.CMB.2.raw
  modified_base (347)..(347): a, c, t, g, unknown or other
  misc_feature (347)..(347): n is a, c, g, or t
  modified_base (412)..(412): a, c, t, g, unknown or other
  misc_feature (412)..(412): n is a, c, g, or t
  modified_base (491)..(491): a, c, t, g, unknown or other
  misc_feature (491)..(491): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttgggtccagcctggggcggtctctgagactgtcctgtgaaccctctggggtctccgtcagcagcgactgtattgcctgggtccgccaggctccgagggaagaggccggagtgggtcgcaggtattttanaggtgggacgacattctacggagactccagtggagggccgattcaccatctccagagtactttcncagaacacactgtctcttcaaatgaaacagcctgaggggaccgaggacacggccgtctattatgtgtgagtagtttagnggcgtagtcggcgtggtggacaggactacgacggtcggggaccgtaacgggg

SEQ ID NO: 320374 - DNA, 678 bp, Homo sapiens
  misc_feature: GZ8MTXP02ICAPX.19.67.G01.1.454.CMB.2.raw
  modified_base (326)..(326): a, c, t, g, unknown or other
  misc_feature (326)..(326): n is a, c, g, or t
  modified_base (633)..(633): a, c, t, g, unknown or other
  misc_feature (633)..(633): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactgggtggagactgggcggaggcttggtccagccgtgggcggtctctgagactgtcctgtcgaaccctctggggtctccgtcagcagcgactgtattgcctggggtccgccagggctccgaggggaaggnggccgggaggtggggtcgcgaggttatttttagagggtgggaccgactagttctacgggagacctcccgagtcggggaacggggcccgtaagtttccgaaccctacttccctaccccgtaaggacggttaccctttttctaccgaagtaaaccacctacttcgtaccttacctttacaaaaagttcgaaaccaggtacccgttaggacgggggaccgaacggggaaccgaaccgggtccgttacttagtttaacgttggtaggtaggtaggttagtttaacgtggggacgtagtgggtcgttagggnggtacaggtactaccggacggttcgggggacccgtaaaccggggg

SEQ ID NO: 320375 - DNA, 658 bp, Homo sapiens
  misc_feature: GZ8MTXP02FMTKR.19.67.G01.1.454.CMB.2.raw
  modified_base (333)..(333): a, c, t, g, unknown or other
  misc_feature (333)..(333): n is a, c, g, or t
  modified_base (370)..(370): a, c, t, g, unknown or other
  misc_feature (370)..(370): n is a, c, g, or t
  modified_base (375)..(375): a, c, t, g, unknown or other
  misc_feature (375)..(375): n is a, c, g, or t
tcagtactctcgtgcacgaccggtgctcgatttagagtatacatattggggtttggggggagaggagcccagcactgggattccgaggtgtttccattcggtgctcagcactgaacacagaggactcaccatggagttttggctgacctgggttttcctgctgcaatttcaggaggtgtccagtgtgaggtgcaactgggtggagactgggcggaggcttggtccagcctgggcggtctctgagactgtcctgtgaaccctctggggtctccgtcagcagcgactgtattgcctgggtccgccaggctccgagggagaggccggagtgggtcncgtaggttattttagaggtggaccgacattcacgganactcngtgggaggccgattccgaaccatctccagtacgtacttttcacaagtaaacacgactgtacctacttacaaaattgaaacctacggtccctagggacgggggacccgaacggggaccacggggtacccgttacgtaatttaacggttggtacggttacggtaagggttaaggtttttaaacggcgggtaacggtacggttcggggtacgttagggggtaacggtaaacgtaacggtaaccggtaccggtaaccgggtaccggggggaacccgtaaaccggggg

SEQ ID NO: 320376 - DNA, 603 bp, Homo sapiens
  misc_feature: GZ8MTXP02IXSH9.19.67.G01.1.454.CMB.2.raw
  modified_base (308)..(308): a, c, t, g, unknown or other
  misc_feature (308)..(308): n is a, c, g, or t
tcagtactctcgtgcacgaccggtgctcgatttagagtatacatattgggtttggggtctgggagaggaacccagcactgggattccgaggtgtttccattcggtgctcagcactgaacacagaggactcaccatggagttttggctgacctgggttttccttgctgcaatttcaggaggtgtccagtgtgaggtgcaactggtggagacgtgggcggaggcttggtccagcctgggcggtctctgagactgtcctgtcgaccctgtggggtctccgtcagcagcgactgtattcgccgtgggtcccncgaggctccgaggagcggcggaggtcggtcgcgtaggtttatttagaggtcgggacactagttcgtacggagtactccgagtcggggacgggcctagttccaaccgtatccgtacagtacgttactttcacgaacgtaacactactgtcctacttacaaattcgaactagaccgtagggacgggaccgaggaccgaccggtcgttacgtagttagttggtagtgtagttagtttagtcggtcgtagtcggtagtgggtacgacgtagtacgtacgtacgggtacggggaacccgg

SEQ ID NO: 320377 - DNA, 555 bp, Homo sapiens
  misc_feature: GZ8MTXP02I4KDP.19.67.G01.1.454.CMB.2.raw
  modified_base (261)..(261): a, c, t, g, unknown or other
  misc_feature (261)..(261): n is a, c, g, or t
  modified_base (318)..(318): a, c, t, g, unknown or other
  misc_feature (318)..(318): n is a, c, g, or t
  modified_base (404)..(404): a, c, t, g, unknown or other
  misc_feature (404)..(404): n is a, c, g, or t
  modified_base (414)..(414): a, c, t, g, unknown or other
  misc_feature (414)..(414): n is a, c, g, or t
  modified_base (502)..(502): a, c, t, g, unknown or other
  misc_feature (502)..(502): n is a, c, g, or t
tcagtactctcgtgcacgaccggtgctcgatttagagtatacatattgggtttggggggaggaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctntggggtctccgtcagcagcgactgtattgcctgggtccgccaggctccgagggaagnggccggagtgggtcgcaggttatttttagagggtggacgacagttctacggagactcagtgggagggccgattccacatctccagngtacttttcncagaacacactgtactcttacaaagttgaacagtcctagagggccgaggacacggccctgtattagttgtagtgtagtagttttaggnggtacgtagtcggtcgtggtggaacgacgacgtcgacggtcgggaccgacggg

SEQ ID NO: 320378 - DNA, 643 bp, Homo sapiens
  misc_feature: GZ8MTXP02FNANC.19.67.G01.1.454.CMB.2.raw
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtcgaccctgtggggtctccgtcagcagcgactgtattgccgtgggtccgccaggctccgaaggggaagacgggccggaggtgggtcgcgtaaggttatttttagagggtggggaccgtactagttcgtacgggagtacctccgagtggggaacgggccgattccgaacctatcctacccaggtacgtaacttttcacgaagaaccacgtacttcgtaccttacttacaaaatcggtaaacacgtcccgtaggacggggcccgaaggtaccgaaccgggtcccgttacttagttagttggtagtacggtaggtagtttagcgggacgtagtgggtcgtggggtcggtaacgaacggtagttacccgaacggttcgggggacctaaaccggggg

SEQ ID NO: 320379 - DNA, 571 bp, Homo sapiens
  misc_feature: GZ8MTXP02JBGFH.19.67.G01.1.454.CMB.2.raw
  modified_base (315)..(315): a, c, t, g, unknown or other
  misc_feature (315)..(315): n is a, c, g, or t
  modified_base (515)..(515): a, c, t, g, unknown or other
  misc_feature (515)..(515): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtcgaaccctgtggggtctccgtcagcagcgactgtatgcctggtccgcaggctccgagggaagnggccggagtgggtcgcgtaggttatttttagagggtggaccgactattctacggagactccagtgggagggccgattcaccatctaccagtagtactttcacagaaacacactgtctcttacaaatcgaaacacgccgtggacgggacccgaagggaccgacgggtccgttacttaattagttgtgtagagtagtttagnggacgtgtcggtgtggtaagacgtacggacgtacggtacgggacggacggtaccgg

SEQ ID NO: 320380 - DNA, 573 bp, Homo sapiens
  misc_feature: GZ8MTXP02HZ69M.19.67.G01.1.454.CMB.2.raw
  modified_base (421)..(421): a, c, t, g, unknown or other
  misc_feature (421)..(421): n is a, c, g, or t
  modified_base (513)..(513): a, c, t, g, unknown or other
  misc_feature (513)..(513): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctgggcggtctctgagactgtcctgtcgaaccctcgtgggtctccgccagcagcgactgtattgcctggtccgcaggctccgaggggaagaggccggaggtgggtcgcgtaggtatttttagagggtgggaccgactattcgtacggagactccagtgggagggccgattccgacatctccagacgtactttcncaagaacacacttgtctcttacaaatgaaacagccgtaggacgggccgaggacgaacgggtccgtacttattagtgtgtgagttagtttaangggtacgagtcggcgtgggtaaggactagacgtacgacggacggggtaccgaaaccgggg

SEQ ID NO: 320381 - DNA, 611 bp, Homo sapiens
  misc_feature: GZ8MTXP02G9I5E.19.67.G01.1.454.CMB.2.raw
  modified_base (321)..(321): a, c, t, g, unknown or other
  misc_feature (321)..(321): n is a, c, g, or t
  modified_base (609)..(610): a, c, t, g, unknown or other
  misc_feature (609)..(610): n is a, c, g, or t
tcagtactctcgtgcacgaccggtgctcgatttagagtatacatattgggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagactttttctcagaacacactgtctcttcaaatgaacagcctgagggccgaggacacggccgtctatttattgtgtgagtagtttanggcgatgggctgggtggacagatcaccgtggggccaggggaccctggtccaccgtctcctcacgccctccaccgacgggcccacgtccggtcccttcccccgtggcccgcccctgcctccgacgggacgccacccgtccggagacgccgacgacggcccgggcccgtggggcctcggcccgtcgggtaccgaaacgggtaccttacccgttaccccgaacggtacggtacggtacgtcgggaacgggccggggcgtacggggaacgaacgggccggacagtacggcgnng

SEQ ID NO: 320382 - DNA, 712 bp, Homo sapiens
  misc_feature: GZ8MTXP02H47AN.19.67.G01.1.454.CMB.2.raw
  modified_base (325)..(325): a, c, t, g, unknown or other
  misc_feature (325)..(325): n is a, c, g, or t
  modified_base (371)..(371): a, c, t, g, unknown or other
  misc_feature (371)..(371): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttcctgctgcaatttcaggaggtgtccagtgtgaggtgcaacgtggtggagacgtggcggaggcttggtccagccgtgggcgtctctgagactgtctgtgaccctgtgggtctcgtcagcagcgactgtatgccgtggtccgcaggctcgagggagaggcggagtgggtcgntaggttattttagagggtggaccgactagttcgaaggagacttccnggtacgggagggccgtagttaccacctatccgtaccctaggacgttacctttacacaaacgtaaacacctacttcggtaccttaccttaacaaaagttcgaaaaccgtacggtacccgttaggggaacggggacccggaaacgggtaacccgaccgggggttacccttaacgtttaaacgttttaggttaacggtttgggttaacggtaaggttttaacggtttttaaacggggtacggggttacggttacgggttcgggttacgggttacggggtaacggaaacgtaacggtaacggttaccggaaccggggttaccgggggaacccggtaaaccggggg

SEQ ID NO: 320383 - DNA, 623 bp, Homo sapiens
  misc_feature: GZ8MTXP02GD73S.19.67.G01.1.454.CMB.2.raw
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaacgtgggtggagacgtgggcggaggcttgggtccaggccgtggggcggtctcgtgagactgtcctgtcgaaccctgtggggtctccgtcagcagcgactgtattgcctgggtccgccaggctccgaggggaagagggccggaggtggggtcgcgaggttatttttagtaggtgggacgacattctacggagactccagtgggagggccgagttcaccatctaccagacgtactttctacacgaacacactagtcttacttacaaagttacgaaactacgaccgttaggaacggggaccgaacggaccgaaccgggcccgttacgttagtttaagttcggtagttaggtaacggttaagtttaacgtcgggacgtaagttggggtcggttacgggtacggacgtagtacgtacggacgggtcgggg

SEQ ID NO: 320384 - DNA, 781 bp, Homo sapiens
  misc_feature: GZ8MTXP02FRT5J.19.67.G01.1.454.CMB.2.raw
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtgggtggagacgtgggcggaggcttggtccaggccgtggggcggtctctgagactgtcctgtcgaaccctcgtgggtctccgtcagcagcgactgtattcgccgtgggtccgcgagggctccgaaggggaacgagggccggaggtgggtcgcgtaggtttaatttttaggagggtcgggaccgtactacgttacgtaacgggacgacctacgaggtggggacgggtaccgtatttccgaacctacgttcctacccgtaagtaacggttacctttttccgtacgtaaacgaaacctacctacttacggttaccttacgttaacctaaaaagttcggaaaactaccgggtaccgttacggggaaccgggggaacccgggaacgggaaaccggacccggggttaccccgttaacgtttaacgtttaacggtttggttaggttacggtaacgggtttaaacggtttttaaagggccggggttacggttaaggttccggggtacgtttagggggtaacggggtaaacccgtaaggggtaacgtaccggttaaccggggtaccggggggaaccccggtaaaacccggggg

SEQ ID NO: 320385 - DNA, 738 bp, Homo sapiens
  misc_feature: GZ8MTXP02IHALH.19.67.G01.1.454.CMB.2.raw
  modified_base (192)..(192): a, c, t, g, unknown or other
  misc_feature (192)..(192): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtncaactgggtggagacgtgggcggaggcttggtccagccgtgggcggtctctgagactgtcctgtcgaaccctgtggggtctccgtcagcagcgactgtattgccgtggtccgccaggctccgaggggaagacggccggaggtgggtcgctaggttatttttagagggtggaccgactagttcgtacggagaccttccaggttggggaaggggcccgtaatttccacccgtaattcccgtaccaaggtaacggttaaccctttttacaccgtaaacgtaaactaacccgtacttacggttacccttacttaacaaaagtttacggaaacctacggtacccgttacgggaacgggggacccggaaacggggaaccggaaccggggtacccggtttaccgttaaagtttaacgtttggttacgggtttacggaaggtttaggttttaaacgtgggggaccgtaggttcggggtacgttagggggtaacggggtaactaagggtaaacgtccgtaaccggggtacgggggtacccgtaaaacccgggggg

SEQ ID NO: 320386 - DNA, 611 bp, Homo sapiens
  misc_feature: GZ8MTXP02IFSE6.19.67.G01.1.454.CMB.2.raw
  modified_base (237)..(237): a, c, t, g, unknown or other
  misc_feature (237)..(237): n is a, c, g, or t
  modified_base (421)..(421): a, c, t, g, unknown or other
  misc_feature (421)..(421): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctgcgggacatcgtgatgacccagtacccagactcactggctgtgtctctgggcgagacgccacaatcaactgcaggtccagccagaactatttccnccactcaagaacaaaacttctagcctagtaccaacagagacaggacagcctcctaaagttcgctctatttacgtgggctttctacgcgcgaacgttccggggtccctgaccccgtagttcccggggcaggcgggtctgggcagtatttcactctcaccatcagcagcctgccgaggctagaagngtagtgacttagtttattacgtgtacagtactaatttactttttactacttccgttaccgttgggtaccgtttaccggacccgtaaaaggggtaccccgtaaaggggttacgggtaaaacttcggaaacggtaacggtaaaccgttgggttacggcgttacggaccgtaaccctagtttaccgtttccgg

SEQ ID NO: 320387 - DNA, 546 bp, Homo sapiens
  misc_feature: GZ8MTXP02HHUCK.19.67.G01.1.454.CMB.2.raw
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttcctgctgcaatttcaggaggtgtccagtgtgaggtgcaactgggtggagactgggcggaggcttgggtccagcctggggcgtctctgagactgtcctgtgaaccctctggggtctccgtcagcagcgactgtattgcctgggtccgcaggctccgagggaagaggcccggagtgggtcgctaggtatttttagaggtgggacgacatttcaacggagctccaatggagggccgattcaccatctccagagacttttcacagaacacactgtctcttacaaaagtgaacagcgtgacggacgacggacgacggacgtactattaattgtgtgtagtagttagttacggacgtagtgtgtggtacggacgagacgtacgtacgtacggg

SEQ ID NO: 320388 - DNA, 687 bp, Homo sapiens
  misc_feature: GZ8MTXP02F5J69.19.67.G01.1.454.CMB.2.raw
  modified_base (310)..(310): a, c, t, g, unknown or other
  misc_feature (310)..(310): n is a, c, g, or t
  modified_base (343)..(343): a, c, t, g, unknown or other
  misc_feature (343)..(343): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactgggtggagactgggcggaggcttgggtccaggccctggggcggtctcgtgagactgtcctgtcgaaccctcgtggggtctccgtcagcagcgactgtattggcctgggtccncaggctccgaaggggagaggccggagtgggtcncgtaggttattttagaggtggaccgtacattcgtacggagacctccgagtcgggaacggggtccgaattccgaacctatcctacccgagtacgttacctttttcgctaacgaaaccaccgtaacttcgttaccttaccttactaaaacgttacggaaacctacggacccgttagggaaccgggggacccgaaacggggaaccgtacccggggtacccggttactttagtttaaacgtttggtaggttggtaaggttaggttttagtacgggcggtaacgttcgggcgtttaggggaacggaacgtaggacgtaccggaacggtcgggggaccctaaaccggggg

SEQ ID NO: 320389 - DNA, 652 bp, Homo sapiens
  misc_feature: GZ8MTXP02JTD7P.19.67.G01.1.454.CMB.2.raw
  modified_base (364)..(364): a, c, t, g, unknown or other
  misc_feature (364)..(364): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactgggtggagacgtgggcggagggcttgggtccaggcccgtggggcggtctcgtggagactgtcctgtcgaacccctcgtggggtctccgtcagcagcgactgtattcgcctgggtccgccaggctccgagggaaggaggccggaggtgggtcgcgaggtatttttanagggtgggaccgacattctacggagactccagtgggagggccgattcgaccatctccgagagtacttttcgtcaagtaacaccacttacgtcttacttacaaaatagaaacgaagccgtaggacggggacccgaagggacccgaccgggtacccggtacgttaagtttagttggtggttacggtaggttaaggttttaacgtggggtacggtaagttccggggtcgttgggggtaaggaccgaaggtaaacgtcggaccggttacgggggacccggtaaacccggggg

SEQ ID NO: 320390 - DNA, 596 bp, Homo sapiens
  misc_feature: GZ8MTXP02J0GLZ.19.67.G01.1.454.CMB.2.raw
  modified_base (383)..(383): a, c, t, g, unknown or other
  misc_feature (383)..(383): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagccgtgggcggtctctgagactgtcctgtcgaaccctcgtggggtctccgtcagcagcgactgtattgcctgggtccgccaggctccgaggggaagagggccggaggtgggtcgcgtagggttatttttagagggtgggaccgacattcgtacggganacctccgagtgggaggggcccgtattccaccatcctcccagtacgtacttttctacaagaacacactcgtctcttacaaatgaaacacgccgtggacggggccgaggacgacggccgtctattagtgtgtgtagagtttagtcgggcgtagtcgggtcgtggggtaacggacgtaggacttaccgacggttcgggggacccgaaacccggggg

SEQ ID NO: 320391 - DNA, 536 bp, Homo sapiens
  misc_feature: GZ8MTXP02GOUTR.19.67.G01.1.454.CMB.2.raw
  modified_base (497)..(497): a, c, t, g, unknown or other
  misc_feature (497)..(497): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtatgcctgggtccgccaggctccaggggaagaggccgggaggtgggtcgcgaggtatttttagagggtgggacgacattcgtacggagctccatgggagggccgattcaccatctccagagtactttctcagaacacactgtctcttacaaatgaaacagcctgacgggccgaggacgacggccgtctattattgtgtgtagtagttanggcgtagtggcgtggtaggacagactcgaacgtcggggg

SEQ ID NO: 320392 - DNA, 571 bp, Homo sapiens
  misc_feature: GZ8MTXP02HD6OB.19.67.G01.1.454.CMB.2.raw
  modified_base (375)..(375): a, c, t, g, unknown or other
  misc_feature (375)..(375): n is a, c, g, or t
  modified_base (457)..(457): a, c, t, g, unknown or other
  misc_feature (457)..(457): n is a, c, g, or t
  modified_base (520)..(520): a, c, t, g, unknown or other
  misc_feature (520)..(520): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtgggcggaggcttggtccagcctgggcgtctctgagctgtcctgtcgaaccctctggggtctccgtcagcagcgactgtattgcctgggtccgccaggctccgaggggaagaggccggagtggggtcgcgaggttatttttagagggtgggaccgatattctacgganactccagtgggagggccgattcgaccatcctccagacgtacttttcgtcagtaacacactcgtctacttacaaaatgaaacncgacctggacggggaccgaagggaccaccgggccgtatacttagttgtgtgaggtagtttagnggcgagtggcgtgggtggacgagtactcgacggtcggggaccgtaacgggg

SEQ ID NO: 320393 - DNA, 589 bp, Homo sapiens
  misc_feature: GZ8MTXP02IQQB5.19.67.G01.1.454.CMB.2.raw
  modified_base (270)..(270): a, c, t, g, unknown or other
  misc_feature (270)..(270): n is a, c, g, or t
  modified_base (298)..(298): a, c, t, g, unknown or other
  misc_feature (298)..(298): n is a, c, g, or t
  modified_base (332)..(332): a, c, t, g, unknown or other
  misc_feature (332)..(332): n is a, c, g, or t
tcagtactctcgtgcacgaccggtgctcgatttagagtatacatattgggtttggggggagaggagcccagcactgggattccgaggtgtttccattcggtgctcagcactgaacacaaaggactcaccatggagttttggctgacctgggttttccttgctgcaatttcaggaggtgtccagtgtgaggtgcaactggtggagactggcggaggcttggtccagcctgggcggtctctgagctgtcctgtgaccctgtgggtctccgtnagcagcgactgtattgccgtgggtcccnccgaggctccgagggaagacggcggaggtgggcncgtaggttattttagaggtggacactagttcgtaacggagactccgatggggacgggcctagtccaccatcctaccagtagtacttttcacagaaacacactgtcttactacaaatacgaaacagccgtaggacgggccggaaggacgaccggtccgtactaattagttgtgtgtaaggtacgttttagcgggtagtagtggtcgtgggtaggaacgaggtactcgacggtcgggggaccgaacgggggtaaccccg

SEQ ID NO: 320394 - DNA, 576 bp, Homo sapiens
  misc_feature: GZ8MTXP02JAYCY.19.67.G01.1.454.CMB.2.raw
  modified_base (517)..(517): a, c, t, g, unknown or other
  misc_feature (517)..(517): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctgggcggtctctgagactgtcctgtgaaccctctggggtctccgtcagcagcgactgtattgcctgggtccgccaggctccgaggggaagaggccggaggtggggtcgcaggttatttttagagggtgggaccgacattcgtacggagactccgagtgggagggccgattcaccatctaccagacgtactttctacaagaacacactgtctcttacaaatgaaacagcctaggacgggaccgaacggaccgacgggcccgtatactttattgtgtaggagtagtttagnggacgtagtggtcgtagggtggaacgaggtactacgacggtcgggggaccaaccggggg

SEQ ID NO: 320395 - DNA, 611 bp, Homo sapiens
  misc_feature: GZ8MTXP02G4IER.19.67.G01.1.454.CMB.2.raw
  modified_base (302)..(302): a, c, t, g, unknown or other
  misc_feature (302)..(302): n is a, c, g, or t
tcagtactctcgtgcacgaccggtgctcgatttagagtatacatattggggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctgggcggtctctgagactgtcctgtcgaaccctcgtggggtctccgtcagcagcgactgtattgcctggtccncaggctccgagggaagaggccggaggtgggtcgcgtaggttatttttagagggtggaccgactattcgtacggagactccgagtgggagggccgagttccaccgactctaccagacgtactttctactagaacacactcgtctacttactaaatacgtaaacacgaccgtaggacggggaccggacgggacgaccggaccggtacgttacgttaagttgtggttacggtaggtgtttaaaaaaacgtggtacggtacgtgggtcgtaggtggtacgaggtacgtacgacgtacggggacgtaaccgggg

SEQ ID NO: 320396 - DNA, 537 bp, Homo sapiens
  misc_feature: GZ8MTXP02F70IN.19.67.G01.1.454.CMB.2.raw
  modified_base (250)..(250): a, c, t, g, unknown or other
  misc_feature (250)..(250): n is a, c, g, or t
tcagtactctcgtgcacgaccggtgctcgatttagagtatacatattgggtttgggggtagctcaggaagcagagcctggagcatctccactatggcctgggctccactacttctcaccctcctcgctcactgcacaggttcttgggccaactttatgctgactcagccccactctgtgtcggagtctccggggaagacggtaaccatcttttgcacccacaacagtggcaacattgccagcaattttgngcagtggtaccagcagcgcccgggcacgttcccccacattgtgatctatgaggataatcaaagccgtcgtggggtccctgatcggttctctcggctccatcgacacgctcctccaactctcgccctccctcaccatctctggactgaagactgaggacgaggctgactactactgtcagtcttatcgatacggccgtcggtcagtggtcggtcgttcgggcggtacgggaacccaaggcgtacgccgtaccgtaaggtccacgcccgaaggcctccgcccccgtcgg

SEQ ID NO: 320397 - DNA, 573 bp, Homo sapiens
  misc_feature: GZ8MTXP02F1V86.19.67.G01.1.454.CMB.2.raw
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctggggcggtctctgagactgtcctgtgaaccctctggggtctccgtcagcagcgactgtattgcctgggtccgccaggctccagggagaggccgggagtggggtcgcgaggtatttttagaggtgggacgacattctacggagactccaatgggaggggccgagtctaccactctccacgagactttacttctacgaacacactatcgtccttactaaatacgaacgaacgaccgtacgacgggacggacggacggaacggccgtacgtacttattaggttgtggtagtaggttattcggcgtagtggtcgtggtaggacgagtacgacgtacgtacggggg

SEQ ID NO: 320398 - DNA, 754 bp, Homo sapiens
  misc_feature: GZ8MTXP02HPV4E.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactgggtggagacgtgggcggaggcttggtccaggccgtgggcggtctctgagtactgtcctgtcgaccctgtgggtctccgtcagcagcgactgtatcgccgtcgggtcccgcgaggcctaccggaaggggaaggacgggccgggaggtggggtcgacgtagggtttatttttaaggagggtagggaccgtactagttcgtaacggagacctcgagttcggggacgggaccgtaacttccgaacctacttaccctacccgtaaggtacgttacctttttacctaccaaacgtaaaccacctacgttactccttaccttaaaccaaaagttacgaaacctacggtaccgttacgggaaccgggggacccggaacggaaacccggaccgggtcccccggttaactttagtttaagttagggttggttacggtaaagggtttacggttttaaacggtgggtaccggtaacgggttcggggtacgttacgggggtaaggttaaccgaaagggttactaaccggtaccggggtaccggggggtaacccggtaaaccccggggg

SEQ ID NO: 320399 - DNA, 611 bp, Homo sapiens
  misc_feature: GZ8MTXP02G01DF.19.67.G01.1.454.CMB.2.raw
  modified_base (317)..(317): a, c, t, g, unknown or other
  misc_feature (317)..(317): n is a, c, g, or t
  modified_base (346)..(346): a, c, t, g, unknown or other
  misc_feature (346)..(346): n is a, c, g, or t
tcagtactctcgtgcacgaccggtgctcgatttagagtatacatattgggtttggggggaggaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtatgcctgggtccgcaggctccgaggggaagnggccggagtgggtcgcaggttatttttanagggtggaccgactattctaacggagacttccgagtgggagggaccgattccaccattccctccagtacgtactttcgtacaacgtaaacacctactgtacctcttacaaatcgaaacacgtcctaggacggggaccgaaggaccgacggtcccgtacgttaatttacgttgtaggttcggagtaaaggttttcgaggggcgtaagtcggtcgtggtaacgggacagtaaccgtcgaaccggtcgggggacccgtaaaccggggg

SEQ ID NO: 320400 - DNA, 756 bp, Homo sapiens
  misc_feature: GZ8MTXP02G5DVP.19.67.G01.1.454.CMB.2.raw
  modified_base (302)..(302): a, c, t, g, unknown or other
  misc_feature (302)..(302): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctgggcggtctctgagactgtcctgtcgaaccctcgtggggtctccgtcagcagcgactgtattgcctgggtccnccaggctccgaggggaagaggccggaggtgggtcgcgtagggttatttttagagggttggggaacccgtacgtagtttcgtaacggggacgtaccttacccgaggttcggggacgggggtccccgtaaatttcccgaacccgtattacccgttacccgaggtaacggttacctttttctaaccgaacgaaaccgtaacctaacctttcgttacccttactttaccaaaaagttcgaaaacctacggtcccgtagggaccgggggtaccccgaacggggaacccgaacccgggggtcccgtttaccttaacggtttaacgtttcgggtacggtttacggtaaaggttagggtttttaagtaccgggggtcggtaacgttggggaccgttgggggttaacggaaacgaggggtaaactccggtaaccgggttcgggggaacccggtaaaccggggg

SEQ ID NO: 320401 - DNA, 563 bp, Homo sapiens
  misc_feature: GZ8MTXP02GNB4X.19.67.G01.1.454.CMB.2.raw
  modified_base (363)..(363): a, c, t, g, unknown or other
  misc_feature (363)..(363): n is a, c, g, or t
  modified_base (373)..(373): a, c, t, g, unknown or other
  misc_feature (373)..(373): n is a, c, g, or t
  modified_base (424)..(424): a, c, t, g, unknown or other
  misc_feature (424)..(424): n is a, c, g, or t
  modified_base (505)..(505): a, c, t, g, unknown or other
  misc_feature (505)..(505): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttgggtccaggcctggggcggtctctgagactgtcctggtcgaaccctcgtgggtctccgtcagcagcgactgtatcgcctggtccgccaggctccgagggaagaggccggagtgggtcgcgtaggttattttagaggtggaccganattcacgganactcagtgggaggccgtattcacatctaccagtagtactttcacagaaacnctactcgtctacttacaaatagaacacgcctaggacgggcgaacgacgacggccgtctattatgtgtagtagtagtttagnggtacgtagtcggcgtagggtaagacaggacgtcgacggtcggggaccgtaaaccggg

SEQ ID NO: 320402 - DNA, 584 bp, Homo sapiens
  misc_feature: GZ8MTXP02I21PM.19.67.G01.1.454.CMB.2.raw
  modified_base (517)..(517): a, c, t, g, unknown or other
  misc_feature (517)..(517): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccgaggggaagagggccggagtgggtcgcgaggttatttttagagggtggaccgacattcgtacggagactccagtgggagggccgattccaccatcctccagagtactttctacaagaacacactgtctacttacaaaatgaaacacgcctaggacggggaccgaaggacgacggccgtactatttagttgtggtgtaggtagtttaagngggacgtagtgggcgttggggtaaggacgaaggtactaccgacggtcgggggaccgaaacccggggg

SEQ ID NO: 320403 - DNA, 610 bp, Homo sapiens
  misc_feature: GZ8MTXP02H10WV.19.67.G01.1.454.CMB.2.raw
  modified_base (244)..(244): a, c, t, g, unknown or other
  misc_feature (244)..(244): n is a, c, g, or t
  modified_base (284)..(284): a, c, t, g, unknown or other
  misc_feature (284)..(284): n is a, c, g, or t
  modified_base (450)..(450): a, c, t, g, unknown or other
  misc_feature (450)..(450): n is a, c, g, or t
  modified_base (454)..(454): a, c, t, g, unknown or other
  misc_feature (454)..(454): n is a, c, g, or t
  modified_base (488)..(488): a, c, t, g, unknown or other
  misc_feature (488)..(488): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctggcggggacatcgtgatcgacccagtacccagactcactggctgtgtctcgtgggcgagacggccaacaatcaactgcaggtccagccagaactattttccnccacctaccaaagaaactaaaacttctagcctagaccaanagagacgagacagcctctaagttgctactatttacgtgggtcttctacgcgtacgtaagtttccggggcctggtaccccgacgttccggggctagggtcgggtcgtggggactagtactttccgacttcctacacctatccaagccgagcctgcgaggctgaaagntggnggtactagttttatacgtgtacagtactaatttnttttactactccttaccggtggtaccgttaccggacgtaacgggggaccgtaggggtaacgtaaaacgtcgaacggtaaccgaagttggtacgtaccgtcgacccaaccgtgtttaccgtcg

SEQ ID NO: 320404 - DNA, 575 bp, Homo sapiens
  misc_feature: GZ8MTXP02JLSWC.19.67.G01.1.454.CMB.2.raw
  modified_base (302)..(302): a, c, t, g, unknown or other
  misc_feature (302)..(302): n is a, c, g, or t
  modified_base (376)..(376): a, c, t, g, unknown or other
  misc_feature (376)..(376): n is a, c, g, or t
  modified_base (503)..(503): a, c, t, g, unknown or other
  misc_feature (503)..(503): n is a, c, g, or t
  modified_base (516)..(516): a, c, t, g, unknown or other
  misc_feature (516)..(516): n is a, c, g, or t
  modified_base (525)..(525): a, c, t, g, unknown or other
  misc_feature (525)..(525): n is a, c, g, or t
  modified_base (536)..(536): a, c, t, g, unknown or other
  misc_feature (536)..(536): n is a, c, g, or t
  modified_base (551)..(551): a, c, t, g, unknown or other
  misc_feature (551)..(551): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtcgaaccctcgtggggtctccggtcagcagcgactgtattgcctgggtccncagctcgagggagaggccggagtgggtcgcgaggttatttttagaggggtgggaccgactagttcgtacggganaaccgtccagtgggaggggcccgtaagttccgaacctatccctacccagtacgtacttttcactaagaaccacactgtcctacttacaaatgaaacagcctggacgggccgaggaccacggtccgtntattatgtgtagngtatttagnggctagtcggnttgggcgacagtacncgacggttcggggacgaaccgggg

SEQ ID NO: 320405 - DNA, 582 bp, Homo sapiens
  misc_feature: GZ8MTXP02GVC28.19.67.G01.1.454.CMB.2.raw
  modified_base (465)..(465): a, c, t, g, unknown or other
  misc_feature (465)..(465): n is a, c, g, or t
  modified_base (524)..(524): a, c, t, g, unknown or other
  misc_feature (524)..(524): n is a, c, g, or t
  modified_base (543)..(543): a, c, t, g, unknown or other
  misc_feature (543)..(543): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccaggcctggggcggtctctgagactgtcctgtcgaaccctcgtggggtctccgtcagcagcgactgtattcgcctgggtccgccaggctccgaggggaagaggccggaggtggggtcgcgtaggttatttttagagggtgggaccgtacattcgacggagactccagtgggacgggccgaattccaccatcctccagtacgtactttctacaagaacacactgtctacttacaaatgaaacncgctaggacggggaccgaggaccacgggcctacgtattagtgtgtaggagtagtttagnggtcgagttggcgttgggnggacacggtatacgtacggtcgggggacctaaccggggg

SEQ ID NO: 320406 - DNA, 597 bp, Homo sapiens
  misc_feature: GZ8MTXP02GVDMW.19.67.G01.1.454.CMB.2.raw
  modified_base (275)..(275): a, c, t, g, unknown or other
  misc_feature (275)..(275): n is a, c, g, or t
  modified_base (302)..(302): a, c, t, g, unknown or other
  misc_feature (302)..(302): n is a, c, g, or t
  modified_base (479)..(479): a, c, t, g, unknown or other
  misc_feature (479)..(479): n is a, c, g, or t
  modified_base (510)..(510): a, c, t, g, unknown or other
  misc_feature (510)..(510): n is a, c, g, or t
  modified_base (595)..(597): a, c, t, g, unknown or other
  misc_feature (595)..(597): n is a, c, g, or t
tcagtactctcgtgcacgaccggtgctcgatttagagtatacatattgggcttggtccagcctgggcggtctctgagactgtcctgtgaaccctctggggtctccgtcagcagcgactgtattgcctgggtccgccaggctccagggaagaggccggagtgggtcgcaggttatttttataggtgggacgacattctacggagactccatggagggccgattcaccatctccagagtacttttctcagaacacactgtctcttacaaaatgaacngcctggagggccgaggacacggccgtntattattgtgtgagtagtttagtggcgtatgggcttgggtggaacaggattccgaaccggtgggggacccaaggggaacccctggggtcccaccggttcctcctcgacgccctaccgaaccgaacgggccctagtccgtcccttcccccgtggcccgccctgccctccgagggaccnccgaccgtcgagacgccacgcggccggccgngggcctcgcgtcggacaacgtactaccgtacccgacggacgacgtacgacggacggccgggcacggaacgacggcgacagtacgnnn

SEQ ID NO: 320407 - DNA, 535 bp, Homo sapiens
  misc_feature: GZ8MTXP02IT41Z.19.67.G01.1.454.CMB.2.raw
  modified_base (261)..(261): a, c, t, g, unknown or other
  misc_feature (261)..(261): n is a, c, g, or t
  modified_base (414)..(414): a, c, t, g, unknown or other
  misc_feature (414)..(414): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctggggcggtctctgagactgtcctgtgaaccctntggggtctccgtcagcagcgactgtattgcctgggtccgccaggctccgagggaagaggccggagtgggtcgcaggtatttttagaggtgggaccgacattctacggagacttccagtgggagggccgattccacatctccagagtactttcncagacacactgtctctcaaatgaacagcctagagggccgaggacacggcgtctattatgtgtagagtagtttatggcgagtggcttgggtggacaggactcgacgtgggggaccaacgggg

SEQ ID NO: 320408 - DNA, 570 bp, Homo sapiens
  misc_feature: GZ8MTXP02GH3OE.19.67.G01.1.454.CMB.2.raw
  modified_base (324)..(324): a, c, t, g, unknown or other
  misc_feature (324)..(324): n is a, c, g, or t
  modified_base (364)..(364): a, c, t, g, unknown or other
  misc_feature (364)..(364): n is a, c, g, or t
  modified_base (519)..(519): a, c, t, g, unknown or other
  misc_feature (519)..(519): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtgggcggaggcttgggtccaggcctggggcggtctctgagactgtcctgtcgaccctcgtggggtctccgtcagcagcgactgtattgcctgggtccgccaggctccgagggaagnggccggagtgtgcgctaggttattttagaggtgggacganattcgacggagactccgatgggacgggccgattcgaccatcctccgaagtgtacttttcacaagaaccactactgtacctcttacaaagtgaacagcctagggacggccggaggacgacggccgtactattagttgtaggtgaggttagtttagngggtacgtacgtggtagtggggtgaacgagatcgacggtcggggaacccgg

SEQ ID NO: 320409 - DNA, 609 bp, Homo sapiens
  misc_feature: GZ8MTXP02HXQ5W.19.67.G01.1.454.CMB.2.raw
  modified_base (560)..(560): a, c, t, g, unknown or other
  misc_feature (560)..(560): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggagtgtccagtgtgaggtgcaactggtggagactgggcggaggcttgggccagccgtggggcggtctctgagactgtcctgtgaaccctcgtggggtctccgtcagcagcgactgtatgcctgggtccgcaggctccgagggacgaggccggagtgggtcgcgtaggtatttttagaggtgggacgacgattcgtacggagtcctccgaagttgggacggggtccgaagtttccaacccacttacctcccgaaggtacgtaacctttttctacgaacgaactacacttgtactactttacaaattcgaaacacgtacccgtaggacgggaccgtaacgggaccgaacgggtcccgtatagtttagtgtgtagagtagtttacgnggacgtagtgggtaacgttgggtagacgaggactcgaacggtccggggg

SEQ ID NO: 320410 - DNA, 626 bp, Homo sapiens
  misc_feature: GZ8MTXP02HYAJQ.19.67.G01.1.454.CMB.2.raw
  modified_base (209)..(209): a, c, t, g, unknown or other
  misc_feature (209)..(209): n is a, c, g, or t
  modified_base (243)..(243): a, c, t, g, unknown or other
  misc_feature (243)..(243): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctggcgggacatcgtgatcgacccagtacccagactcactggctgtgtctcgtgggcgagaccggccanaatcaactgcaggtccagccagaactattttccnccacctaccaaagaacctaaaaacttctagcctaggtaaccaacagacgaccaggacacgcctacctaagtcgctactatttacgtggtcttcgtacgcgacgtacgttccggggcctaggaccccgtagtccggggcagggtcggtcgtgggcagtattcactctcacatcagcacgccgtgacgagggtctaggaagtagtggtaggacttaaggttttacttacgttagtacagtacttaaatttactttttacttacgttccgttaccggttacggtacccggtttaccggaccggtaaagggggtacccgtaaggggttaacgaaacttacgaacggtaacgacgttggacggtctcgacctaaccgtacttccgtcg

SEQ ID NO: 320411 - DNA, 564 bp, Homo sapiens
  misc_feature: GZ8MTXP02GGU09.19.67.G01.1.454.CMB.2.raw
  modified_base (303)..(303): a, c, t, g, unknown or other
  misc_feature (303)..(303): n is a, c, g, or t
  modified_base (320)..(320): a, c, t, g, unknown or other
  misc_feature (320)..(320): n is a, c, g, or t
  modified_base (373)..(373): a, c, t, g, unknown or other
  misc_feature (373)..(373): n is a, c, g, or t
  modified_base (380)..(380): a, c, t, g, unknown or other
  misc_feature (380)..(380): n is a, c, g, or t
  modified_base (445)..(445): a, c, t, g, unknown or other
  misc_feature (445)..(445): n is a, c, g, or t
  modified_base (508)..(508): a, c, t, g, unknown or other
  misc_feature (508)..(508): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctgggcggtctctgagactgtcctgtcgaaccctcgtggggtctccggtcagcagcgactgtattgcctgggtccncaggctccgagggaagnggccggagtgggtcgctaggtatttttagagggtgggaccacattcgacgganaccttcngtggagggccattccacatctccagagtcttttcactagaacacactgtctctacaaatgaaacncgaccgtggacgggaccgaaggacgacggccgttatacgttattgtagtgagtagttttaggnggtacgtgtcggtcgtggtaaggacgagtacgtcgacggtacggggaccgaacggg

SEQ ID NO: 320412 - DNA, 579 bp, Homo sapiens
  misc_feature: GZ8MTXP02F28L3.19.67.G01.1.454.CMB.2.raw
  modified_base (286)..(286): a, c, t, g, unknown or other
  misc_feature (286)..(286): n is a, c, g, or t
  modified_base (297)..(297): a, c, t, g, unknown or other
  misc_feature (297)..(297): n is a, c, g, or t
  modified_base (522)..(522): a, c, t, g, unknown or other
  misc_feature (522)..(522): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtcgaaccctcgtggggtctccgtcagcagcgactntaggggggttnccgtgggtccgccaggctccgagggaagaggccggagtgggcgcgtaggttatttttagtaggtggaccgactattctacggagacctccagtgggagggccgattcaaccatcctaccagtacgtacttttctacaagaacacactgtcctacttacaaaatgaaacacgtcctaggagggccgaaggaccacggcctctattatgtagtgagtagtttacggnggtacgtagtcggtcgtgggtaagacgagtacgtacgacggtcggggaccgaacggg

SEQ ID NO: 320413 - DNA, 608 bp, Homo sapiens
  misc_feature: GZ8MTXP02JBMSG.19.67.G01.1.454.CMB.2.raw
  modified_base (297)..(297): a, c, t, g, unknown or other
  misc_feature (297)..(297): n is a, c, g, or t
  modified_base (312)..(312): a, c, t, g, unknown or other
  misc_feature (312)..(312): n is a, c, g, or t
  modified_base (378)..(378): a, c, t, g, unknown or other
  misc_feature (378)..(378): n is a, c, g, or t
  modified_base (462)..(462): a, c, t, g, unknown or other
  misc_feature (462)..(462): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctgtggggtctccgtcagcagcgactgtattgctggtccncaggctcgagggagnggcggagtgggtcgctaggttatttttagaggggtggggaccgtacattcgtaacgggatactccngtcgggagggccgtattccaactatcgtacccagacgtaccttttcacaagaacaccgatcgtactcttaccaaaatcgaaacncgactaggacgggaccgaaggaccgacggtccgtacttagttagtgtagtaggtagttaaggttagcgggtacggtaggtcggtacggtaggggtaacggaacgaacggtacgtacggtacgggtacgggggacccgtaaccgggg

SEQ ID NO: 320414 - DNA, 583 bp, Homo sapiens
  misc_feature: GZ8MTXP02I8ODQ.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctggggcggtctctgagactgtcctgtgaaccctcgtggggtctccgtcagcagcgactgtattgccgtgggtccgcaggctccgagggaagaggccgggagtggggtcgcgtaggttatttttagtagggtgggaccgactagttcgtacggagactcgagtgggagggccgattccacatcctaccagacgtactttcactaagaacacactgtctctacaaatagaaacacgcctggacgggccgaaggaccgacggtccgtacttaacttagttagtggtagtagtagtttagtgggcgtagtggtcgtgggtgacgaggactacgacggttcgggggaccgtaaccgggg

SEQ ID NO: 320415 - DNA, 598 bp, Homo sapiens
  misc_feature: GZ8MTXP02J2PKQ.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttcctgctgcaatttcaggaggtgtccagtgtgaggtgcaactgggtggagacgtgggcggaggcttggccaggcccgtggggcgtctcgtgagactgtcctgtcgaaccctcgtggggtctccgtcagcagcgactgtattcgccgtggtccgcaggctccgagggaagagggccggaggtgggtcgcgtaggttatttttagaggggtggaccgactagttcgaacggagacctcgagtgggacgggtccgattcgacctatcctaccaagtacgtactttcacagaacacactgtctactacaaatagaactagcctaggaccggggacgaacggacgaccggccgtcgttattagttggtgttaggaaggttgttaacgtggacgtagtcgggtcgtaggggtcgaagtagcgtacgacggtcgggggacgaaccgggg

SEQ ID NO: 320416 - DNA, 609 bp, Homo sapiens
  misc_feature: GZ8MTXP02FQCI3.19.67.G01.1.454.CMB.2.raw
  modified_base (552)..(552): a, c, t, g, unknown or other
  misc_feature (552)..(552): n is a, c, g, or t
  modified_base (571)..(571): a, c, t, g, unknown or other
  misc_feature (571)..(571): n is a, c, g, or t
  modified_base (578)..(578): a, c, t, g, unknown or other
  misc_feature (578)..(578): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactgggtggagactgggcggaggcttggtccagcctgggcggtctctgagactgtcctgtcgaaccctcgtggggtctccgtcagcagcgactgtattgccgtgggtccgccgaggcctccgaaggggaacggagggccgggaggtcggggtcgcgtagggtttatttttagaggggtgggacccgtacattcgtacggagacctccagtgggacggggccgattccaaccgtatcctaccagtacgtacctttttcacaagtaacactactgtactacttacaaatgaaacacgacctggaacggggccgaacgggacgaccggccgttacttattagttgtgtgagtagtttagngggtcgagtggcgttgggnggaacgngaacgtcgacggtcgggggacctaaacgggg

SEQ ID NO: 320417 - DNA, 574 bp, Homo sapiens
  misc_feature: GZ8MTXP02H2XKM.19.67.G01.1.454.CMB.2.raw
  modified_base (383)..(383): a, c, t, g, unknown or other
  misc_feature (383)..(383): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtgggcggaggcttgggtccagcctgggcggtctctgagactgtcctgtcgaaccctgtggggtctccgtcagcagcgactgtattgcctgggtccgccaggctccgaggggagaggccggagtgggtcgcgtaggttatttttagaggtgggaccgacagttcacggagactccgngtgggaggccgattccacatctaccagacgtacttttcacagaacacagtgtctcttacaaatgaaacacgtcctagacgggccgaaggaccgacggccgtctaagttacgtgtgtacgtaggtagttactgggtacgtagttcggagtgggtaaggtacgagactacggacggttacgggacgaaccggg

SEQ ID NO: 320418 - DNA, 603 bp, Homo sapiens
  misc_feature: GZ8MTXP02GLQLF.19.67.G01.1.454.CMB.2.raw
  modified_base (319)..(319): a, c, t, g, unknown or other
  misc_feature (319)..(319): n is a, c, g, or t
  modified_base (466)..(466): a, c, t, g, unknown or other
  misc_feature (466)..(466): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagccgtgggcgtctctgagactgtcctgtcgaccctcgtggggtctccgtcagcagcgactgtatgccgtggtccgccaggcctccgagggtaagnggccggaggtgggtcgcgaggttattttagagggtggaccgatagttcgtacggagtacctccgagtgggacgggccgtattccgaccagtcctccagtacgtacttttcactaagaccactactcgtctactttacaaatgaaacncgtccgtagggacggggaccgaacggaccgaccgggtaccgttctatttagttgtgtagtagtagtttacgtggtacgagtcggtcgtagggtggaactaggtacgtaccgacggtacgggggaccgtaaaccgggg

SEQ ID NO: 320419 - DNA, 558 bp, Homo sapiens
  misc_feature: GZ8MTXP02FK2ZU.19.67.G01.1.454.CMB.2.raw
  modified_base (506)..(506): a, c, t, g, unknown or other
  misc_feature (506)..(506): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttgggtccaggccgtggggcggtctctgagactgtcctgtcgaaccctctggggtctccgtcagcagcgactgtatgcctgggtccaccaggctccgagggaagaggccggagtgggtcgcgaggttatttttagaggtgggaccgtacattcgtacggagactccagtgggaggccgattcacatctccagacgtacttttctacaagaacacactgtctcttacaaatgaaacagccgtggacgggccgacggacgcggccgtctattattgtgtgagtagtttagnggtacgagtggctagggtggacaggtactcgacgtcgggggaccaacggggg

SEQ ID NO: 320420 - DNA, 583 bp, Homo sapiens
  misc_feature: GZ8MTXP02HZES8.19.67.G01.1.454.CMB.2.raw
  modified_base (494)..(494): a, c, t, g, unknown or other
  misc_feature (494)..(494): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtcgaaccctcgtgggtctccgtcagcagcgactgtattgccgtggtccgccacggctccgagggaaggaggcggaggtgggtcgcgtaggttagtttttagtaggtggagaccccctagttcgtacggagaccgtcgagtgggacggccgtacttcgaccatcctcagacgtactttctcaagaacacactgtctactacaaatagaacacgtcgtaggacgggacgacggacgacggcgtnttattagtgtagtgtagtagttagtggtacgtagtggcgttagggtaacggtacgtagtacgtacgacggtcggggaccgtaaccgggg

SEQ ID NO: 320421 - DNA, 644 bp, Homo sapiens
  misc_feature: GZ8MTXP02JK9CQ.19.67.G01.1.454.CMB.2.raw
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttcctgctgcaatttcaggaggtgtccagtgtgaggtgcaactggtggagactggcggaggcttggtccagcctgggcggtcgtctgagacgtgtcctgtgaaccctgtgggtctccgtcagcagcgactggtattgcctgggtccgcaggctccgagggaagacggccggaggtgggtcgcgtaggttatttttagagggttggggacactagtttccgaggacgactccaagtgggaacggggcctaatttccacctaactccttaccaaaggtacgtaactttttcgacaaggaaactaacacctagttcttacttacctaaaactaacgtaacgacgtacgtacggacgggaccggaacggaaccgtacggtaccgttacgttacgttagttacggttaggtaggtaagttaaggtttaacggtacggtacgtaggtaggtaacggtacggtacggtacgtacgtacgtacgtacggtacggg

SEQ ID NO: 320422 - DNA, 593 bp, Homo sapiens
  misc_feature: GZ8MTXP02HAP7O.19.67.G01.1.454.CMB.2.raw
  modified_base (281)..(281): a, c, t, g, unknown or other
  misc_feature (281)..(281): n is a, c, g, or t
  modified_base (502)..(502): a, c, t, g, unknown or other
  misc_feature (502)..(502): n is a, c, g, or t
  modified_base (565)..(565): a, c, t, g, unknown or other
  misc_feature (565)..(565): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttcctgctgcaatttcaggaggtgtccagtgtgaggtgcaacgtggtggagactgggcggaggcttggtccagccgtgggcggtctcgtgagactgtcctgtcgaaccctgtggggtctccgtnagcagcgactgtattgccgtgggtccgccgaggcctaccgaggggaacgacgggcccgggaggttcggggtccgacgtaaggtttacgtttttaagacggggttcgggacgtaactagtttcgtacgggatccgtccaagtggggacgggccgtattccgacctatcctaccagtacgtacctttcactacgaaccactactgtctactacaaatgaaacngcgagacggacgacggacgcgtctactattagtgtgtagtacgtagttagtcgacgtagtggngtggacgacgagtacgtcgacggtcggg

SEQ ID NO: 320423 - DNA, 618 bp, Homo sapiens
  misc_feature: GZ8MTXP02HUNS6.19.67.G01.1.454.CMB.2.raw
  modified_base (413)..(413): a, c, t, g, unknown or other
  misc_feature (413)..(413): n is a, c, g, or t
  modified_base (448)..(448): a, c, t, g, unknown or other
  misc_feature (448)..(448): n is a, c, g, or t
  modified_base (458)..(458): a, c, t, g, unknown or other
  misc_feature (458)..(458): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcgtctctgagactgtcctgtcgaaccctgtcggggtctccgtcagcagcgactgtatgcctgggtccgccaggctccgagggaagagggccggaggtgggtcgcgtaggttatttttagagggtgggaaccgacgtattcgtacggagacctaccagtgggaaggccgattccaccagtcnccagagtactttctcaagaacacactgtctcctanaaatgaaacncgtaccgtggacgggcccgaaggaccgacgggtacccgtacgttatttaagtcggttaggttacggaagttaggttttaacggcggtacgtacggtacgggtcgttagggaacggtacgtacggtacgtacggtacgggtacggggtacccggtaacggg

SEQ ID NO: 320424 - DNA, 582 bp, Homo sapiens
  misc_feature: GZ8MTXP02FU21X.19.67.G01.1.454.CMB.2.raw
  modified_base (293)..(293): a, c, t, g, unknown or other
  misc_feature (293)..(293): n is a, c, g, or t
  modified_base (455)..(455): a, c, t, g, unknown or other
  misc_feature (455)..(455): n is a, c, g, or t
tcagtactctcgtgcacgaccggtgctcgatttagagtatacatattgggtttggggggtagctcaggaagcagagcctggagcatctccactatggcctgggctccactacttctcaccctcctcgctcactgcacaggttcttgggccaactttatgctgactcagccccactctgtgtcggagtctccggggaagacggtaaccatctttgcacccacaacagtggcaacattgccagctaattttgtgcagtggtaccagcagcgcccgggcacgttcccccacattgngatctatgaggaataatacaaaagtaccgtcgtggggtccctgactcggttctcgtggcctccatccgacagcctcctccaaactctcgcccttccctcacccatcctctggaactgaaagactggaaggacgaggctagaactactactgtcagttcttancgaatcgccgtacggtcagtcggtggttccgttcggggacgggtaacggggaaccaagggtccttacggacccgttaccgtaagggtccaacggaccccgaaagggtccctccgccccccgttacgg

SEQ ID NO: 320425 - DNA, 590 bp, Homo sapiens
  misc_feature: GZ8MTXP02IY4K7.19.67.G01.1.454.CMB.2.raw
  modified_base (460)..(460): a, c, t, g, unknown or other
  misc_feature (460)..(460): n is a, c, g, or t
  modified_base (513)..(513): a, c, t, g, unknown or other
  misc_feature (513)..(513): n is a, c, g, or t
  modified_base (533)..(533): a, c, t, g, unknown or other
  misc_feature (533)..(533): n is a, c, g, or t
tcagtactctcgtgcacgaccggtgctcgatttagagtatacatattgggtttggggggagaggagcccagcactgggattccgaggtgtttccattcggtgctcagaactgaacacagaggactcaccatggagttttggctgacctgggttttccttgctgcaatttcaggaggtgtccagtgtgaggtgcaactggtggagactgggcggaggcttggtccagccgtgggcggtctctgagactgtcctgtcgaacccgtcgtggggtctccgtcagcagcgactgtattcgcctgggtcccgccaggctccgaggggaagacggccggaggtggggtcgcgaggtttatttttaagtaggtggggaccacgtattacgtacggacgacttcccgagtggggacgggcgtacttccaccatctacaagtagtaccttttcactacgaaacactactntctacttacaaatacgaactacgcctaggacgggccgaacgacgaccggcgtntattatgtatgagtagtttnacggtgattcgggcgtggagaacgtagacgtacgacggtacgggaccgtacggtacg

SEQ ID NO: 320426 - DNA, 582 bp, Homo sapiens
  misc_feature: GZ8MTXP02I85M5.19.67.G01.1.454.CMB.2.raw
  modified_base (528)..(528): a, c, t, g, unknown or other
  misc_feature (528)..(528): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttcctgctgcaatttcaggaggtgtccagtgtgaggtgcaactggtggagactgggcggaggcttggtccagcctggggcggtctctgagactgtcctgtgaaccctctggggtctccgtcagcagcgactgtattgcctgggtccgccaggctccgagggaagaggccggagtggggtcgcgtaggttatttttagagggttggggaccgtacattcgtacgggagaccttccgagtgggacggggccgagttcaaccatcctacccgagtagtacttttctacagtaaacactactgtctacttacaaatcgaaacagcctaggaggggaccgaaggaccgacggccgtactattattgtggtgagtagtttnagggtcagtcggcgtgggtgaacgagtacgtacgacgtcggggacctaacgggg

SEQ ID NO: 320427 - DNA, 597 bp, Homo sapiens
  misc_feature: GZ8MTXP02IOYP1.19.67.G01.1.454.CMB.2.raw
  modified_base (535)..(535): a, c, t, g, unknown or other
  misc_feature (535)..(535): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctgggcggtctctgagactgtcctgtcgaacccctgtggggtctccgtcagcagcgactgtattgcctggtccgcaggctccgagggaagaggccggagtggggtcgcgtaggttatttttagaaggggtggaaccgtactatttcgacggagaaccttccagtgggacgggtccgattccgaccatccaccagacgtactttcacagaacactactgtctacttacaaatgaaacagtcctaggacgggacccgaggaccgaacggtccgttactagtttatggttgtaggagttaaggtttacggnggtacgtagtcggtcgtagggtaacgaacgtagtacgtacgacggtacggggaccgtaacgg

SEQ ID NO: 320428 - DNA, 614 bp, Homo sapiens
  misc_feature: GZ8MTXP02G6VS5.19.67.G01.1.454.CMB.2.raw
  modified_base (258)..(258): a, c, t, g, unknown or other
  misc_feature (258)..(258): n is a, c, g, or t
  modified_base (296)..(296): a, c, t, g, unknown or other
  misc_feature (296)..(296): n is a, c, g, or t
  modified_base (460)..(460): a, c, t, g, unknown or other
  misc_feature (460)..(460): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcgtctctgagctgtcctgtcgaccctntggggtctccgtcagcagcgactgtattgcctggtccncaggctccgaggggagaggccggagtgggtcgcaggttatttttagagggttgggaccgtacagtttcgtaacgggagaccttccagtcggggagggccgtattccgacctatcctccagtacgtacttttcacagaacacactgtctcttacaaatcgaaacncgcctggacggggacccgagggaccgaacgggcccgttattaacgttagttggtagttcggaggttaaggttttagacgggtacgtagtcgggtcgtttaggggaaggaactaggtaacgttccgaacggttcgggggacccgtaaaccggggg

SEQ ID NO: 320429 - DNA, 534 bp, Homo sapiens
  misc_feature: GZ8MTXP02GLEPJ.19.67.G01.1.454.CMB.2.raw
  modified_base (303)..(303): a, c, t, g, unknown or other
  misc_feature (303)..(303): n is a, c, g, or t
  modified_base (518)..(518): a, c, t, g, unknown or other
  misc_feature (518)..(518): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagtttggctgacctgggttttcctgctgcaatttcaggaggtgtccagtgtgaggtgcaactgggtggagactgggcggaggcttgggtccagccgtgggcggtctctgagactgtcctgtgaaccctctggggtctccgtcagcagcgactgtatgcctggtccncaggctccagggagaggccggagtgggtcgcaggtatttttagaggttgggacgacattcgtacggagactccatggggaaggccgattccaccatcctcccagagtactttctacagaacacactgtctacttacaaatgaacagacctgacggccgaggacgacggccgtactattatgtgtgagtagttagtcgcgatggcgtggtacgganagatcgaagtccgggg

SEQ ID NO: 320430 - DNA, 567 bp, Homo sapiens
  misc_feature: GZ8MTXP02G0LWB.19.67.G01.1.454.CMB.2.raw
  modified_base (248)..(248): a, c, t, g, unknown or other
  misc_feature (248)..(248): n is a, c, g, or t
  modified_base (288)..(288): a, c, t, g, unknown or other
  misc_feature (288)..(288): n is a, c, g, or t
  modified_base (448)..(448): a, c, t, g, unknown or other
  misc_feature (448)..(448): n is a, c, g, or t
  modified_base (465)..(465): a, c, t, g, unknown or other
  misc_feature (465)..(465): n is a, c, g, or t
tcagtactctcgtgcacgaccggtgctcgatttagagtatacatattgggtttgggggtagctcaggaagcagagcctggagcatctccactatggcctgggctccactacttctcaccctcctcgctcactgcacaggttcttgggccaactttatgctgactcagccccactctgtgtcggagtctccggggaagacggtaaccatctttgcaccacaacagtgcaacattgccagctaattttgngcagtggtaccagcagcgcccggcacgttcccccacatgngatctatgagataaatcaaaagccgtgtcggggtccctgactcggttctcgtcggctccatcgacagcctcctccaaactctcgcccctccctcaccctatcctctggactgaaacgtactggaaggacgaggctacgactactactcgtcagttcttangtaatacggccgcggtntagtggtcggttacgttcggggacgggacgggaacctaaacggcgtacgtcccgttacgtaacgggtcaaccggcccgaaggtcctccggccccctttccgg

SEQ ID NO: 320431 - DNA, 569 bp, Homo sapiens
  misc_feature: GZ8MTXP02IMG46.19.67.G01.1.454.CMB.2.raw
  modified_base (379)..(379): a, c, t, g, unknown or other
  misc_feature (379)..(379): n is a, c, g, or t
  modified_base (384)..(384): a, c, t, g, unknown or other
  misc_feature (384)..(384): n is a, c, g, or t
  modified_base (419)..(419): a, c, t, g, unknown or other
  misc_feature (419)..(419): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagccgtgggcggtctctgagactgtcctgtcgaaccctctggggtctccgtcagcagcgactgtatgcctgggtccgccaggctccgaggggaagagggccggagtggggtcgctaggttatttttagagggtggaccgtacattcgtacgganactcngtgggaggccattccacatccacagagtactttcncaagaacacactgtctcttacaaatagaacacgctaggacgggacccgaggaccgacggccgtactattagtgtgtagagttagtttatgggacgtagtcggtctgggtaaggacgaggtactacgacggtcggggaccgtaaaccgggg

SEQ ID NO: 320432 - DNA, 590 bp, Homo sapiens
  misc_feature: GZ8MTXP02FYGDV.19.67.G01.1.454.CMB.2.raw
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccaggcctgggcggtctctgagactgtcctgtcgaaccctcgtggggtctccgtcagcagcgactgtattgccgtgggtccgccaggctccgaggggaagaggccgggagtggggtcgcgtaggttatttttagtagggtgggaccgactattcgtacggagacctccagtgggacggggccgattccgaaccatcctaccgagtacgtactttactacaagaacacaactgtctacttacaaatcgaaacacgacctggacggggaccgacggacgacggccgtactattagttgtgtagtagtagtttagtggtcgtagtggcgtgggtaagacgagtactcgacggtcggggaccgtaaccgggg

SEQ ID NO: 320433 - DNA, 556 bp, Homo sapiens
  misc_feature: GZ8MTXP02FFF19.19.67.G01.1.454.CMB.2.raw
  modified_base (422)..(422): a, c, t, g, unknown or other
  misc_feature (422)..(422): n is a, c, g, or t
  modified_base (490)..(490): a, c, t, g, unknown or other
  misc_feature (490)..(490): n is a, c, g, or t
  modified_base (504)..(504): a, c, t, g, unknown or other
  misc_feature (504)..(504): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtgagactggcggaggcttggccagcctgggcggtctctgagactgtcctgtgaaccctctggggtctccgtcagcagcgactgtattgcctgggtccgccaggctccgaggggaagaggccggagtggggtcgcgtagggttatttttagtagggtgggaccgacagttctacgggagacctccagtgggagggccgattcaccatctccagagtacttttcncagaacacactgtctacttcaaaatgaaacagcctggacgggccgaggaccacggccgtctatattgngtgagtagtttagnggcgagtcggcttgggtaaggacaggactcgacgtcgggggacccaacgggg

SEQ ID NO: 320434 - DNA, 548 bp, Homo sapiens
  misc_feature: GZ8MTXP02GWDAU.19.67.G01.1.454.CMB.2.raw
  modified_base (301)..(301): a, c, t, g, unknown or other
  misc_feature (301)..(301): n is a, c, g, or t
  modified_base (483)..(483): a, c, t, g, unknown or other
  misc_feature (483)..(483): n is a, c, g, or t
  modified_base (521)..(521): a, c, t, g, unknown or other
  misc_feature (521)..(521): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccaggcctgggcggtctctgagactgtcctgtgaaccctctggggtctccgtcagcagcgactgtattgcctgggtccncaggctccgagggaagaggccggagtgggtcgcgtaggtattttagtagggtggaccgacattctacggagacttccagtgggaggggccgattccacatcctccagtagtacttttctcaagaacacactagtctctacaaatgaaacagcctggacgggccgaggacacggcgtctattntgtgtagagtagtttatggcgagtggcgtgggtggaanagactcgacggtcggggcgaaccgggg

SEQ ID NO: 320435 - DNA, 575 bp, Homo sapiens
  misc_feature: GZ8MTXP02IAF3B.19.67.G01.1.454.CMB.2.raw
  modified_base (319)..(319): a, c, t, g, unknown or other
  misc_feature (319)..(319): n is a, c, g, or t
tcagtactctcgtgcacgaccggtgctcgatttagagtatacatattgggtttggggggagaggagcccagcactgggattccgaggtgtttccattcggtgctcagcactgaacacagaggactcactatggagttttggctgacctgggttttccttgctgcaatttcaggaggtgtccagtgtgaggtgcaactggtggagactggcggaggcttggtccagccgtgggcggtctctgagactgtcctgtgaaccctcgtggggtctccgtcagcagcgactgtatgcctgggtccgccaggctccgaggggaagnggccggaggtggggtcgcgtaggtatttttaagagggtgggaccgactagtttctacgggagacctcccgagtggggagggccgattccaccatccacccgagacgtactttcacagaacacactgtctacttacaaaattgaaacagcctagggacgggaccgaggaccgacgggtcccgtattagttatgtagtgagttggttaatggacgagtggcgtggtggacagatacgacggtcggggacctaacgggg

SEQ ID NO: 320436 - DNA, 667 bp, Homo sapiens
  misc_feature: GZ8MTXP02J0Y8D.19.67.G01.1.454.CMB.2.raw
  modified_base (314)..(314): a, c, t, g, unknown or other
  misc_feature (314)..(314): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttcctgctgcaatttcaggaggtgtccagtgtgaggtgcaactggtggagactggcggaggcttggtccagccgtgggcgtctctgagctgtcctgtcgaccctgtggggtctccgtcagcagcgactgtattgacctggtccgcaggctccgagggaagnggccggaggtgggcgcgtaggttatttttagagggtcgggtaccgactagtttcgacggagaccttcgagtgggacgggtccgattccgacctactctacccgagtacgtaccttttcgacgaacaactacctaacgttcgttaccttactttaccaaaagttcgaaaccacggtacccgtagggacgggggacccgaagggacccgaacgggtcccggttactaacgtttagttcggtaggttaccggtaagttaggtttaggcggtaccggtagtcggggtaccgtttgggggaaggtaaccgtaggtaccttaccggaaaccggttccgggggaaccgtaaacccggggg

SEQ ID NO: 320437 - DNA, 748 bp, Homo sapiens
  misc_feature: GZ8MTXP02I92VY.19.67.G01.1.454.CMB.2.raw
  modified_base (275)..(275): a, c, t, g, unknown or other
  misc_feature (275)..(275): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagactggcggaggcttggtccagcctggggcggtctctgagactgtcctgtcgaccctcgtggggtcnccgtcagcagcgactgtattggccgtgggtccgccgaggcctacccgaaggggaagacggggcccgggaggtggggtccgacgtaggtttatttttagaggggtcgggaacgtacgtagttaccgtaacgggacgaccgtccgaaaggtcgggggaacgggggtcccctaaaggtttacccaaaccctaacttccgtacccgtaaaggtacggtttaacccttttttccaacgtaacggaaacctaacccttaaccgttcggttaccttaccctttaataaaacgttacgtaaaaccgacggtaccccgttagggaaccgggggacccggaaggggaacccgaaccggggtacccgttaaccgtttaagttaccggtttacggttaggttaggtaacggtaaggtttaagtccgggtacggtaagtgggtcgtagggttacggaccgtagacgttacggacggtacccggggg

SEQ ID NO: 320438 - DNA, 605 bp, Homo sapiens
  misc_feature: GZ8MTXP02I2O3Z.19.67.G01.1.454.CMB.2.raw
  modified_base (308)..(308): a, c, t, g, unknown or other
  misc_feature (308)..(308): n is a, c, g, or t
  modified_base (327)..(327): a, c, t, g, unknown or other
  misc_feature (327)..(327): n is a, c, g, or t
  modified_base (382)..(382): a, c, t, g, unknown or other
  misc_feature (382)..(382): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggtagttttggctgaccttgggttttccttgctgctaatttcgaggaggtgtccagtgtgaggtgcaacgtggtggagacgtgggcggaggcttggtccaggccgtgggcggtctcgtgagactgtcctgtcgaccctgtggggtctccgtcagcagcgactgtatgccgtggtccncgaggctccgaagggaagnggccggaggtgggtcgctaggttattttagagggtggacgactagttcgacgganactcagtgggacggccgtattccgacctatcctaccgagtacgtacttttcacaagaacactactgtctacttaacaaaatgaaacacgtaccgtagggacgggaccgaacggaccgaccggtcgtacttattagtttagtggtagtaggtagtttagtggtacgtagtcggtcgtagggtaaggaactaggtacgtcgtacggtcggggaccgtaaccgggg

SEQ ID NO: 320439 - DNA, 572 bp, Homo sapiens
  misc_feature: GZ8MTXP02GJI9A.19.67.G01.1.454.CMB.2.raw
  modified_base (455)..(455): a, c, t, g, unknown or other
  misc_feature (455)..(455): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccaggcctggggcggtctctgagactgtcctgtcgaaccctcgtggggtctccgtcagcagcgactgtattgcctgggtccgccaggctccgagggaagaggccggagtggggtcgcgtaggtatttttagaggtgggaccgactattcgtacggagacctcagtgggaggggccgattccgacatctccagagtactttctcagaacacactgtctacttacaaatgaaacngccgtaggacggggaccgaggaccgacgggccgtacttattagttgtgtgaggtagtttagtgggtcgtagtggcgtagggtgacgagactcgaacggtcggggaccgtaaccgggg

SEQ ID NO: 320440 - DNA, 540 bp, Homo sapiens
  misc_feature: GZ8MTXP02J3LDV.19.67.G01.1.454.CMB.2.raw
  modified_base (321)..(321): a, c, t, g, unknown or other
  misc_feature (321)..(321): n is a, c, g, or t
  modified_base (426)..(426): a, c, t, g, unknown or other
  misc_feature (426)..(426): n is a, c, g, or t
  modified_base (517)..(517): a, c, t, g, unknown or other
  misc_feature (517)..(517): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttgggtccagcctgggcgtctctgagactgtcctgtcgaccctcgtgggtctccggtcagcagcgactgtatgcctgggtccgcaggctccgagggaagnggccggagtgggcgcgtaggttattttagagggtgggacgacagttcgacggagcctccgaagtgggagggccgtaattccaccatcctacagacgtacttttcnctagaacacactgtctacttacaaatgaacagccgtgacggccgaggacacgggcctctagttattgtgtgagtagtttagcgcgagtggngtggacgacagactcgacggcgg

SEQ ID NO: 320441 - DNA, 566 bp, Homo sapiens
  misc_feature: GZ8MTXP02GG51G.19.67.G01.1.454.CMB.2.raw
  modified_base (302)..(302): a, c, t, g, unknown or other
  misc_feature (302)..(302): n is a, c, g, or t
  modified_base (362)..(362): a, c, t, g, unknown or other
  misc_feature (362)..(362): n is a, c, g, or t
  modified_base (373)..(373): a, c, t, g, unknown or other
  misc_feature (373)..(373): n is a, c, g, or t
  modified_base (449)..(449): a, c, t, g, unknown or other
  misc_feature (449)..(449): n is a, c, g, or t
  modified_base (515)..(515): a, c, t, g, unknown or other
  misc_feature (515)..(515): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttgggtccaggcctgggcggtctctgagactgtcctgtcgaaccctcgtggggtctccgtcagcagcgactgtatgcctggtccnccaggctccgaagggagaggccggagtgggtcgcgtaggtatttttagaggtgggaccanattcgacgganactcagtggaggccgatccacatctacagtagtacttttcacaagacacgtactgtcctacttacaaattgaaacngtccgtaggacggggaccgaagggaccacggggccttctagttagtgtgtcggtagtagtttaggnggacgtagtcggtgtgggtgaacgacgtcgtacgacggtcgggaccgacgg

SEQ ID NO: 320442 - DNA, 530 bp, Homo sapiens
  misc_feature: GZ8MTXP02HD1T5.19.67.G01.1.454.CMB.2.raw
  modified_base (298)..(298): a, c, t, g, unknown or other
  misc_feature (298)..(298): n is a, c, g, or t
  modified_base (422)..(422): a, c, t, g, unknown or other
  misc_feature (422)..(422): n is a, c, g, or t
  modified_base (435)..(435): a, c, t, g, unknown or other
  misc_feature (435)..(435): n is a, c, g, or t
  modified_base (441)..(441): a, c, t, g, unknown or other
  misc_feature (441)..(441): n is a, c, g, or t
  modified_base (444)..(444): a, c, t, g, unknown or other
  misc_feature (444)..(444): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtatgcctgggtccnccaggctccgagggaagaggccggagtgggtcgcaggtatttttagagggtggacgactattctacggagactcatggagggccattcacatctaccagagtacttttcacagaaacacacttntctctacaaatanaacacncgngaggacgacgacgacgcgtctattatgtgtagagtagttagtgcgagtgtgtggtaaggacgagacgtacgacgtacggacgacgg

SEQ ID NO: 320443 - DNA, 596 bp, Homo sapiens
  misc_feature: GZ8MTXP02HNX49.19.67.G01.1.454.CMB.2.raw
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgaccttgggttttccttgctgcaatttcaggaggtgtccagtgtgaggtgcaactggtggagacgtgggcggaggcttgggtccagccgtggggcggttctcgtgagactgtcctgtcgaaccctcgtgggtctccgtcagcagcgactgtatgccgtggtccgcaggctaccgagggaagaggccggaggtgggtcgcgtaggttatttttagagggtacgggactacgtattcgtaacggagcctccagtgggacggccgtatcaccatcaccagacgtactttcacaagaacacactcgtctacttacaaatacgaacacgccgtaggacgggaccggaacggaccgaacggtcccgttacgttagttaagtttcgtggtagtaacgttagttacgtggacgtagtggaacgttgggaggacgagacgtaccgtacggtaccgggg

SEQ ID NO: 320444 - DNA, 571 bp, Homo sapiens
  misc_feature: GZ8MTXP02JPS7M.19.67.G01.1.454.CMB.2.raw
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcgggaggcttggtccaggcctgggcggtctctgagactgtcctgtgaaccctcgtggggtctccgtcagcagcgactgtatgcctgggtccgccaggctccgaggggaagaggcccgggaggtgggtcgacgtaggttatttttagagggttgggacgactattcgtacggagacctccgattgggagggccgtagttccaccatctccagagtactttcacacgaacacactgtcttcttacaaatgaactgccgtaggacggcgacggacgacggccgtacgtattagttgtgtgtagtagtttagtggcgtagtcggtgtgggtaggacgagtacgttacgacggtaccggggg

SEQ ID NO: 320445 - DNA, 650 bp, Homo sapiens
  misc_feature: GZ8MTXP02H52VY.19.67.G01.1.454.CMB.2.raw
  modified_base (400)..(400): a, c, t, g, unknown or other
  misc_feature (400)..(400): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgaccttgggttttccttgctgcaatttcaggaggtgtccagtgtgaggtgcaacgtggtggagacgtgggcggaggcttggtccagccgtggggcgtctcgtgagtactgtcctgtcgaacccctcgtggggtctccgtcagcagcgactgtattgccgtgggtccgccgaggcctccgaaggggaaggaggccgggaggtgggtcgcgtaggttagtttttagagggtggaccgacagtttcaacggagacctcgngtagggacggaccgtactaccgacctactccctaccgagtaccgtttactttccacaacgtaaacctacctacttcgttacttacttaactaaactaacgaaccacgtacgtagggacgggaccggacggaccgaccggtaccgtacgttagttgttagtggtagtaggttagttcggtcgggtacgtagtcggttacggtggtaacggtagacgtacgtacgacgggtacgggtaaccggtaacccggg

SEQ ID NO: 320446 - DNA, 581 bp, Homo sapiens
  misc_feature: GZ8MTXP02FZ7VF.19.67.G01.1.454.CMB.2.raw
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtgggcgggaggcttgggtccagcctggggcgtctctgagctgtcctgtgaaccctcgtggggtctcgtcagcagcgactgtatgcctggtccgccaggctccgagggagaggccggagtcgggtcgacgtaggttatttttagaggtgggacgagtattcgtacggagacctccgaagtgggacggggccgtattccgaccatcctacccagtacgtacttttacacgtaacgaactacactacgtcttaccttacaaatacgaacacgtaccgtagacgggccgaggaccgaaccggccgtatacgttagttcgtgtagagtgtttaagtggtcgagtggcgtggtcgacgagactcgacgtcggggg

SEQ ID NO: 320447 - DNA, 547 bp, Homo sapiens
  misc_feature: GZ8MTXP02FSK9A.19.67.G01.1.454.CMB.2.raw
  modified_base (257)..(257): a, c, t, g, unknown or other
  misc_feature (257)..(257): n is a, c, g, or t
  modified_base (273)..(273): a, c, t, g, unknown or other
  misc_feature (273)..(273): n is a, c, g, or t
  modified_base (296)..(296): a, c, t, g, unknown or other
  misc_feature (296)..(296): n is a, c, g, or t
  modified_base (298)..(298): a, c, t, g, unknown or other
  misc_feature (298)..(298): n is a, c, g, or t
  modified_base (315)..(315): a, c, t, g, unknown or other
  misc_feature (315)..(315): n is a, c, g, or t
  modified_base (322)..(322): a, c, t, g, unknown or other
  misc_feature (322)..(322): n is a, c, g, or t
  modified_base (356)..(356): a, c, t, g, unknown or other
  misc_feature (356)..(356): n is a, c, g, or t
  modified_base (363)..(363): a, c, t, g, unknown or other
  misc_feature (363)..(363): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcgtcgtctgagactgcctgtgacctntgggggtctcccggtnagcagcgatgtatcgcgtggccncngcacgaggagcggcggngtggcgngtaggttatttagaggtggacatagtcgacgganacctcgnggtgggacggtcctattccaactatcctacgagtacttactttcacgaagaacacactctctactactaatacgacgacgacgtacgacgggacggacgacgacgtacgtacgtattagtgtgtagtagtagttagtgtcgtagtcgtgtggtggacgacgacgtacgacgtacggacggacgg

SEQ ID NO: 320448 - DNA, 615 bp, Homo sapiens
  misc_feature: GZ8MTXP02GHOMZ.19.67.G01.1.454.CMB.2.raw
  modified_base (480)..(480): a, c, t, g, unknown or other
  misc_feature (480)..(480): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttgggtccaggcctggggcggtctcgtgagactgtcctgtcgaaccctcgtggggtctccgtcagcagcgactgtatgcctgggtccgccaggctccgaggggaagacgggccgggaggtggggtcgcgtaggttatttttagtaggggtgggaccgtacagtttcgacgggagacttccgagtgggacggggccgattaccgacctactctccagacgttacttttcacagaaacactactgtctacttacaaatgaaacncgtacctggacggggaccgaaggaccgacgggccgttacgtattagttgtgttaggagttaggtttgtaggcgtagtcgggtcgtgggtaagggtacaggtactccgtaacggtcgggggacccgtaaaccgggg

SEQ ID NO: 320449 - DNA, 591 bp, Homo sapiens
  misc_feature: GZ8MTXP02HCG2T.19.67.G01.1.454.CMB.2.raw
  modified_base (300)..(300): a, c, t, g, unknown or other
  misc_feature (300)..(300): n is a, c, g, or t
  modified_base (449)..(449): a, c, t, g, unknown or other
  misc_feature (449)..(449): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtgggcggaggcttggtccagccgtgggcggtctctgagactgtcctgtcgaccctgtggggtctccgtcagcagcgactgtatgcctggtccncaggctccgagggagaggccggagtgggtcgcgtaggttatttttagagggtgggaccgactattcgtacggagacctccgagtgggacgggccgtattccacatcctaccagagtacttttcacagaacacactgtctcttacaaatnaaacacgcctaggacgggaccgaacggacgaccgggtccgtacgttattagttggtagtacggaggttagttttacgagggacgtagtcgggtcgtagggtggactaggtacgtacgacggtcggggaccgtaaacccgggg

SEQ ID NO: 320450 - DNA, 514 bp, Homo sapiens
  misc_feature: GZ8MTXP02HSQ9F.19.67.G01.1.454.CMB.2.raw
  modified_base (432)..(432): a, c, t, g, unknown or other
  misc_feature (432)..(432): n is a, c, g, or t
tcagtactctcgtgcacgaccggtgctcgatttagagtatacatattgggtttgggggtagctcaggaagcagagcctggagcatctccactatggtctgggctccactacttctcaccctcctcgctcactgcacaggttcttgggccaactttatgctgactcagcccactctgtgtcggagtctccggggaagacggtaaccatcttttgcaccacaacagtgcaacattgccagcaattttgtgcagtggtaccagcagcgcccgggcacgttcccccaccattgtgatctatgaggataatcaaaagacgtctggggtccctgatcggttctctcggctccatcgacacgctcctccaactctcgccctccctcacccatctctgactgaagactgaggacgaggctgactactactgtcagtctangatagccgtggtcagtgtggtcgttcgggcggacggaccaagctcgaccgtctaaggtcacgcccaaggcctcgcccctcgg

SEQ ID NO: 320451 - DNA, 547 bp, Homo sapiens
  misc_feature: GZ8MTXP02JU01B.19.67.G01.1.454.CMB.2.raw
  modified_base (422)..(422): a, c, t, g, unknown or other
  misc_feature (422)..(422): n is a, c, g, or t
  modified_base (514)..(514): a, c, t, g, unknown or other
  misc_feature (514)..(514): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctgggcgtctctgagactgtcctgtgaaccctctggggtctccgtcagcagcgactgtatgcctgggtccgcaggctccgagggagaggccggaggtgggtcgcgaggtatttttagagggtggggacgactattcgtacggagacctccaagtcggagggcccgattcaccatctccgagagtactttcncagaacacactgtctcttacaaattgaaacagcctaggacgggacccgagggacctacgggccgttctaattacttggtgtgagtagtttancggcgatggctaggtgacagatcgacgtcgggg

SEQ ID NO: 320452 - DNA, 626 bp, Homo sapiens
  misc_feature: GZ8MTXP02FUJXH.19.67.G01.1.454.CMB.2.raw
  modified_base (239)..(239): a, c, t, g, unknown or other
  misc_feature (239)..(239): n is a, c, g, or t
  modified_base (452)..(452): a, c, t, g, unknown or other
  misc_feature (452)..(452): n is a, c, g, or t
  modified_base (494)..(494): a, c, t, g, unknown or other
  misc_feature (494)..(494): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctcgtgggcgagacggccacaatcaactgcaggtccagccagaactatttcnccacctaccaaagaaactaaaacttctagcctaggtaaccaacagacgaccaggacagccctacctaagttgctactatttacgtgggtcctttcgtacgcgacgtaaacgttccggggtacccctggacccccgtacgttcccggggcacggtcgggtcgtggggacagtactttcacctctacaccatcagcagcctgcaggctagaagtntggtggacttaagtttattacgtgtacaagtacttaaatttntttttacttactcccgtccggttaggtaccgttacggaccgtaaacggggaccgtaagggggtacgtaaaactaccgaaacgtaaccggtaaacgtcggtggaccgtacggaccctaccgtatttcgttacg

SEQ ID NO: 320453 - DNA, 561 bp, Homo sapiens
  misc_feature: GZ8MTXP02GZPEG.19.67.G01.1.454.CMB.2.raw
  modified_base (321)..(321): a, c, t, g, unknown or other
  misc_feature (321)..(321): n is a, c, g, or t
  modified_base (379)..(379): a, c, t, g, unknown or other
  misc_feature (379)..(379): n is a, c, g, or t
  modified_base (408)..(408): a, c, t, g, unknown or other
  misc_feature (408)..(408): n is a, c, g, or t
  modified_base (496)..(496): a, c, t, g, unknown or other
  misc_feature (496)..(496): n is a, c, g, or t
  modified_base (532)..(532): a, c, t, g, unknown or other
  misc_feature (532)..(532): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctcggttttccttgctgcaatttcaggaggtgtccagtgtgaggtgcaactggtggagactgggcggaggcttggtccagccgtgggcgtctctgagactgtcctgtcgaaccctcgtgggtctccgtcagcagcgactgtatgcctgggtccgcaggctccgagggaagnggccggagtgggtcgcgtaggttatttttagagggtgggacgactagttcgacgggancctccagtgggacggccgtattccgaccnctctacccagtacgtacttttcacagaacactactgtctcttacaaatgaacagtcccgtggacgggaccgaggacgacggtcccgtntattagtgtgtagagtagttagcggacgtagtcggngtgggtacgactagactcgacggtcgggg

SEQ ID NO: 320454 - DNA, 535 bp, Homo sapiens
  misc_feature: GZ8MTXP02FO96L.19.67.G01.1.454.CMB.2.raw
  modified_base (237)..(237): a, c, t, g, unknown or other
  misc_feature (237)..(237): n is a, c, g, or t
  modified_base (417)..(417): a, c, t, g, unknown or other
  misc_feature (417)..(417): n is a, c, g, or t
  modified_base (420)..(420): a, c, t, g, unknown or other
  misc_feature (420)..(420): n is a, c, g, or t
  modified_base (449)..(449): a, c, t, g, unknown or other
  misc_feature (449)..(449): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacatttcnccacctcaagaacaaaacttctagcctggtaccaacagagaccaggacagcctcctaagttgctcatttactgggcttcacgcgacgaattcggggtccctgaccccgagttccggggcaggcgggtctggggacagtactttccactctacaccatcagcagcctgcaggctagaaagntgngctagtttatacgtgtcagactaaatttntttttctatccgtcgtgtacgttcgaccgaagggaccagggtagaaactcgaagacgaaacgtggtacggctcgacaccatcgtcg

SEQ ID NO: 320455 - DNA, 586 bp, Homo sapiens
  misc_feature: GZ8MTXP02IO55J.19.67.G01.1.454.CMB.2.raw
  modified_base (281)..(281): a, c, t, g, unknown or other
  misc_feature (281)..(281): n is a, c, g, or t
  modified_base (324)..(324): a, c, t, g, unknown or other
  misc_feature (324)..(324): n is a, c, g, or t
  modified_base (339)..(339): a, c, t, g, unknown or other
  misc_feature (339)..(339): n is a, c, g, or t
  modified_base (383)..(383): a, c, t, g, unknown or other
  misc_feature (383)..(383): n is a, c, g, or t
  modified_base (439)..(439): a, c, t, g, unknown or other
  misc_feature (439)..(439): n is a, c, g, or t
  modified_base (447)..(447): a, c, t, g, unknown or other
  misc_feature (447)..(447): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagtttggctgacctgggttttcctgctgcaatttcaggaggtgtccagtggtgaggtgcaacgtggtggagactgggcggaggcttgggtccagccgtgggcggtctcgtgagctgtcctgtcgaccctgtggggtctccgtanagcagcgatgtatgccgtggtaccgcaggctaccgagggaagnggccggagtgggtcncgtaggtatttttagaccgggtaggacgactagttcaacggganccttccgaattggggaacgggcctattccacacttcaccagacgtactttcacganaaacaccntactcttaccttagaaatacgaacatccgagacgggccgtaaggccgaacggcccggtactaagttagtggtgaccgtaggtaccgtttagtccggacgtgtcggggcgtcggtacggacgagacgtacgtacggacgg

SEQ ID NO: 320456 - DNA, 605 bp, Homo sapiens
  misc_feature: GZ8MTXP02F8FKN.19.67.G01.1.454.CMB.2.raw
  modified_base (570)..(570): a, c, t, g, unknown or other
  misc_feature (570)..(570): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccgagggaaggaggccggagtgggtcgcgaggtatttttagaggtgggacgagtattcgtacggagtcctccagtggggacgggccgagttcaccatctccagagtactttctacagaacacaactcgtcttcttaccaaaattcgaaacacgtacccgttaggaccggggcccggaaagggaaccgaaccggggcccgttaccgttaatttaacgttacggttggtaggtacggtaagtttacgtcggcgtaagtgggngtagggtggaacaggtacgtcgaacggtccggggg

SEQ ID NO: 320457 - DNA, 591 bp, Homo sapiens
  misc_feature: GZ8MTXP02FQHBZ.19.67.G01.1.454.CMB.2.raw
  modified_base (323)..(323): a, c, t, g, unknown or other
  misc_feature (323)..(323): n is a, c, g, or t
  modified_base (365)..(365): a, c, t, g, unknown or other
  misc_feature (365)..(365): n is a, c, g, or t
tcagtactctcgtgcacgaccggtgctcgatttagagtatacatattgggtttgggggtagctcaggaagcagagcctggagcatctccactatggcctgggctccactacttctcaccctcctcgctcactgcacaggttcttgggccaactttatgctgactcagccccactctgtgtcggagtcgtccggggaagacggtaaccatcttttgcacccacaacagtggcaacattgccagctaattttgtgcagtggtaccagcagcgcccgggcacgttcccccacattgtgatctatgaggataaatcaaaagaccgtntcggggtccctgatcggttctctcggctcatcgacagctccnccaactctgccctcctcaccatctctggactgaaagctgacggacgaggctagactaactacgtgtcagttacttatgaattacggcccgtgggttcaagttggttcgggttcgttaccggggcgggtaaacgggaccccgaaaggtccgttacggaaccccgtttcgtaacggggttaccaacggacccaaacggggtcccttcggggccccccctttaacgggg

SEQ ID NO: 320458 - DNA, 593 bp, Homo sapiens
  misc_feature: GZ8MTXP02IEIDG.19.67.G01.1.454.CMB.2.raw
  modified_base (280)..(280): a, c, t, g, unknown or other
  misc_feature (280)..(280): n is a, c, g, or t
  modified_base (307)..(307): a, c, t, g, unknown or other
  misc_feature (307)..(307): n is a, c, g, or t
  modified_base (346)..(346): a, c, t, g, unknown or other
  misc_feature (346)..(346): n is a, c, g, or t
  modified_base (448)..(448): a, c, t, g, unknown or other
  misc_feature (448)..(448): n is a, c, g, or t
  modified_base (479)..(479): a, c, t, g, unknown or other
  misc_feature (479)..(479): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactgggtggagacgtgggcggaggcttggtccaggccgtgggcggtctcgtgagtactgtcctgtcgaaccctcgtgggtctcgtnagcagcgactgtatcgccgtgggtccnccgaggcctccgaaggggaagcggccggagtggggtcgngtaggtttattttagaggtggaccgactagttcgacggagacctcagtcgggacggccgtattccaccgtatcctccgagacgttactttctacagaaaccnctactgtacctactacaaatgaaacagtcgnggacgggccgaggacgacggcgtacttatagttgtgtagtagttagttagtggacgtagtcggtgtagggtaacgacgagtacgtacgtacggtacggggtaccgtaaccgggg

SEQ ID NO: 320459 - DNA, 548 bp, Homo sapiens
  misc_feature: GZ8MTXP02IOSQS.19.67.G01.1.454.CMB.2.raw
  modified_base (299)..(299): a, c, t, g, unknown or other
  misc_feature (299)..(299): n is a, c, g, or t
  modified_base (424)..(424): a, c, t, g, unknown or other
  misc_feature (424)..(424): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactgggtggagactgggcggaggcttggccagcctggggcgtctctgagactgtcctgtcgaccctctgggtctccgtcagcagcgactgtatgcctgggtccnccaggctccgaggggaagaggccggaggtgggtcgcagggttattttagaggtggaccgacattcacggagactccagtggagggccgattccgacatcctaccagagtactttctacagaaacncactgtactctacaaatgaaacagcctggagggccgaggaccacggctctattagtgtgtagagttagttagtggacgtagtcggtctggtggacaggactcgacgtcgggggacctaacgggg

SEQ ID NO: 320460 - DNA, 547 bp, Homo sapiens
  misc_feature: GZ8MTXP02I5GO8.19.67.G01.1.454.CMB.2.raw
  modified_base (411)..(411): a, c, t, g, unknown or other
  misc_feature (411)..(411): n is a, c, g, or t
  modified_base (418)..(418): a, c, t, g, unknown or other
  misc_feature (418)..(418): n is a, c, g, or t
  modified_base (438)..(438): a, c, t, g, unknown or other
  misc_feature (438)..(438): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttcctgctgcaatttcaggaggtgtccagtgtgaggtgcaactggtggagactggcggaggcttggtccaggcctgggcgtctctgagactgtcctgtgaccctctgggtctcgtcagcagcgactgtatgcctgggtccgccaggctccgagggagaggccggagtggggtcgcgaggtatttttagagggttgggaccgacattctacgggagacttccagtgggagggccgattccacatctccagagactttcncagaacncactgtctctacaatgaacncgctaggacgggaccgagacgacggctactattatgtgtagagttagtagtggacgtagtggtcgtagggtaacgacgagtactccgaggtcggggaccgtaaccgggg

SEQ ID NO: 320461 - DNA, 551 bp, Homo sapiens
  misc_feature: GZ8MTXP02GITEI.19.67.G01.1.454.CMB.2.raw
  modified_base (417)..(417): a, c, t, g, unknown or other
  misc_feature (417)..(417): n is a, c, g, or t
  modified_base (484)..(484): a, c, t, g, unknown or other
  misc_feature (484)..(484): n is a, c, g, or t
  modified_base (498)..(498): a, c, t, g, unknown or other
  misc_feature (498)..(498): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtatgcctggtccgccaggctccgaggggaagaggccggagtgggtcgcgaggttattttagaggtgggaccgactattctacgggagactccagtgggagggccgattccgacatctccagtagtacttttcncagaacacactgtctacttacaaatagaacagcctaggagggccgagacacggctcgtattagttgngtgagtagtttagnggtcgagtgggcgtgggtggacgagtacgtcgacggtcgggaccgtaacgggg

SEQ ID NO: 320462 - DNA, 544 bp, Homo sapiens
  misc_feature: GZ8MTXP02FGV31.19.67.G01.1.454.CMB.2.raw
  modified_base (417)..(417): a, c, t, g, unknown or other
  misc_feature (417)..(417): n is a, c, g, or t
  modified_base (448)..(448): a, c, t, g, unknown or other
  misc_feature (448)..(448): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtcgtctgagacgtgtcctgtgaccctgtgggtctccgtcagcagcgactgtattgcctggtccgccaggctccgaggggaagaggccggagtgggtcgcgagggttatttttagaggtgggaccgacattctacggagactccgatcgggagggccattcaaccatctccagagtacttttcncaagaacacactgtctcttacaaatgaaacncgcgagacggacgacgacgacgcgtctattagtgtgtagtagtagttagtgcgagtcgcgtggtggacgacgacgtacgacggtcgggacggacgg

SEQ ID NO: 320463 - DNA, 786 bp, Homo sapiens
  misc_feature: GZ8MTXP02GFNS9.19.67.G01.1.454.CMB.2.raw
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtgggcggaggcttggtccaggccgtgggcgtctctgagctgtcctgtcgaaccctgtgggtctccgtcagcagcgactgtattcgcctgggtccgccgagctccgagggaagcggccgggagtggggtcgcgtaggttacgtttttagacggggtaggggaccgtaacgtactttcgtaaccgggacgtaccgtccgaaggttcgggggaacggggtaccccgaagtttacccgaacccgtaaacttccgttacccgtaacggaacggtttaacccttttttacccgtaaccgtaaacggtaaaaccctaaccgtaaaccgtttacggttccctttaacctttttaaccgaaaagtttacggaaaaccgtacggtacccggttagggaaaccgggggcccggaaacgggaaccgtacccggggtacccgttaccgttaagttttacgtttacggttaggttaggtaaacggtttaaggtttagggtacgggtaaccggtaggttcggggtaaccggttcggggttaacgggtaacgtaacggtaaacgtttccgggacgggttaacccgggggg

SEQ ID NO: 320464 - DNA, 543 bp, Homo sapiens
  misc_feature: GZ8MTXP02HFQ3S.19.67.G01.1.454.CMB.2.raw
  modified_base (445)..(445): a, c, t, g, unknown or other
  misc_feature (445)..(445): n is a, c, g, or t
  modified_base (471)..(471): a, c, t, g, unknown or other
  misc_feature (471)..(471): n is a, c, g, or t
  modified_base (493)..(493): a, c, t, g, unknown or other
  misc_feature (493)..(493): n is a, c, g, or t
  modified_base (510)..(510): a, c, t, g, unknown or other
  misc_feature (510)..(510): n is a, c, g, or t
tcagtactctcgtgcacgaccggtgctcgatttagagtatacatattgggtttgggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctgggcggtctctgagactgtcctgtgaaccctcgtggggtctccgtcagcagcgactgtattgcctgggtccgccaggctccgaggggaagaggccggagtggggtcgcgaggtatttttagagggtgggaccgacattctacggagactcagtgggagggccgattcacatctccagagtactttctcagaacacactcgtctcttacaaatgaacngtcttgaggggcaggacacggccgtntattatgtgtgagtagtttagnggacgagtggcttgggnggacgagactcgacgtcgggggaccaaccgggg

SEQ ID NO: 320465 - DNA, 550 bp, Homo sapiens
  misc_feature: GZ8MTXP02JU39W.19.67.G01.1.454.CMB.2.raw
  modified_base (320)..(320): a, c, t, g, unknown or other
  misc_feature (320)..(320): n is a, c, g, or t
  modified_base (512)..(512): a, c, t, g, unknown or other
  misc_feature (512)..(512): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagnggccggaggtgggtcgcgaggtatttttagagggtgggacgacagttctacgggagactccaagtgggaggggccgatttccacccgatcctcccgagtacgtacttttctcagaacacactgtctacttcaaatcgaacagcctgacgggccgaggacacggccgtactattatgtgtgacgtagtttagnggtcgagtggcgtgggtcgacagactcgacggtcgggg

SEQ ID NO: 320466 - DNA, 568 bp, Homo sapiens
  misc_feature: GZ8MTXP02FHJU7.19.67.G01.1.454.CMB.2.raw
  modified_base (298)..(298): a, c, t, g, unknown or other
  misc_feature (298)..(298): n is a, c, g, or t
  modified_base (464)..(464): a, c, t, g, unknown or other
  misc_feature (464)..(464): n is a, c, g, or t
  modified_base (506)..(506): a, c, t, g, unknown or other
  misc_feature (506)..(506): n is a, c, g, or t
  modified_base (521)..(521): a, c, t, g, unknown or other
  misc_feature (521)..(521): n is a, c, g, or t
  modified_base (533)..(533): a, c, t, g, unknown or other
  misc_feature (533)..(533): n is a, c, g, or t
  modified_base (539)..(539): a, c, t, g, unknown or other
  misc_feature (539)..(539): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaccctgtggggtctccgtcagcagcgactgtattgcctgggtccncaggctcgagggagaggccggagtgggcgctaggttattttagagggtgggaaccgactagttcgtacgggagacctccgagtgggggaacgggccgtattccaaccatcctaccagtacgtaccttttcactaagaacacgactgtctacttacaaaatgaaacngaccgtggacggggccgaggaccacggtcgtctattagttgngtgagtagtttaggnggacgagtcggngtaggngacagacgtcgacggcgggaccgaacggg

SEQ ID NO: 320467 - DNA, 658 bp, Homo sapiens
  misc_feature: GZ8MTXP02IWO42.19.67.G01.1.454.CMB.2.raw
  modified_base (323)..(323): a, c, t, g, unknown or other
  misc_feature (323)..(323): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctggggcggtctctgagactgtcctgtgaaccctcgtggggtctccgtcagcagcgactgtattgcctcgggtccgccaggctccgaggggaagngggccggaggtgggtcgcgtaggttagtttttagagggtggaccgactattctacggagactccgagtgggagggcccgattccgaaccatcctacccgagtacgttacttttctactaacgaaacacctacttcgttacctacttacaaaacttggaaaccaacggcccgttacgggacgggggacccgaaggggacccgaacggggtcccgttaccttatttaacgttaggttgttacggtaggttaacggttttagtgggaccgtagtcgggtcgtagggttaacgggaacagggtaaactccgtaacggtcgggggaccctaaaccggggg

SEQ ID NO: 320468 - DNA, 620 bp, Homo sapiens
  misc_feature: GZ8MTXP02IOR45.19.67.G01.1.454.CMB.2.raw
  modified_base (239)..(239): a, c, t, g, unknown or other
  misc_feature (239)..(239): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaactattttcnccacctccaaagaaacaaaacttctagcctaggtaccaacagagaccaggacacgccctacctaagttcgctactatttacgtgggtcctttcgtacgcgacgtaaacgttccggggtccctcggaccccgtacgttcccggggcaggcgggtcgtggggactagtactttccaccttcctacaacctatcagccacgcctgccgaggcctagaaacgtatggtggtacttagttttatacgttgtactagtacctaatttattttacttacttcccgttcggttaggtaccgtttcggaccgaacggggtaccagggggttaacgaaacttcgaacggtacgtaaacgtggtacggcctacgacctacgtacttcgttcg

SEQ ID NO: 320469 - DNA, 613 bp, Homo sapiens
  misc_feature: GZ8MTXP02FISMC.19.67.G01.1.454.CMB.2.raw
  modified_base (277)..(277): a, c, t, g, unknown or other
  misc_feature (277)..(277): n is a, c, g, or t
  modified_base (302)..(302): a, c, t, g, unknown or other
  misc_feature (302)..(302): n is a, c, g, or t
  modified_base (331)..(331): a, c, t, g, unknown or other
  misc_feature (331)..(331): n is a, c, g, or t
  modified_base (344)..(344): a, c, t, g, unknown or other
  misc_feature (344)..(344): n is a, c, g, or t
  modified_base (366)..(366): a, c, t, g, unknown or other
  misc_feature (366)..(366): n is a, c, g, or t
  modified_base (554)..(554): a, c, t, g, unknown or other
  misc_feature (554)..(554): n is a, c, g, or t
  modified_base (569)..(569): a, c, t, g, unknown or other
  misc_feature (569)..(569): n is a, c, g, or t
  modified_base (588)..(588): a, c, t, g, unknown or other
  misc_feature (588)..(588): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttcctgctgcaatttcaggaggtgtccagtgtgaggtgcaactgggtggagactgggcggaggcttggtccaggccgtggggcgtctctgagactgtcctgtacgaccctgtgggtctccgtnagcagcgactgtatcgccgtggccncaggcctcgaggagaggccggagtgggcngtagttatttagngggtggaccatattcgacgganacctcaggtcgggacgggtccgtattccacacttcgtaccagtacgttaccttttacacgaacgaaccactaacgttcgtccttacttaacaaaagttcgaaaacgtcgaccgtagggaacggggacccgaacggaccgaccgggtccgttacttagtttagttggtagtacggtagttagtttaggngggtacgtagtcggngttggggaagacgagtacncgtacggcgggaccgtaaaccgggg

SEQ ID NO: 320470 - DNA, 662 bp, Homo sapiens
  misc_feature: GZ8MTXP02J1YPV.19.67.G01.1.454.CMB.2.raw
  modified_base (297)..(297): a, c, t, g, unknown or other
  misc_feature (297)..(297): n is a, c, g, or t
  modified_base (349)..(349): a, c, t, g, unknown or other
  misc_feature (349)..(349): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttcctgctgcaatttcaggagtgtccagtgtgaggtgcaactggtggagactggcggaggcttggtccagccgtgggcgtctctgagactgtcctgtcgaaccctgtgggtctccgtcagcagcgactgtattgcctgggtccncaggctccgagggaagacggccggagtgggtcgacgtaggttactttttagngggtgggaccgtacgtattccgacggagacctccgagtggggaacgggccgagttccgccctagtccctaccgaggtacgtacctttttcaccgaagaacctactaacttcggttaccttaccttaccaaaagttgaaaccgacggtccctagggaacggggtacccgaaggacccgaccgggtcccgttacgttaagtttacgttggtagttacggaggtaagttttacgtgggtaccgtaacgtgggtaccgttagggggtccgaagacggtacttaccggaccggttacgggggacccgtaaaccggggg

SEQ ID NO: 320471 - DNA, 552 bp, Homo sapiens
  misc_feature: GZ8MTXP02HG8QA.19.67.G01.1.454.CMB.2.raw
  modified_base (453)..(453): a, c, t, g, unknown or other
  misc_feature (453)..(453): n is a, c, g, or t
  modified_base (489)..(489): a, c, t, g, unknown or other
  misc_feature (489)..(489): n is a, c, g, or t
  modified_base (503)..(503): a, c, t, g, unknown or other
  misc_feature (503)..(503): n is a, c, g, or t
  modified_base (525)..(525): a, c, t, g, unknown or other
  misc_feature (525)..(525): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctggggcggtctctgagactgtcctgtgaacccctctggggtctccgtcagcagcgactgtattgcctgggtccgccaggctccgaggggaagaggccggaggtgggtcgcgaggttatttttagagggtgggacgacattcgacggagactccgagtgggagggccgagttcaccgatctccagacgtacttttcacagaacacactgtctacttcaaatgaaacngctgacgggccgaggacacgggcgtctagttattgngtagagtagtttanggcgagtcggcgtgggtcgganagactcgacggtcggggaccaacgggg

SEQ ID NO: 320472 - DNA, 548 bp, Homo sapiens
  misc_feature: GZ8MTXP02FTO2H.19.67.G01.1.454.CMB.2.raw
  modified_base (362)..(362): a, c, t, g, unknown or other
  misc_feature (362)..(362): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctgggcggtctctgagactgtcctgtgaaccctctggggtctccgtcagcagcgactgtatgcctggtccgccaggctccgagggaagaggcccggagtggggtcgcaggtatttttagaggtgggacganattcgtacggagctccatgggacgggccgagttcaccatctcccagacgtacttttctacagaacacactgtctacttacaaatcgaaacagaccgtgacgggccgaggacgacggccgtactattagttgtgtgagtagtttagtcggcgagtggcgtggtaggacagtactcgacgtacggggg

SEQ ID NO: 320473 - DNA, 561 bp, Homo sapiens
  misc_feature: GZ8MTXP02GUWKK.19.67.G01.1.454.CMB.2.raw
  modified_base (382)..(382): a, c, t, g, unknown or other
  misc_feature (382)..(382): n is a, c, g, or t
  modified_base (518)..(518): a, c, t, g, unknown or other
  misc_feature (518)..(518): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctcgtggggtctccgtcagcagcgactgtattgcctgggtccgccaggctccgaggggaagaggcccgggaggtggggtcgcgaggtatttttagagggtgggacgactattcgtacgganactccagtggagggcccgattcaccatctccagacgtacttttctacagaacacactgtcttacttacaaatgaaactagcccgtagacgggccgaggaccacggccgtactattattgtgtagtagtagtttagnggtcgagtggaagtgggtaggacgagtattccgacgtcggggg

SEQ ID NO: 320474 - DNA, 574 bp, Homo sapiens
  misc_feature: GZ8MTXP02GPZ4S.19.67.G01.1.454.CMB.2.raw
  modified_base (250)..(251): a, c, t, g, unknown or other
  misc_feature (250)..(251): n is a, c, g, or t
  modified_base (258)..(258): a, c, t, g, unknown or other
  misc_feature (258)..(258): n is a, c, g, or t
  modified_base (261)..(261): a, c, t, g, unknown or other
  misc_feature (261)..(261): n is a, c, g, or t
  modified_base (281)..(281): a, c, t, g, unknown or other
  misc_feature (281)..(281): n is a, c, g, or t
  modified_base (284)..(284): a, c, t, g, unknown or other
  misc_feature (284)..(284): n is a, c, g, or t
  modified_base (287)..(287): a, c, t, g, unknown or other
  misc_feature (287)..(287): n is a, c, g, or t
  modified_base (290)..(290): a, c, t, g, unknown or other
  misc_feature (290)..(290): n is a, c, g, or t
  modified_base (298)..(298): a, c, t, g, unknown or other
  misc_feature (298)..(298): n is a, c, g, or t
tcagtactctcgtgcacgaccggtgctcgatttagagtatacatattgggtttgggggtagctcaggaagcagagcctggagcatctccactatggcctgggctccactacttctcaccctcctcgctcactgcacaggttcttgggccaactttatgctgactcagccccactctgtgtcggagtctccggggaagacggtaaccatctttgcacccacaacagtggcaaacattgccagcaattttgnnagtgacngcngcgccggcaccgtccccacntgnatntangagataanacaaacgccgtcgtcgggtccctgacgttcgtctcgtcgcctccatcacacgcctccctacctactcctccgtcccctccctccaccctacttcctcgtagactagaaacgtacgtaggacggacggagctacgaacctacttactcgtactagttcttagtacgtacgtacgtcgtcgtacgtagtgttcggttcggttcgggacgggacggaccgacgtacgtaccgtaccgtaccgtaacgtacgacgaccgacgaccgtcccgtcccgtccg

SEQ ID NO: 320475 - DNA, 607 bp, Homo sapiens
  misc_feature: GZ8MTXP02G84HP.19.67.G01.1.454.CMB.2.raw
  modified_base (386)..(386): a, c, t, g, unknown or other
  misc_feature (386)..(386): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagtttggctgacctgggttttcctgctgcaatttcaggaggtgtccagtgtgaggtgcaacgtgggtggagacgtgggcggaggcttggtccagccgtgggcggtctctgagactgtcctgtgaccctgtggggtctccgtcagcagcgactgtatcgcctgggtccgccgaggcctaccgagggaagacgggccgggtagtgggtcgcgtaggtatttttagagggtgggacgacagttcgtacgganctcagtgggaggccgattccgactactctaccagacgtactttctacaagaaacactactcgtacttacttacaaatcgaaacacgtacgaggacgggaccggaacggaaccgaccggggtaccggttactaaagtttatttacggggttgtagggacgttaaggtttacgtgggacgtaagtcgggtgtgggtggaacgagtataccggaagtccggggg

SEQ ID NO: 320476 - DNA, 536 bp, Homo sapiens
  misc_feature: GZ8MTXP02JL4ND.19.67.G01.1.454.CMB.2.raw
  modified_base (220)..(220): a, c, t, g, unknown or other
  misc_feature (220)..(220): n is a, c, g, or t
  modified_base (224)..(224): a, c, t, g, unknown or other
  misc_feature (224)..(224): n is a, c, g, or t
  modified_base (400)..(400): a, c, t, g, unknown or other
  misc_feature (400)..(400): n is a, c, g, or t
  modified_base (436)..(436): a, c, t, g, unknown or other
  misc_feature (436)..(436): n is a, c, g, or t
tcagtactctcgtgcacgaccggtgctcgatttagagtatacatattgggtttgggggtagctcaggaagcagagcctggagcatctccactatggcctgggctccactacttctcaccctcctcgctcactgcacaggttcttgggccaactttatgctgactcagccccactctgtgtcggagtctccggggaagacggtaaccatctttgcacccanaacngtggcaacattgccagctaattttgtgcagtggtaccagcagcgcccgggcacgttcccccaccatgtcgatctatgaggataatcaaaagaccgtcgtaggggtccctgactcggttctcgtcggctccatcgacagctcctcaactctcgcctcctcacatcgtctgactgaanactgagcgaggctagacttactacgtgttacatttntatagtagtacgcgtcgtcgtagtgtggtcggtcggacggacggacgacgacgtacgtaccgtacgtaacgtcgacgaccgacgccgtccgtcccgtccg

SEQ ID NO: 320477 - DNA, 680 bp, Homo sapiens
  misc_feature: GZ8MTXP02F5G3X.19.67.G01.1.454.CMB.2.raw
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtcgaaccctcgtggggtctccgtcagcagcgactgtattcgcctgggtccgccaggcctccgaggggaagaggccggaggtggggtcgcgtaggttatttttagagggtggggacccgtatagttcgacggagacctccgagtcggggaacggggccgtattccgacctattccctaccgaggtaacgttacctttttaccgtacaacgtaaaccacctaacttcggttaccttacctttaacctaaaaagttcgaaaaccgtacggtacccgtagggaacgggggacccggaaggggaaccgtacggggccttacggttacgttatttacgtttggtcggtaggtaggttaggtttagtgggtacgtagtcgggtcgtgggggtacggaacgtaggtacgttacgaacgggttcgggggaaaccccgg

SEQ ID NO: 320478 - DNA, 611 bp, Homo sapiens
  misc_feature: GZ8MTXP02HQA14.19.67.G01.1.454.CMB.2.raw
  modified_base (243)..(243): a, c, t, g, unknown or other
  misc_feature (243)..(243): n is a, c, g, or t
  modified_base (297)..(297): a, c, t, g, unknown or other
  misc_feature (297)..(297): n is a, c, g, or t
  modified_base (319)..(319): a, c, t, g, unknown or other
  misc_feature (319)..(319): n is a, c, g, or t
  modified_base (337)..(337): a, c, t, g, unknown or other
  misc_feature (337)..(337): n is a, c, g, or t
  modified_base (378)..(378): a, c, t, g, unknown or other
  misc_feature (378)..(378): n is a, c, g, or t
  modified_base (610)..(611): a, c, t, g, unknown or other
  misc_feature (610)..(611): n is a, c, g, or t
tcagtactctcgtgcacgaccggtgctcgatttagagtatacatattgggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggaggccgattcaccatctccagagactttttcncagaacacactgtctcttcaaatgaacagcctgagggccgaggacacggccgtntatttatgtgtgagtagtttanggcatgggctggtggacngatcgaccgtggggccaggggaccctggtccacgtctcctnacgccctaccaccgaagggcccccagtccggtcccttcccccgtgggcccgcccgttcgccttccgacgggacgccacccgtcccggagacggccaacgcgcccgggccccctggggcctcggccctggggttaccaaacgggtaccttaacccgtttccccgaacggacgtacggttaacctggacggccgggggacctggggaacccgaaagggccgtacgagtacggcnn

SEQ ID NO: 320479 - DNA, 807 bp, Homo sapiens
  misc_feature: GZ8MTXP02IU494.19.67.G01.1.454.CMB.2.raw
  modified_base (189)..(189): a, c, t, g, unknown or other
  misc_feature (189)..(189): n is a, c, g, or t
  modified_base (301)..(301): a, c, t, g, unknown or other
  misc_feature (301)..(301): n is a, c, g, or t
  modified_base (317)..(317): a, c, t, g, unknown or other
  misc_feature (317)..(317): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttcctgctgcaattcaggagtgtccagtgtgaggtncaactggtggagactggcggaggcttggtccagccgtgggcgtctctgagactggtcctggtcgaaccctgtggggtcctccgtcagtcagcgactgtatcgccgtggtccncaggctcgagggaagnggccggagtgggtcgctaggttactttttagagggttcggaacctacgtagttcgaacgggagaccttccgaggtcggggaacgggtaccccggtaatttacccgaaccgtaacgttccctacccgtaaggtaaccgttaaccgtttttcgaaccgtaaacggtaaacctaccgtaaaccgtttcggttaaccttaccgtttaaacgtaaaacgtttaccggtaaaaccgtaaccgggttacccgtttaggggaaaccgggggttaccccgaaaacggggtaacccggtaaccggggttacccccgtttaacgtttaacgttttaaacggtttcgggttacggtttaacgggtaaaccggtttaagggtttacggttacggggtaacggttaacgttcggggtaacccggtttaggggttaacgggtaaaccgtacggtaaccgttacccggtaaccgggtttacgggggaccccgttaaaacccggggg

SEQ ID NO: 320480 - DNA, 619 bp, Homo sapiens
  misc_feature: GZ8MTXP02JJKCU.19.67.G01.1.454.CMB.2.raw
  modified_base (298)..(298): a, c, t, g, unknown or other
  misc_feature (298)..(298): n is a, c, g, or t
  modified_base (313)..(313): a, c, t, g, unknown or other
  misc_feature (313)..(313): n is a, c, g, or t
  modified_base (464)..(464): a, c, t, g, unknown or other
  misc_feature (464)..(464): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagccgtgggcgtctctgagctgtcctgtcgaccctgtggggtctcgtcagcagcgactgtattcgctgggtccncaggctcgagggagnggccggaggtgggcgcgaggttatttttagagggttggaccgactagttcgtacggagactccagtgggacgggccgtattccgaccatcctaccgagagtacctttctacaagtaacaccacttgtaccttcttacctaaaatcgaaacncgacctgggacgggggaccaacggggaccaccgggtcccgtagttattagttggtggttaagaggttaaggtttacgtaggggacgtaagttcgggtccgtagggtaacgggacaggtaacttcgaacgggttcgggggacccttaaaccggggg

SEQ ID NO: 320481 - DNA, 610 bp, Homo sapiens
  misc_feature: GZ8MTXP02IU892.19.67.G01.1.454.CMB.2.raw
  modified_base (300)..(300): a, c, t, g, unknown or other
  misc_feature (300)..(300): n is a, c, g, or t
  modified_base (424)..(424): a, c, t, g, unknown or other
  misc_feature (424)..(424): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtcgaaccctcgtggggtctccgtcagcagcgactgtatgcctggtccncaggctccgagggaagaggcggagtgggtcgcgtaggttatttttagagggtggaccgactattcgtacggagtacctccagtgggagggccgtattccgacatcctaccagtagtacctttcncaagaacactacttcgtacttcttacaaatacgaacacgtccgtagggacggggacccgaaggaccgacgggtccgttacgttacgttaagtttggtagttaggtaaggttagttttaagcgggtacgtaggtcggcgttgggtaacggactaggactcgacggtcggggaccgtaaacccggggg

SEQ ID NO: 320482 - DNA, 836 bp, Homo sapiens
  misc_feature: GZ8MTXP02H7REJ.19.67.G01.1.454.CMB.2.raw
  modified_base (299)..(299): a, c, t, g, unknown or other
  misc_feature (299)..(299): n is a, c, g, or t
  modified_base (319)..(319): a, c, t, g, unknown or other
  misc_feature (319)..(319): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggtttcctgctgcaatttcaggaggtgtccagtgtgaggtgcgactgggtggagacgtggcggaggcttggccagccgtgggcgtctcgtgagactgtcctgtcgaaccctcgtgggtctcgtcagcagcgactgtatcgccgtggtccncgaggctaccgagggaacgnggccggagtcgggtcacgtaggttattttagaggtcggaccgtacgtagttcgaacggactaccgttcgagtcggggacgggtccctaagttccgaaccgtacgttcccgtacccgtaaggtaccgtttaccgttttaccgtacgtaaacgtaaacctaccgttacgttacggttaccctttaccgttaacgtaaaacgtttccggtaaaaccgtacggttacccggtaacgggtaccgggggtaacccgtaaaccggggtaacccgtaacccgggggttaccccgtttaacgtttaacgtttacggtttacgggttaacgggtttaacgggttaaacgggtttaaaccgggtttttaaacggtaccgggggttaaccggttaacggtttaccgggggtttacccggtttaaacgggggttaaccgggttaaacccggttaaacgggttaacccggtttaacccgggtaaacccgggggtttaccggggggtaaacccccgtttaaaacccgggggg

SEQ ID NO: 320483 - DNA, 528 bp, Homo sapiens
  misc_feature: GZ8MTXP02I7VTE.19.67.G01.1.454.CMB.2.raw
  modified_base (342)..(342): a, c, t, g, unknown or other
  misc_feature (342)..(342): n is a, c, g, or t
  modified_base (484)..(484): a, c, t, g, unknown or other
  misc_feature (484)..(484): n is a, c, g, or t
  modified_base (495)..(495): a, c, t, g, unknown or other
  misc_feature (495)..(495): n is a, c, g, or t
  modified_base (500)..(500): a, c, t, g, unknown or other
  misc_feature (500)..(500): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtatgcctgggtccgccaggctccagggaagaggccggagtgggtcgcaggtattttanaggtggaccgacattctacggagactccagtgggagggccgattcacatcctccagagtactttctcagaacacactgtctctacaaatgaacagcctgagggccgaggacacggccgtctattatgtgtgagtagtttagnggcgagtcggngtggngacgagactcgacggtcgggaccgacgg

SEQ ID NO: 320484 - DNA, 666 bp, Homo sapiens
  misc_feature: GZ8MTXP02JDFQ5.19.67.G01.1.454.CMB.2.raw
  modified_base (599)..(599): a, c, t, g, unknown or other
  misc_feature (599)..(599): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttgggtccagccgtggggcggtctctgagactgtcctgtcgaccctcgtgggtcctccgtcagcagcgactgtatcgccgtcgggtccgccgagggcctccggaaggggaacggacgggccgggaggtggggtcgacgtaaggttatttttagtaggggtgggtaccgtactagttcgtacggagtactccgagtcggggacggggccgtaagttccaactactcctacccgagtacgtaccttttcacaacgaaacacgtacttcgttactaccttaacaaactacggaaccacggtcccgtaggggaccggggaccggacgggaccgtacgggtccgttacgttaagtttagttggtaggttacggagttaggtttagngggtacggtagtgggtcgttgggaaggacgtaggtactcggaccggtcgggggaccgtaaccggggg

SEQ ID NO: 320485 - DNA, 596 bp, Homo sapiens
  misc_feature: GZ8MTXP02IVQ1Q.19.67.G01.1.454.CMB.2.raw
  modified_base (263)..(263): a, c, t, g, unknown or other
  misc_feature (263)..(263): n is a, c, g, or t
  modified_base (513)..(513): a, c, t, g, unknown or other
  misc_feature (513)..(513): n is a, c, g, or t
  modified_base (522)..(522): a, c, t, g, unknown or other
  misc_feature (522)..(522): n is a, c, g, or t
  modified_base (537)..(537): a, c, t, g, unknown or other
  misc_feature (537)..(537): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcgggaggcttggtccaggccgtgggcggtctctgagactgtcctgtgaaccctntggggtctccgtcagcagcgactgtattgccgtgggtcccgcaggctccgagggaagaggccggaggtgggtcgcgtaggttatttttaggacggttgggaccgactagttctaacggagaccttcgagtcgggaacggggcctagttccaccgattcccaccaagtacgttactttcctacaagaaaccacgaacttgtcctacttacaaaatgaaacagccctaggacgggccgagaccacggccgtntattagtgngtagagtagttacgngggacgtagtgggtcaggggtcgaacgaggactcgacggttcggggccgtaaaccgggg

SEQ ID NO: 320486 - DNA, 559 bp, Homo sapiens
  misc_feature: GZ8MTXP02H45WR.19.67.G01.1.454.CMB.2.raw
  modified_base (247)..(247): a, c, t, g, unknown or other
  misc_feature (247)..(247): n is a, c, g, or t
  modified_base (288)..(288): a, c, t, g, unknown or other
  misc_feature (288)..(288): n is a, c, g, or t
  modified_base (303)..(303): a, c, t, g, unknown or other
  misc_feature (303)..(303): n is a, c, g, or t
tcagtactctcgtgcacgaccggtgctcgatttagagtatacatattgggtttgggggtagctcaggaagcagagcctggagcatctccactatggcctgggctccactacttctcaccctcctcgctcactgcacaggttcttgggccaactttatgctgactcagccccactctgtgtcggagtctccggggaagacgtaaccatctttgcaccacaacagtgcaacattgccagctaattttgngcagtggtaccagcagcgcccgggcacgtcccccacattgngatctatgagataancaaaagaccgtgtggggtccctgatcggttctctcggctccatcgacagcctcctccaaactctcgccctcccctcaccatcctctagactagaacgacgtggaacggacgaggctagacctactactgtcagttctatgagtacgccgcggtcagtgtcggttcgttcgggacgggacggaacccgaagtccgtacggacccgttaccgtaacgggtccaacggcccgaacggtccgtccggtcccccgttccgg

SEQ ID NO: 320487 - DNA, 525 bp, Homo sapiens
  misc_feature: GZ8MTXP02ILGH1.19.67.G01.1.454.CMB.2.raw
  modified_base (247)..(247): a, c, t, g, unknown or other
  misc_feature (247)..(247): n is a, c, g, or t
  modified_base (265)..(265): a, c, t, g, unknown or other
  misc_feature (265)..(265): n is a, c, g, or t
  modified_base (277)..(277): a, c, t, g, unknown or other
  misc_feature (277)..(277): n is a, c, g, or t
  modified_base (279)..(279): a, c, t, g, unknown or other
  misc_feature (279)..(279): n is a, c, g, or t
  modified_base (282)..(283): a, c, t, g, unknown or other
  misc_feature (282)..(283): n is a, c, g, or t
  modified_base (287)..(287): a, c, t, g, unknown or other
  misc_feature (287)..(287): n is a, c, g, or t
  modified_base (291)..(291): a, c, t, g, unknown or other
  misc_feature (291)..(291): n is a, c, g, or t
  modified_base (295)..(295): a, c, t, g, unknown or other
  misc_feature (295)..(295): n is a, c, g, or t
  modified_base (297)..(297): a, c, t, g, unknown or other
  misc_feature (297)..(297): n is a, c, g, or t
  modified_base (300)..(300): a, c, t, g, unknown or other
  misc_feature (300)..(300): n is a, c, g, or t
  modified_base (308)..(308): a, c, t, g, unknown or other
  misc_feature (308)..(308): n is a, c, g, or t
  modified_base (313)..(313): a, c, t, g, unknown or other
  misc_feature (313)..(313): n is a, c, g, or t
  modified_base (318)..(319): a, c, t, g, unknown or other
  misc_feature (318)..(319): n is a, c, g, or t
  modified_base (338)..(338): a, c, t, g, unknown or other
  misc_feature (338)..(338): n is a, c, g, or t
  modified_base (346)..(346): a, c, t, g, unknown or other
  misc_feature (346)..(346): n is a, c, g, or t
  modified_base (351)..(351): a, c, t, g, unknown or other
  misc_feature (351)..(351): n is a, c, g, or t
  modified_base (366)..(366): a, c, t, g, unknown or other
  misc_feature (366)..(366): n is a, c, g, or t
  modified_base (369)..(369): a, c, t, g, unknown or other
  misc_feature (369)..(369): n is a, c, g, or t
  modified_base (378)..(378): a, c, t, g, unknown or other
  misc_feature (378)..(378): n is a, c, g, or t
  modified_base (380)..(380): a, c, t, g, unknown or other
  misc_feature (380)..(380): n is a, c, g, or t
  modified_base (382)..(382): a, c, t, g, unknown or other
  misc_feature (382)..(382): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttgggtccagccctgggcggtcgtctgganacgtgtcctgtgaccctntggggctccgtngnagnntgtntgcnggcncngcncgaggagngcggngtggnnagtattagaggtggaccantcgagganactcngtggaggccatcacntcncagatcttnananacacactctactactactaaataagaacacgaccgtacggacgggaccggacggacgacggcgtactagttagtgtgtgtagtagttagtagacgagtcggtgtggtaaggacgacgacgtacgtacggtacgggacggacgg

SEQ ID NO: 320488 - DNA, 760 bp, Homo sapiens
  misc_feature: GZ8MTXP02JFI9Y.19.67.G01.1.454.CMB.2.raw
  modified_base (241)..(241): a, c, t, g, unknown or other
  misc_feature (241)..(241): n is a, c, g, or t
  modified_base (320)..(320): a, c, t, g, unknown or other
  misc_feature (320)..(320): n is a, c, g, or t
tcagtactctcgtgcacgaccggtgctcgatttagagtatacatattgggtttgggggagctacaacaggcaggcaggggcagcaagatggtgttgcagacccaggtcttaatttctctgttgctctggatctctggttcctggcgggacatcgtgatgacccagtacccagactcactggctgtgtctcgtgggcgagacggccacaatcaactgcaggtccagccaagaactattttcnccacctacaagaaactaaaactctagcctgtaaccaacagacgaccaggacacgcctacctaagtcgctacatttacgnggtcttcgacgcgtacgtaacgttcccggggtccctaggtacccgtacggttcccgggggcacgggtccggggttactacggggaacctagggttacttttacccaaccgttcccgtacccgtaacccctagttacccgaaacgccctaaacgggttccccctaggacccgaaaggggtcctaagggaaagtacgttgggtacgggactttaaaggttttacttaacgtcggttacctaaaggtacctttaaaagtttttacgtttttaccttaaccgttcccggttacgggttacgggttaccggtttacccgggaacccggtaaaacgggggtaccccgtaagggggtaaccgtaaaaactcccggtaaaggtaacccgtaacgttggggtaaccgtcgttacggaccctaaacgttacttaccggttacgtttaccc

SEQ ID NO: 320489 - DNA, 543 bp, Homo sapiens
  misc_feature: GZ8MTXP02FZVI0.19.67.G01.1.454.CMB.2.raw
  modified_base (301)..(301): a, c, t, g, unknown or other
  misc_feature (301)..(301): n is a, c, g, or t
  modified_base (382)..(382): a, c, t, g, unknown or other
  misc_feature (382)..(382): n is a, c, g, or t
  modified_base (419)..(419): a, c, t, g, unknown or other
  misc_feature (419)..(419): n is a, c, g, or t
  modified_base (511)..(511): a, c, t, g, unknown or other
  misc_feature (511)..(511): n is a, c, g, or t
  modified_base (515)..(515): a, c, t, g, unknown or other
  misc_feature (515)..(515): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagccgtgggcggtctctgagctgtcctgtcgaaccctctggggtctccgtcagcagcgactgtattgcctgggtccncaggctccagggaagaggccggagtggggtcgcgaggttatttttagagggtggggaccgactattcgtacggagacttcngtgggagggccgattcacatctccagagtacttttcnctagaacacaactgtactcttcaaatgaaactagtctaggagggaccgaggacacggcgtctattatgtgtgagtagttatggcgagtcggntggngtacagatcgacgtcgggccgtaacggg

SEQ ID NO: 320490 - DNA, 581 bp, Homo sapiens
  misc_feature: GZ8MTXP02GWVO0.19.67.G01.1.454.CMB.2.raw
  modified_base (387)..(387): a, c, t, g, unknown or other
  misc_feature (387)..(387): n is a, c, g, or t
  modified_base (545)..(545): a, c, t, g, unknown or other
  misc_feature (545)..(545): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagccgtgggcggtctcgtgagactgtcctgtcgaccctcgtggggtctccgtcagcagcgactgtattgccgtgggtccgccaggcctccgaggggaagaggccggagtggggtcgcgtaggttatttttagagggtggaccgacattcgacggagacctccngtgggacgggccgattccaccgtatcctaccagtacgtacttttcacaagaacacacttcgtcctcttacaaatgaaacacgccgtaggacgggaccgaggaccgacggcgtactagttacgtgtgtgtagtagtttagtggtagagtggtcgtgggnggacaggtactcgacggtcggggaccgtaaccgggg

SEQ ID NO: 320491 - DNA, 590 bp, Homo sapiens
  misc_feature: GZ8MTXP02F7OPG.19.67.G01.1.454.CMB.2.raw
  modified_base (299)..(299): a, c, t, g, unknown or other
  misc_feature (299)..(299): n is a, c, g, or t
  modified_base (317)..(317): a, c, t, g, unknown or other
  misc_feature (317)..(317): n is a, c, g, or t
  modified_base (438)..(438): a, c, t, g, unknown or other
  misc_feature (438)..(438): n is a, c, g, or t
  modified_base (480)..(480): a, c, t, g, unknown or other
  misc_feature (480)..(480): n is a, c, g, or t
  modified_base (546)..(546): a, c, t, g, unknown or other
  misc_feature (546)..(546): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtcgaaccctgtggggtctccgtcagcagcgactgtatgcctgggtccncaggctccgaggggaagnggccggaggtgggtcgcgtaggttatttttagaggggtgggacccgtacattcgtacggagaccttccagtggggacggggccgaattccgaacctatcccttaccagtacgtacttttcncaacgaacacgtacttgttcctactttacaaaattgaaaccncggacctgggacggggcccgaacgggaccgaccggccgttactatttatggtgtgagtagtttagnggcgtagtggtcgtggcgagagtactcgacggtcgggacgacgg

SEQ ID NO: 320492 - DNA, 599 bp, Homo sapiens
  misc_feature: GZ8MTXP02IZGSI.19.67.G01.1.454.CMB.2.raw
  modified_base (296)..(296): a, c, t, g, unknown or other
  misc_feature (296)..(296): n is a, c, g, or t
  modified_base (369)..(369): a, c, t, g, unknown or other
  misc_feature (369)..(369): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagtttggctgacctgggtttcctgctgcaattcaggaggtgtccagtgtgaggtgcaactggtggagacgtgggcggaggcttggtccagccgtgggcgtctctgagactgtcctgtcgaccctcgtggggtctccgtcagcagcgactgtatgcctggtccncaggctccgagggaagaggccggaggtgggtcgcgtaggttatttttagagggtggacgacattcgtacgganacctcagtgggacggccgtattccacctatcctaccagtacgtacttttcacaacgaacactactgtaccttcttaacaaagttcgaaaccacggtccgtagggacggggacccgaagggaaccgaccgggccgtacttagttattaggtgtacgagtagtttagtcgggacgtacgtcggtgttagggcggaactaaggactacgacggtacggggaccgtaaacgggg

SEQ ID NO: 320493 - DNA, 584 bp, Homo sapiens
  misc_feature: GZ8MTXP02GRSM9.19.67.G01.1.454.CMB.2.raw
  modified_base (348)..(348): a, c, t, g, unknown or other
  misc_feature (348)..(348): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctggggcggtctctgagactgtcctgtgaaccctcgtggggtctccgtcagcagcgactgtatgcctgggtccgcaggctccgaggggaagaggccggagtggggtcgcgtaggtattttanagggtgggaccgacattctacggagactcagtggagggccgattcacatcctaccagtacgtacttttcgtacagtaaacactactgtacctacttacaaaattcggaaacagtcccgtagggaacggggcccgaacgggaccacgggcccgttactaatttagttgtgtagagttagtttatgggacgtagtggcttgggtgacaggacttcgacgtcgggggaccaaacggggg

SEQ ID NO: 320494 - DNA, 605 bp, Homo sapiens
  misc_feature: GZ8MTXP02GP3UJ.19.67.G01.1.454.CMB.2.raw
  modified_base (302)..(302): a, c, t, g, unknown or other
  misc_feature (302)..(302): n is a, c, g, or t
  modified_base (319)..(319): a, c, t, g, unknown or other
  misc_feature (319)..(319): n is a, c, g, or t
  modified_base (547)..(547): a, c, t, g, unknown or other
  misc_feature (547)..(547): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagactgggcggaggcttggtccaggccgtgggcggtctctgagactgtcctgtcgaccctcgtgggtctcgtcagcagcgactgtatgccgtgggtccncaggctccgagggaagnggccggaggtgggtcgcgtaggttatttttagagggtgggaccgactagttcgacggagacctccgagtcgggacgggccgtattccactatcctaccgagtacgtacttttcacaacgaacacgtactcgtactacttacaaatcgaaacacgaccgtagggacggggaccgaacggaccgaccgggtccgttacttatttagttgtagttagaggttagtttacgnggtacgtagtcggcgttagggtgacgagtacgtcgacggtcggggaccgtaaccgggg

SEQ ID NO: 320495 - DNA, 668 bp, Homo sapiens
  misc_feature: GZ8MTXP02IDC53.19.67.G01.1.454.CMB.2.raw
  modified_base (310)..(310): a, c, t, g, unknown or other
  misc_feature (310)..(310): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactgggtggagacgtgggcggaggcttggtccaggcccgtgggcggtctcgtgagactgtcctgtcgaacccttgtcggggtctccgtcagcagcgactgtatgccgtcgggtccnccgaggctccgaggggaagcggccgggaggtgggtcgcgtaggttatttttaggagggtcggggaccgtaactagtttacgacgggagtacctccgagtcggggacggggcccgtaatttccgaaccctattccctacccgtaagacgttacctttttccaccaaacgtaaaccacctaacttcgttaccttacctttacaaaacttcgaaaccacggtcccgtagggacggggacccgaacgggaaccgtacgggtcccgtagtttatagtttggtgttaggaagttacggtttatgggacgtagtgggtctgggggtaagtacagacgttcgaccggtacgggggacccaacgggg

SEQ ID NO: 320496 - DNA, 582 bp, Homo sapiens
  misc_feature: GZ8MTXP02I38M9.19.67.G01.1.454.CMB.2.raw
  modified_base (251)..(251): a, c, t, g, unknown or other
  misc_feature (251)..(251): n is a, c, g, or t
tcagtactctcgtgcacgaccggtgctcgatttagagtatacatattgggtttgggggtagctcaggaagcagagcctggagcatctccactatggcctgggctccactacttctcaccctcctcgctcactgcacaggttcttgggccaactttatgctgactcagccccactctgtgtcggagtctccggggaagacggtaaccatctttgcacccacaacagtggcaacattgccagctaaattttgngcagtggtaccagcagcgcccgggcacgttcccccaccattgtgatctatgaggataatcaaaagccgtctggggtccctgatcggtctctggctcatcgacacgctcctccaactctcgccctccctcaccatctctggactgaagactggacggacgagctagactacgtactcgtctagttcttaatgatagcccgtacggtctagtggttcggttcgttcggggacgggtacggggaaccgtaaacggccgttacggtacccgttccgtaacgggtccgaaccggaccccgaaaggggtcctacccggggtccccccgtttccgggg

SEQ ID NO: 320497 - DNA, 698 bp, Homo sapiens
  misc_feature: GZ8MTXP02HDO1X.19.67.G01.1.454.CMB.2.raw
tcagtactctcgtgcacgaccggtgctcgatttagagtatacatattgggtttggggggagaggagcccagcactgggattccgaggtgtttccattcggtgctcagcactgaacacagaggactcaccatggagttttggctgaccttgggttttccttgctgcaatttcaggaggtgtccagtgtgaggtgcaacgtggtggagacgtgggcggaggcttggtccagccgtgggcggtctctgagactgtcctgtcgaccctcgtggggtctccgtcagcagcgactgtattcgcctcgggtccgccgaggctccggaaggggaacggcggccggaggtgggcgcgtaggttatttttagagggtggaccgactagttcgacggagtacctccagttcggggacggggtcccgtattcccaaccgtacttcccgtaccgaagtaacgttacctttttcgacaacgtaaaccaccacttcgtaccttacttaccaaaagttcgaaacgacgtaccgtagggacggggacccgaaacgggaccgaccgggtcccgttacgttaagtttagtttagggttaggttacgggtaagttaggttttaaaggtcggggtacgtagttcggggtccgttgggggttaacggaacgtacggtacgttaccgtacgggttaccgggggacccgtaaaccccggggg

SEQ ID NO: 320498 - DNA, 605 bp, Homo sapiens
  misc_feature: GZ8MTXP02JBOZA.19.67.G01.1.454.CMB.2.raw
  modified_base (583)..(583): a, c, t, g, unknown or other
  misc_feature (583)..(583): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgaccttgggttttccttgctgctaatttcaggaggtgtccagtgtgaggtgcaactggtggagacgtgggcggaggtcttggtccagccgtggggcggtctctgagactgtcctgtcgaccctcgtggggtctccgtcagcagcgactgtattgccgtgggtccgccaggctccgagggaagagtggccggaggtgggtcgcgtaggtttattttagagggtcggacgactagttcgtacggagacctccgagtgggacgggccgattccaacccgtatcctaccgaaggtacgttaactttttcacgaagtaaaccactacttgtacttacttacaaaattcgaaacagccgtagggacgggaccgagggaccaccggccgttactagttagttgtgtagaggtagtttagcggtacgtacgtggcgtgggtcgaacgngagtcgaacgtcggggaacccg

SEQ ID NO: 320499 - DNA, 606 bp, Homo sapiens
  misc_feature: GZ8MTXP02HD16N.19.67.G01.1.454.CMB.2.raw
  modified_base (320)..(320): a, c, t, g, unknown or other
  misc_feature (320)..(320): n is a, c, g, or t
  modified_base (407)..(407): a, c, t, g, unknown or other
  misc_feature (407)..(407): n is a, c, g, or t
  modified_base (546)..(546): a, c, t, g, unknown or other
  misc_feature (546)..(546): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagactgggcggaggcttggtccagccgtgggcggtctctgagactgtcctgtcgaaccctgtggggtctccgtcagcagcgactgtatgccgtggtccgccaggctccgagggaagngggccggaggtgggtcgcgtaggttatttttagaggtggacgactattcgacggagacctcgagtgggagggccgattccacatccnccagtacgtactttcgtacaagaactacacgttacgtccttacttacctaaaatcgaaacagtcccgtagggacggggaccggaacggtaccgacgggtaccgttacttagtttagttgtgtaggtagttaggtttagnggtacgtagtgggtctggggtaagacgtagtacgtcgacggtcggggaccgtaaccgggg

SEQ ID NO: 320500 - DNA, 661 bp, Homo sapiens
  misc_feature: GZ8MTXP02JIVQT.19.67.G01.1.454.CMB.2.raw
  modified_base (244)..(244): a, c, t, g, unknown or other
  misc_feature (244)..(244): n is a, c, g, or t
  modified_base (486)..(486): a, c, t, g, unknown or other
  misc_feature (486)..(486): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctggcggggacatcgtgatgacccagtacccagactcactggctgtgtctcgtgggcgagacggccaacaatcaacgtgcaggtccagccaagaactatttccnccacctacaaagaactaaaacttctagcctaggtaccaacagagaccaggacacgcctactaagttcgctactatttacgtgggtcctttacgacggcgacggtaacgttccggggtcccctaggaacccccggtagttcccgggggacacggggtccggggtcgtacggggacctaggtactttcgacctctaccactatccacgtaccacgcccgtgaccgagggtcctaggaaacggtntcggtacggtacttaggtttactacgtgtcaagtacttaaagtttcttttacctagttcccgtacggttaggtaccgtccggtaacccggaaaggggtaccgtaaaggggtacgaaaacgttcgaaacggacgtaacgtcggtacggcgtacggactacccgtattccgtttacg

SEQ ID NO: 320501 - DNA, 556 bp, Homo sapiens
  misc_feature: GZ8MTXP02IWT0B.19.67.G01.1.454.CMB.2.raw
  modified_base (501)..(501): a, c, t, g, unknown or other
  misc_feature (501)..(501): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctggggcggtctctgagactgtcctgtcgaaccctctggggtctccgtcagcagcgactgtatgcctggtccgccaggctccgagggaagaggccggagtggggtcgcgtaggtatttttagagggtggaccgacattcgtacggagactccagtgggagggccgattcgaccatctccagacgtactttcacagaacacactgtctcttacaaatgaaacacgcctggacgggccgaggacacggccgtctattagtgtgtagagtagtttagnggcgtagtcggtgtgggttggacagactacgacgtcgggggaccgtaaccggggg

SEQ ID NO: 320502 - DNA, 833 bp, Homo sapiens
  misc_feature: GZ8MTXP02H15MQ.19.67.G01.1.454.CMB.2.raw
  modified_base (295)..(295): a, c, t, g, unknown or other
  misc_feature (295)..(295): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggtttcctgctgcaatttcaggagtgtccagtgtgaggtgcaacgtggtggagactggcggagcttggccagcctgggcgtctcgtgagtactgtcctgtcgaaccctgtgggtctcgtcagcagcgactgtatcgccgtggtccnccgaggcctccgaggggtaacgacggcccgggtaaggttcggggtacgtcgtaaggtttacgtttttaggaggggttcggggaccgtaacgtacgtttccggtaaacggtacgtaaccgttcccgaggttacggggaacggggtaccccgtacgtttaccgaaaccccgtagttaccccgttacccgaaacggtaaccggtttaacccgtttttacccgtaaccggtaaaccgttaaaacccgtaaccgttaaccgttacggttaccgttaccgtttaaccgaaaacgtttcggtaaaacccgtacgggtacccgttagggtaccgggggtacccgtaaacggggtaacccgtaaccggggttcccggttaaccgttaacggtttaacgtttcggttacgggttacggtaacgggtttacggtttaaacggtcggggttaaacccggtagtttaccgggtccggttaggggttaacggtaaccggtacggtaacgttacccggtaacgggtttaccggggacccgttaaacccggggg

SEQ ID NO: 320503 - DNA, 612 bp, Homo sapiens
  misc_feature: GZ8MTXP02HJJX9.19.67.G01.1.454.CMB.2.raw
  modified_base (372)..(372): a, c, t, g, unknown or other
  misc_feature (372)..(372): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggtttcctgctgcaatttcaggaggtgtccagtgtgaggtgcaactggtggagactgggcggaggcttggtccagccgtgggcgtctctgagactgtcctgtgaaccctgtggggtctccgtcagcagcgactgtattgccgtggtccgccaggctaccgagggaagaggccggagtgggtcgcgtaggtatttttagagggtgggaccatattcgtacgganactcgagtgggaacgggccgaattccaacatcctaccaagagtactttcacaagaacacacctgtccttacttacaaaagttgaaacacgtccgaggacggggacccgaagggaccgaaccggtcccgtacttaattaagttggtagttaggaacggtagttttaagccgggtacgtaagtcgggcgttgggaagggaaacgaacggtacgtacgtacgggtaccggggaccgaaccggg

SEQ ID NO: 320504 - DNA, 559 bp, Homo sapiens
  misc_feature: GZ8MTXP02G3223.19.67.G01.1.454.CMB.2.raw
  modified_base (455)..(455): a, c, t, g, unknown or other
  misc_feature (455)..(455): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccgagggaagaggccggaggtgggtcgcgtaggttatttttagaggggttgggaccgtacgattcgtacgggagactccagtgggagggccgattccgaccatctccagagtactttcacagaacacactgtctcttacaaatgaaacngacctggacgggccgaggacacggcgtctattatgtgtgtagtagttagtggacgtagtcggctgggtcgacgagtactcgacgtcgggggaccgtaaccgggg

SEQ ID NO: 320505 - DNA, 599 bp, Homo sapiens
  misc_feature: GZ8MTXP02JQ6MY.19.67.G01.1.454.CMB.2.raw
  modified_base (538)..(538): a, c, t, g, unknown or other
  misc_feature (538)..(538): n is a, c, g, or t
  modified_base (553)..(553): a, c, t, g, unknown or other
  misc_feature (553)..(553): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttcctgctgcaatttcaggaggtgtccagtgtgaggtgcaacgtggtggagacgtgggcggaggcttggtccagccgtggggcggtctctgagactgtcctgtgaaccctgtggggtctccgtcagcagcactgtatgcctgggtccgcaggctcgagggaagaggcggaggtgggcgcgtaggttattttagagggtggaccgactagttacgtacggagaccttcaggtggggacggggccctagttccgacctaatcctaccgaagtacgtaccttttacacaagaactaccaacttcgtctacttacaaaatcgaaacagcctagggacgggccgaaggaccgacggccgtactattagttgtgtaggagtagtttacggnggtacgtacgtcggngtagggtaagaacgtagtacgtcgacggtaccggggaccgaacggg

SEQ ID NO: 320506 - DNA, 666 bp, Homo sapiens
  misc_feature: GZ8MTXP02F2J92.19.67.G01.1.454.CMB.2.raw
  modified_base (305)..(305): a, c, t, g, unknown or other
  misc_feature (305)..(305): n is a, c, g, or t
  modified_base (326)..(326): a, c, t, g, unknown or other
  misc_feature (326)..(326): n is a, c, g, or t
  modified_base (381)..(381): a, c, t, g, unknown or other
  misc_feature (381)..(381): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactgggtggagactgggcggaggcttggtccaggcctggggcggtctctgagactgtcctgtcgaccctcgtggggtctccgtcagcagcgactgtattgccgtgggtccncccaggcctccgaggggaagnggccggagtgggtcgcgtaggttattttagagggtgggaccacattcgtacgganactcagtgggacgggccattccaacctatcctaccgagtacgtaccttttcactaacgaaaccacacttcgttcctacttacaaaatcggaaacacgtcccgtagggaacggggaccgaacgggaccaacggggtcccgttacttagtttaagtttgggtagttaggtaaggttaggtttttaacggacggggtacgtaacggttcggggtacggttagggggtaacggtaaacgtaacggtacgtacccggaacggggttaccgggggaacccgtaaacggggg

SEQ ID NO: 320507 - DNA, 544 bp, Homo sapiens
  misc_feature: GZ8MTXP02JQN6M.19.67.G01.1.454.CMB.2.raw
  modified_base (379)..(379): a, c, t, g, unknown or other
  misc_feature (379)..(379): n is a, c, g, or t
  modified_base (395)..(395): a, c, t, g, unknown or other
  misc_feature (395)..(395): n is a, c, g, or t
  modified_base (411)..(411): a, c, t, g, unknown or other
  misc_feature (411)..(411): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtgggcggaggcttggtccagccgtgggcggtctctgagactgtcctgtcgaccctctggggtctccgtcagcagcgactgtattgcctgggtccgccaggctccgagggaagaggccggagtgggtcgcgaggtatttttagaggtggaccgacattctacggagactccngtggaggccgatcacntctcagagtactttcncagaacacactgtctctacaaatgaacacgacgtgacgggaccgaggaccgacggccgtctattactgtgtgaggtagtttagtggacgagtcggcgtggtggacagactcgacggtcggggactaaccgggg

SEQ ID NO: 320508 - DNA, 676 bp, Homo sapiens
  misc_feature: GZ8MTXP02IMNMD.19.67.G01.1.454.CMB.2.raw
  modified_base (381)..(381): a, c, t, g, unknown or other
  misc_feature (381)..(381): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttcctgctgcaatttcaggaggtgtccagtgtgaggtgcaactggtggagactggcggaggcttggtccagccgtgggcggtctctgagactgtcctgtcgaccctcgtggggtctccgtcagcagcgactgtatcgcctgggtccgccgaggctaccgagggagaggccgggagtgggtcgcgaggttatttttagagggtgggacgactattcgtaacgganaccgtccgaagttcgggacggggtcccgtaattaccaccctatcctaccgagtacgtactttttcactaacgaaacaacctaccgttacgtcttacctttaaccaaaagttacgtaaaccgacgaccgttacggacggggacccggaacgggtaccgaccgggtaccgttaccgtaagtttaacggttttcggtaggttaggtaacggttaagggttttaagttcggggacggttaagttcggggtcgttggggttacgggactaaggtacgtttacggaacggttaccgggggg

SEQ ID NO: 320509 - DNA, 550 bp, Homo sapiens
  misc_feature: GZ8MTXP02I9X8Q.19.67.G01.1.454.CMB.2.raw
  modified_base (389)..(389): a, c, t, g, unknown or other
  misc_feature (389)..(389): n is a, c, g, or t
tcagtactctcgtgcacgaccggtgctcgatttagagtatacatattgggtttggggggtagctcaggaagcagagcctggagcatctccactatggcctgggctccactacttctcaccctcctcgctcactgcacaggttcttgggccaactttatgctgactcagccccactctgtgtcggagtctccggggaagacggtaaccatcttttgcacccacaacagtggcaacattgccagctaattttgtgcagtggtaccagcagcgcccgggcacgttcccccacattgtgatctatgaggataatcaaagccgtctggggtccctgatcggtctcgtgcctccatcgacagctcctccaactctcgccctccctcaccatctcnggactgaaagactgaggacgaggctgactactactgtcagttcttagtgagtacgccgtacggtctagtggttcggtcgttcggggacgggtacgggaacccaaggtctacggacccgttccgtaaggtccaacggccccgagggccctcggccccctcgg

SEQ ID NO: 320510 - DNA, 696 bp, Homo sapiens
  misc_feature: GZ8MTXP02I0DXI.19.67.G01.1.454.CMB.2.raw
  modified_base (236)..(236): a, c, t, g, unknown or other
  misc_feature (236)..(236): n is a, c, g, or t
  modified_base (274)..(274): a, c, t, g, unknown or other
  misc_feature (274)..(274): n is a, c, g, or t
  modified_base (304)..(304): a, c, t, g, unknown or other
  misc_feature (304)..(304): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggacctctggttcctgcgggacatcgtgatgacccagtacccagactcactggctgtgtctctgggcgagacggccacaatcaactgcaggtccagccagaacatttcncactcaagaacaaaacttctagcctggtaccaacaganaccaggacagcctctaagtgctcatttacnggcttcacgcgcgtaacgttccggggtccctggaccgtacgtttccccggggctacggccggggttctcggggaacctagggtacttttccgaaccttcctaccaaccctatccgaagccaacggcccctaggaccaaggggtccttaggaaaggtagttgggtagggaccttaaagggtttttaacttaacgttcggttaccaaggtacctaaaatttttacgttttttccttaacttcccccgttaccgggttacgggttaaccgggtttccgggaccccgtaaaagggggtacccctaagggggttacggtaaaacttcggaaacggtaaccggtaaaccgttggtcgggacccttaggacccaacccgtaagtttccctaggtttccc

SEQ ID NO: 320511 - DNA, 688 bp, Homo sapiens
  misc_feature: GZ8MTXP02IUFGA.19.67.G01.1.454.CMB.2.raw
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaccctcgtggggtctccgtcagcagcgactgtattgcctgggtccgcaggctcgaggggaagaggccggagtgggtcgcgtaggttatttttagagggtgggaccgtactagttcgtacggagactccagtcgggaagggtcccgattccaaccgattcctcccgaagtaacgttacctttttcacgaaacgaaacacctaacgttcgttaccttacctttaaccaaaaattcggaaaacctaggtcccgtagggaacgggggacccgaaacgggaccgaaccggggtccccgttattaagtttaagtttggtaggttacggtaaggttaagtttttaaacggggtcgggtacgtacggttcggggtcggttaggggtaacggaaacgtaacggtaacgtccggtaaccgggtccgggggaacccgtaaccgggg

SEQ ID NO: 320512 - DNA, 616 bp, Homo sapiens
  misc_feature: GZ8MTXP02H8BRX.19.67.G01.1.454.CMB.2.raw
tcagtactctcgtgcacgaccggtgctcgatttagagtatacatattggggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgcaactgggtggagacgtgggcggaggcttggtccagccgtgggcggtctctgagactgtcctgtcgaaccctcgtggggtctccgtcagcagcgactgtattgcctgggtccgccaggctccgagggaaggaggccgggaggtggggtcgacgtaggttagtttttaagaggggtcggacgacgtattcgtacggagacgtccagtcggggaggccgtattcaccatctccagacgtacttttctacagaacacacttcgtacctcttacaaaagtcgaaacgcgaccgtaggacggggaccgaacgggaccgaacgggtccgtacgttagtttagttggtagtacgaaggttaggtttatcgggacacggtggtcgtgggtaacgacgagtactacgacggtcggggaccgtaaccgggg

SEQ ID NO: 320513 - DNA, 572 bp, Homo sapiens
  misc_feature: GZ8MTXP02F468Q.19.67.G01.1.454.CMB.2.raw
  modified_base (277)..(277): a, c, t, g, unknown or other
  misc_feature (277)..(277): n is a, c, g, or t
  modified_base (451)..(451): a, c, t, g, unknown or other
  misc_feature (451)..(451): n is a, c, g, or t
  modified_base (495)..(495): a, c, t, g, unknown or other
  misc_feature (495)..(495): n is a, c, g, or t
  modified_base (513)..(513): a, c, t, g, unknown or other
  misc_feature (513)..(513): n is a, c, g, or t
  modified_base (526)..(526): a, c, t, g, unknown or other
  misc_feature (526)..(526): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagtttggctgacctgggttttccttgctgcaatttcaggaggtgtccagtgtgaggtgcaactggtggagactgggcggaggcttggtccagccgtgggcggtctctgagactgtcctgtcgaaccctctggggtctccgtcngcagcgactgtatgcctgggtccgccaggctccgaggggaagacggccggaggtgggtcgcgtaggtttagttttagtagggtggaccgatagttcgacggagactccgagtgggagggccgattcgacagtctacccagacgtactttcacaagtaacactactgtctactanaaatagaacacgctaggacgggcgaggaccgacgccgtatattntgtgtagagtagtttagnggtacgagtcggngtaggggtgacgaggtactacgacggtcggggaccgtaaaccgggg

SEQ ID NO: 320514 - DNA, 618 bp, Homo sapiens
  misc_feature: GZ8MTXP02IMD9K.19.67.G01.1.454.CMB.2.raw
  modified_base (377)..(377): a, c, t, g, unknown or other
  misc_feature (377)..(377): n is a, c, g, or t
  modified_base (402)..(402): a, c, t, g, unknown or other
  misc_feature (402)..(402): n is a, c, g, or t
  modified_base (416)..(416): a, c, t, g, unknown or other
  misc_feature (416)..(416): n is a, c, g, or t
tcagtactctcgtgcacgaccggtgctcgatttagagtatacatattggggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactgggtggagactgggcggaggcttggtccagcctgggcgtctctgagactgtcctgtcgaaccctgtggggtctccgtcagcagcgactgtatcgccgtgggtccgcaggcctccgaggggaagacggcggaggtgggtcgctaggttattttagaggtggaccgactattcgacgganactcagtggagggccattcacatcncagacgtactttcncaacgaacactactcgtactactacaaattacgaacacgtaccgtagggacggggacccggaacggaccgacgggtaccgttacttagtttaagtggttagttaggtaaggttaggtttagtacgggacggtacgtgggtacgtggggttaaggaccgtaaggtacgtacggtaccggtacgggggacccgtaaaccggggg

SEQ ID NO: 320515 - DNA, 537 bp, Homo sapiens
  misc_feature: GZ8MTXP02JSJWH.19.67.G01.1.454.CMB.2.raw
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctggggcgtctctgagactgtcctgtgaaccctctggggtctccgtcagcagcgactgtattgcctggtccgcagctccagggaagaggccggaggtggtcgctaggtatttttagagggtggacgacattctacggagactccgagtcggagggccagttcaccatctccagagactttctcacgaacacactgtctacttacaaatgaaacagccgtagacgggcgaacggacacggcgtcttattatggtgtgtagagtttaggcgacgtgtgcgtgggtacgacgagactacgacggtcggg

SEQ ID NO: 320516 - DNA, 566 bp, Homo sapiens
  misc_feature: GZ8MTXP02FLJF5.19.67.G01.1.454.CMB.2.raw
  modified_base (372)..(372): a, c, t, g, unknown or other
  misc_feature (372)..(372): n is a, c, g, or t
  modified_base (412)..(412): a, c, t, g, unknown or other
  misc_feature (412)..(412): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtcgaccctcgtgggtctccgtcagcagcgactgtattgcctggtccgccaggctccgaggggaagaggccggaggtgggtcgcgtaggttattttagagggtggaccgtacattcacgganacctcagtgggaggccattcacatctcagagttactttcncagaacacactgtactcttacaaatcgaacacgccgtagggacggggaccgacggaccgacggccgttactagttagtgtgtagagttagtttacgtgggacgtagttcggcgtgggtaaggacagacgtcgacggtcgggggaccaacggggg

SEQ ID NO: 320517 - DNA, 572 bp, Homo sapiens
  misc_feature: GZ8MTXP02JHQ25.19.67.G01.1.454.CMB.2.raw
  modified_base (533)..(533): a, c, t, g, unknown or other
  misc_feature (533)..(533): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagccgtgggcgtctctgagactgtcctgtgaaccctcgtggggtctccgtcagcagcgactgtatgcctgggtccgccaggctccgaggggaagaggccgggaggtgggtcgcgtaggttatttttagagggttgggacgactattcgaacggagcctccgagtgggagggccgattccgaccatctccagacgtactttctacagaacactactgtctacttacaaatacgaacacgacctaggacgggccgaggaccgacggccgttactagttagttggtagtgagtagtttagcggtacgngtgggcgtgggtacggacgtagactacgacgtccggggg

SEQ ID NO: 320518 - DNA, 598 bp, Homo sapiens
  misc_feature: GZ8MTXP02FGFA5.19.67.G01.1.454.CMB.2.raw
  modified_base (261)..(261): a, c, t, g, unknown or other
  misc_feature (261)..(261): n is a, c, g, or t
  modified_base (440)..(440): a, c, t, g, unknown or other
  misc_feature (440)..(440): n is a, c, g, or t
  modified_base (523)..(523): a, c, t, g, unknown or other
  misc_feature (523)..(523): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctgggcggtctctgagactgtcctgtgaaccctntggggtctccgtcagcagcgactgtattgcctgggtccgcaggctcagggaagaggccggaggtgggtcgcgtaggttattttagagggtggggaccgactagttactacgggagaccttccgagtggggaagggccgtaattccgaacctaatcctacccaagtacgtacctttttcncaagaaccacacttgtctcttacaaaatgaaacaggccctaggacgggaccgaggaacgacgggtccgtactagttagttggngtacggaagtaggttttagcgggacgtagtcggcgtggaaggacgtagactacgacggtcggggaccgaacgggg

SEQ ID NO: 320519 - DNA, 556 bp, Homo sapiens
  misc_feature: GZ8MTXP02HZCJ5.19.67.G01.1.454.CMB.2.raw
  modified_base (380)..(380): a, c, t, g, unknown or other
  misc_feature (380)..(380): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccgaggggaagaggccggagtgggtcgcgaggtatttttagagggtgggaccgacatttcgacggagacctccngtgggagggtccgattccaccatcctccagagtacttttctacagaaccacactgtcttcttacaaatgaaacagcctaggacggggccgaggaccacggccgtctattatgtgtgagtagtttatggcgtagtcggcgtgggtgacgaggtatcgacgtcggggaccgaacgggg

SEQ ID NO: 320520 - DNA, 688 bp, Homo sapiens
  misc_feature: GZ8MTXP02FUX3F.19.67.G01.1.454.CMB.2.raw
  modified_base (305)..(305): a, c, t, g, unknown or other
  misc_feature (305)..(305): n is a, c, g, or t
  modified_base (336)..(336): a, c, t, g, unknown or other
  misc_feature (336)..(336): n is a, c, g, or t
  modified_base (376)..(376): a, c, t, g, unknown or other
  misc_feature (376)..(376): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtgggtggagacgtgggcggaggcttggtccagccgtggggcggtctctgagactgtcctgtcgaccctgtgggtctcgtcagcagcgactgtatcgccgtgggtccncaggctccgaggggagaggccggagtgggcncgtaggttattttagagggtggaccactattcgtacgganaccgttcgagtgggacggggtcctacttccgaactatccctaccaaggtacttaccttttacgacaaacgaaaccactaacttcgtctacttacaaagtacgaaacgacgtccgtagggaaccgggggaccgaaacgggaccgaccgggtaccgtttacgttaagtttacgttggttaggttacgggtaaggtttagggtttttaaacgggtacggggtacgttacgggttcggggtacggtttagggggaacggtaacgtaacggtacgtaccgggtaccggggtaccgggggaaccggtaaacccggggg

SEQ ID NO: 320521 - DNA, 568 bp, Homo sapiens
  misc_feature: GZ8MTXP02I727K.19.67.G01.1.454.CMB.2.raw
  modified_base (385)..(385): a, c, t, g, unknown or other
  misc_feature (385)..(385): n is a, c, g, or t
  modified_base (410)..(410): a, c, t, g, unknown or other
  misc_feature (410)..(410): n is a, c, g, or t
  modified_base (426)..(426): a, c, t, g, unknown or other
  misc_feature (426)..(426): n is a, c, g, or t
  modified_base (456)..(456): a, c, t, g, unknown or other
  misc_feature (456)..(456): n is a, c, g, or t
  modified_base (513)..(513): a, c, t, g, unknown or other
  misc_feature (513)..(513): n is a, c, g, or t
  modified_base (536)..(536): a, c, t, g, unknown or other
  misc_feature (536)..(536): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctgggcggtctctgagactgtcctgtcgaaccctctggggtctccgtcagcagcgactgtattgcctgggtccgccaggctccgagggaagaggccggagtgggtcgcgagggttatttttagtagggtgggaccgactattcgtacggagactccgngtgggacgggccgattccacatccnccagtacgtactttcncaagaacacactgtctactacaaatgaacngcctggacgggccgaggaccacggccgtacttagttagttgtgtagagtagtttagnggtacgagtcgggcttagggggngtacgagtacgtcgacggtcgggacgaacggg

SEQ ID NO: 320522 - DNA, 657 bp, Homo sapiens
  misc_feature: GZ8MTXP02H72JP.19.67.G01.1.454.CMB.2.raw
  modified_base (329)..(329): a, c, t, g, unknown or other
  misc_feature (329)..(329): n is a, c, g, or t
  modified_base (385)..(385): a, c, t, g, unknown or other
  misc_feature (385)..(385): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgaccttgggttttccttgctgcaatttcaggaggtgtccagtgtgaggtgcaactgggtggagacgtgggcggaggcttggtccaggccgtgggcggtctcgtgagactgtcctgtcgaaccctcgtgggtctcgtcagcagcgactgtattgccgtcgggtccgccgaggctaccgaggggaagnggccggaggtgggtcgcgtaggttatttttagagggtggaccgatagttcacgganactccgagtgggaggccgtagttccaccatccaccagacgttactttcacaacgtaacactacttcgtccttacttacaaaattcgaaaccaggtccgtacgggacggggacccgaagggaaccgacgggtcccgttacgtttaagtttaagtttggtaggttacggtaaggtttaggtttaacgtggggtaccgtaaggttcgggtacgttggggtaaggaccgtaaggtacgtaccggtaacgggtcgggggtacccgtaaacccggggg

SEQ ID NO: 320523 - DNA, 586 bp, Homo sapiens
  misc_feature: GZ8MTXP02FO6EE.19.67.G01.1.454.CMB.2.raw
  modified_base (187)..(187): a, c, t, g, unknown or other
  misc_feature (187)..(187): n is a, c, g, or t
  modified_base (280)..(280): a, c, t, g, unknown or other
  misc_feature (280)..(280): n is a, c, g, or t
  modified_base (443)..(443): a, c, t, g, unknown or other
  misc_feature (443)..(443): n is a, c, g, or t
  modified_base (475)..(475): a, c, t, g, unknown or other
  misc_feature (475)..(475): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagtttggctgacctgggttttcctgctgcaatttcaggaggtgtccagtntgaggtgcaactgtggagactgggcggaggcttgggtccaggcctggggcggtctctgagactgtccctgtgaacccctctggggtctccgtnagcagcgactgtattgcctgggtccgccaggcctccgaggggaagaggcccgggaggtggggttcgctaggttattttttaagacgggtggggacgactagttcgtacggagacctccaagtggaggggcctattccacctatcctcccagaacgtactttcncagaaacacactgtctcttacaaatgaaaccncgccgtaggaccgggccgaacgggaccgaccggtccgtattagttagttgtagtaggtacgtagtttagtcggacgagtggcgtggtacgacagtactacgacggtcgggg

SEQ ID NO: 320524 - DNA, 578 bp, Homo sapiens
  misc_feature: GZ8MTXP02ILVVN.19.67.G01.1.454.CMB.2.raw
  modified_base (263)..(263): a, c, t, g, unknown or other
  misc_feature (263)..(263): n is a, c, g, or t
  modified_base (524)..(524): a, c, t, g, unknown or other
  misc_feature (524)..(524): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctggggcggtctctgagactgtcctgtcgaaccctntggggtctccgtcagcagcgactgtattgcctggggtccgccaggcctccgaggggaagaggccgggagtggggtcgcgtaggttatttttagagggttggggaccgtacattcgtacgggagaccgttccagtgggacggggcccgattccacatcctccagacgtactttctcaagaacacactgtactcttacaaaatcgaaacacgccgtggacgggccgaggacgacggctctattagtgtgtagtagagtttagnggacgagtcggtcgtgggtggaacagtactcgacggtcgggggacctaacgggg

SEQ ID NO: 320525 - DNA, 588 bp, Homo sapiens
  misc_feature: GZ8MTXP02F3V5Z.19.67.G01.1.454.CMB.2.raw
  modified_base (192)..(192): a, c, t, g, unknown or other
  misc_feature (192)..(192): n is a, c, g, or t
  modified_base (304)..(304): a, c, t, g, unknown or other
  misc_feature (304)..(304): n is a, c, g, or t
  modified_base (320)..(320): a, c, t, g, unknown or other
  misc_feature (320)..(320): n is a, c, g, or t
  modified_base (336)..(336): a, c, t, g, unknown or other
  misc_feature (336)..(336): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttcctgctgcaatttcaggaggtgtccagtgtgaggtncaacgtgggtggagacgtgggcggaggcttggtccaggccgtggggcgtctcgtgagactgtcctgtcgaccctcgtgggtctccgtcagcagcgactgtatgccgtggccncaggctccgagggagnggccggagtgggtcgngtaggttatttagagggtggaccgtactagttcgacggagacctcgagtgggacgggtccgattccgactatcctaccgagtacgtacttttacacaacgaacactactgttctacttacaaatcgaaacacgtcgtaggacgggaccgacggacgacggtccgtacttattagtgtgtagtagttagttaggtggacgtagtcggtgtgggtcgaagagtacgtacgacggtcggggaccgtaaaccgggg

SEQ ID NO: 320526 - DNA, 525 bp, Homo sapiens
  misc_feature: GZ8MTXP02IMCNS.19.67.G01.1.454.CMB.2.raw
  modified_base (408)..(408): a, c, t, g, unknown or other
  misc_feature (408)..(408): n is a, c, g, or t
  modified_base (441)..(441): a, c, t, g, unknown or other
  misc_feature (441)..(441): n is a, c, g, or t
  modified_base (452)..(452): a, c, t, g, unknown or other
  misc_feature (452)..(452): n is a, c, g, or t
tcagtactctcgtgcacgaccggtgctcgatttagagtatacatattgggtttgggggtagctcaggaagcagagcctggagcatctccactatggcctgggctccactacttctcaccctcctcgctcactgcacaggttcttgggccaactttatgctgactcagccccactctgtgtcggagtctccggggaagacggtaaccatcttttgcacccacaacagtggcaacattgccagcaattttgtgcagtggtaccagcagcgcccgggcacgttcccccaccattgtgatctatgaggataatcaaaagaccgtcgtggggtcccctgatcggttctctcggctccatcgacacgcctcctccaactctcgccctcctcaccctatcctctggactgaagcngaggcgaggcctgactacatgtcagtcttaagngatcgcgcgtnagtgtcgtcgtacgggcggacggaacacgcgtacgaccgtcgtaacgtcgacgccgacggcctccgccccgtg

SEQ ID NO: 320527 - DNA, 738 bp, Homo sapiens
  misc_feature: GZ8MTXP02HOJDL.19.67.G01.1.454.CMB.2.raw
  modified_base (303)..(303): a, c, t, g, unknown or other
  misc_feature (303)..(303): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagccgtgggcgtctctgagactgtcctgtcgaaccctcgtcggggtctccgtcagcagcgactgtattcgcctgggtccncgacggctaccgaggggaagaggccggaggtgggtcgcgtaggttaagtttttagagggtggaccgtacagttcgtacggagtacctccgagtgggacggggaccgtagtttaccaacctacttcccgtacccgtaaggtaacggttaacccttttttaccgacctaacggtaaaaccctaacctaaaccgtttccggttcctttaccgtttaaacctaaaacgtacgttaaaacccgaacgggtacccgttaacggggacgggggacccggtaacggggacccgaaacccggggtcccgtttaccgttaagtttacgtttagggtgttacggtaagggttaggttttaacgtgggtacgtaggtcggtcggttacggggttggaaccgtaaggtacgtaccgtacggtaccgggggttaccggaaacccggggg

SEQ ID NO: 320528 - DNA, 557 bp, Homo sapiens
  misc_feature: GZ8MTXP02HKL1L.19.67.G01.1.454.CMB.2.raw
  modified_base (301)..(301): a, c, t, g, unknown or other
  misc_feature (301)..(301): n is a, c, g, or t
  modified_base (420)..(420): a, c, t, g, unknown or other
  misc_feature (420)..(420): n is a, c, g, or t
  modified_base (482)..(482): a, c, t, g, unknown or other
  misc_feature (482)..(482): n is a, c, g, or t
  modified_base (504)..(504): a, c, t, g, unknown or other
  misc_feature (504)..(504): n is a, c, g, or t
tcagtactctcgtgcacgaccggtgctcgatttagagtatacatattgggtttgggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactggtccctgtgaacccctgtggggtctccgtcagcagcgactgtattgcctgggtccnccaggctccgagggaagaggccggagtgggtcgcagggtatttttagaggtgggaccgacattcgtacggagactccgatgggaggcccgattccaccatcctaccagagtacttttcnagaaacacactgtctcttacaaaatgaaaccagcctggagggcccgaggaccacggcccgtntattatgtgtgagtagtttagnggactagtcggtacgtggtaagacaggactacgacggtcggggaccgaacggg

SEQ ID NO: 320529 - DNA, 539 bp, Homo sapiens
  misc_feature: GZ8MTXP02JSTQM.19.67.G01.1.454.CMB.2.raw
  modified_base (365)..(365): a, c, t, g, unknown or other
  misc_feature (365)..(365): n is a, c, g, or t
  modified_base (418)..(418): a, c, t, g, unknown or other
  misc_feature (418)..(418): n is a, c, g, or t
  modified_base (430)..(430): a, c, t, g, unknown or other
  misc_feature (430)..(430): n is a, c, g, or t
  modified_base (447)..(447): a, c, t, g, unknown or other
  misc_feature (447)..(447): n is a, c, g, or t
  modified_base (452)..(452): a, c, t, g, unknown or other
  misc_feature (452)..(452): n is a, c, g, or t
  modified_base (494)..(494): a, c, t, g, unknown or other
  misc_feature (494)..(494): n is a, c, g, or t
  modified_base (512)..(512): a, c, t, g, unknown or other
  misc_feature (512)..(512): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaccctcgtggggtctccgtcagcagcgactgtattgcctggtccgccaggctccgaggggagaggccggaggtgggtcgcgtaggttatttttagagggtgggacccgtanatttcacggagactccagtgggagggccgattcacatctccagagtactttcncagaacacactntctctacaaatgaaacncgcgnggacggcgacgacgacggctatattagtgagtgagtagttgnggacgtagtcggtgtggngagacgactcgacggtcgggacgacgg

SEQ ID NO: 320530 - DNA, 605 bp, Homo sapiens
  misc_feature: GZ8MTXP02G8B6J.19.67.G01.1.454.CMB.2.raw
  modified_base (331)..(331): a, c, t, g, unknown or other
  misc_feature (331)..(331): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagactgggcggaggcttggtccaggcccgtggggcggtctcgtgagtactgtcctgtcgaaccctcgtggggtcctccgtcagcagcgactgtatcgcgtggtccgcgaggctccgagggaagnggccggaggtgggcgcgtaggttattttagtaggtgggacgtactagttcgtaacggacgactccgagtcggggacgggccgtactttccaaccatcctaccgagtacgtactttctacacgaactactacgtactcttacttactaaatacgtaacacgccgtaggacgggaccgacggacgaacggccgtacgtagttattaggtgtaggtagtagttagtcggacgtagtggtcgttgggtacggacgtagtacgtcgtacggtaccgggg

SEQ ID NO: 320531 - DNA, 631 bp, Homo sapiens
  misc_feature: GZ8MTXP02IEYWZ.19.67.G01.1.454.CMB.2.raw
  modified_base (299)..(299): a, c, t, g, unknown or other
  misc_feature (299)..(299): n is a, c, g, or t
  modified_base (302)..(302): a, c, t, g, unknown or other
  misc_feature (302)..(302): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttcctgctgcaatttcaggaggtgtccagtgtgaggtgcaactggtggagacgtgggcggaggcttggccagcctgggcgtcgtctgagacgtgtcctgtgaccctgtgggtctcgcagcagcgactgtattgcctggggtccccncgnggctcggaagggagcggcggaggtcgggtcgcgtaggtttatttaggaggggtggaacccgtactacgttcggacggactaccgtcgagggtcggggacggtccgtactccgaactactcctaccgagtacgttactttcgacgaacgaactactacttgtcttactactaaacgtaacgaacgacgtaccgacgggacgggaccggacggaccgacggtaccgtacgttagttagttagtaggtaggtaggttaggttacgtaggacggtacgtcggtacgtggtaacggtacgacgtacgtacggtacggtacgggtaccggtacgg

SEQ ID NO: 320532 - DNA, 713 bp, Homo sapiens
  misc_feature: GZ8MTXP02HU2LJ.19.67.G01.1.454.CMB.2.raw
tcagtactctcgtgcacgaccggtgctcgatttagagtatacatattgggtttggggggagaggagcccagcactgggattccgaggtgtttccattcggtgctcagcactgaacacagaggactcaccatggagttttggctgaccttgggttttccttgctgcaatttcaggaggtgtccagtgtgaggtgcaactggtggagacgtgggcggaggcttggtccaggccgtgggcggtctctgagactgtcctgtcgaccctcgtgggtcctccgtcagcagcgactgtattgccgtgggtccgccgaggcctaccgaggggaagacgggccgggaggtcggggtcgcgtagggtttatttttagaggggttcggggaccgactagttcgtaacggaagtacgtccaggtgggaacgggtcccgtatttccaacccacttccctaccctaagtagttaccttttctacaacgaaacactaccttgttacctactttaacgaaaactcgaaaccacgtacccgtagggaaccgggggacccgaacgggaacccgaccgggtcccgttacgttaagttttaacgttggtttaggtaggtaacggtttaggtttaacgtgggggacgtaacggttcggggttaccgtgggggttaacggaaccgtaaggtaccgttaacccgacgggtacgggggtaccccgtaaacccggggg

SEQ ID NO: 320533 - DNA, 594 bp, Homo sapiens
  misc_feature: GZ8MTXP02I6CNO.19.67.G01.1.454.CMB.2.raw
  modified_base (319)..(319): a, c, t, g, unknown or other
  misc_feature (319)..(319): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtcgaaccctcgtggggtctccgtcagcagcgactgtatgcctgggtccgccaggctccgaggggaagnggccgggagtggggtcgcgaggttatttttagagggtgggaccgacagttcgtacggagacctccgagtcggggacggggccgtattccgaaccatccctaccgagtacgtacctttttcacaacgaaacaccgactgtccttcttacaaaatgaaacacgccgtaggacggggacccgaggaccgacggccgtactagttatgtgtagagttagtttagtggcgtagtcggcgttgggtgtacgagtactcgacggtcggggacctaaccgggg

SEQ ID NO: 320534 - DNA, 567 bp, Homo sapiens
  misc_feature: GZ8MTXP02JMZGX.19.67.G01.1.454.CMB.2.raw
  modified_base (320)..(320): a, c, t, g, unknown or other
  misc_feature (320)..(320): n is a, c, g, or t
  modified_base (370)..(370): a, c, t, g, unknown or other
  misc_feature (370)..(370): n is a, c, g, or t
  modified_base (413)..(413): a, c, t, g, unknown or other
  misc_feature (413)..(413): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctgggcggtctctgagactgtcctgtcgaaccctgtggggtctccgtcagcagcgactgtattgcctgggtccgccaggctccgagggaagnggccggagtgggcgcaggtatttttagagggtggaccgacattctaaggngactcagtggagggccagtcacatctaccagacgtactttcanaagaacacactgtctacttacaaatgaaacagcctaggacgggacaggacacggtccgtacttagttagttgagtgtaaggtagtttagacgggacgtagtgggtctggggtaaggaactagaacgtcacgggtcgggggacccgtaaacgggg

SEQ ID NO: 320535 - DNA, 576 bp, Homo sapiens
  misc_feature: GZ8MTXP02GO3U3.19.67.G01.1.454.CMB.2.raw
  modified_base (381)..(381): a, c, t, g, unknown or other
  misc_feature (381)..(381): n is a, c, g, or t
  modified_base (523)..(523): a, c, t, g, unknown or other
  misc_feature (523)..(523): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttcctgctgcaatttcaggaggtgtccagtgtgaggtgcaactggtggagactggcggaggcttggtccagcctgggcgtctctgagactgtcctgtgaaccctcgtggggtctccgtcagcagcgactgtattgcctgggtccgccagggctccgagggaagaggccggagtgggtcgcgtagggttatttttagaggggtgggaccgactagttacgtacggganacttccaggtgggaacggggtccattccgaaccatcctacagagtacttttcacaagaacactactgtctactacaaaatgaaacagcctaggacggccgaggaccgacggcctagtacttagtgtagtagagtagtttagnggacgtagtcggtgtggtaaggacgacgactcgacgggtcgggaccgaacggg

SEQ ID NO: 320536 - DNA, 546 bp, Homo sapiens
  misc_feature: GZ8MTXP02HXOXW.19.67.G01.1.454.CMB.2.raw
  modified_base (377)..(377): a, c, t, g, unknown or other
  misc_feature (377)..(377): n is a, c, g, or t
  modified_base (411)..(411): a, c, t, g, unknown or other
  misc_feature (411)..(411): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgaccttgggttttccttgctgcaatttcaggaggtgtccagtgtgaggtgcaactggtggagacgtggcggaggcttggtccagccgtgggcggtctctgagactgtcctgtcgaacccctcgtggggtctccgtcagcagcgactgtatgcctgggtccgccaggctccgagggaagaggccggaggtgggtcgcaggtatttttagaggtggacgacattcacggagactcngtggaggccgattcacatcctcagagtcgtttcncagacacactgtcctctacaaatgtaacagcctgacgggccgaggaccacggccgtactattagtgtgtgtagtagttagtggagtagtgcgtggtggacgtagactcgtaacgtcggggtaccgaaacccgggg

SEQ ID NO: 320537 - DNA, 651 bp, Homo sapiens
  misc_feature: GZ8MTXP02GBPLN.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttcctgctgcaatttcaggaggtgtccagtgtgaggtgcaactggtggagacgtgggcggaggcttggtccaggccgtggggcggtctcgtgagactgtcctgtcgacctgtgggtctcgtcagcagcgactgtatcgccgtggtccgcaggcctaccggaaggggaagacgggccggaggtcgggtcgcgtaggttattttagagggtggaccgactagttcgaacgggataccttcgaggtcgggacggggtcctattccgactatcctaccgagtacgtactttcacagaacactacgttcgtcttacttacaaattcgaaaccgcggtaccgtagggacggggaccgaacggaccgaccggtaccgttagttactttagttggtagtacggtaggttagtttaacggtgggtacgtaggttcggtcggtttagggaacggtaacgtaaggtacgttaccggaacgggttccgggggaaccgtaaacccggggg

SEQ ID NO: 320538 - DNA, 576 bp, Homo sapiens
  misc_feature: GZ8MTXP02IUB4Z.19.67.G01.1.454.CMB.2.raw
  modified_base (300)..(300): a, c, t, g, unknown or other
  misc_feature (300)..(300): n is a, c, g, or t
  modified_base (302)..(302): a, c, t, g, unknown or other
  misc_feature (302)..(302): n is a, c, g, or t
  modified_base (360)..(360): a, c, t, g, unknown or other
  misc_feature (360)..(360): n is a, c, g, or t
  modified_base (372)..(372): a, c, t, g, unknown or other
  misc_feature (372)..(372): n is a, c, g, or t
  modified_base (379)..(379): a, c, t, g, unknown or other
  misc_feature (379)..(379): n is a, c, g, or t
  modified_base (428)..(428): a, c, t, g, unknown or other
  misc_feature (428)..(428): n is a, c, g, or t
  modified_base (456)..(456): a, c, t, g, unknown or other
  misc_feature (456)..(456): n is a, c, g, or t
  modified_base (512)..(512): a, c, t, g, unknown or other
  misc_feature (512)..(512): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtgggcggaggcttggtccagccgtgggcgtctctgagactgtcctgtcgaccctcgtgggtctccgtcagcagcactgtatgcctggtccncnggctccgagggagaggccggagtgggcgcgtaggttattttagagggtggaccgtacngtttcgacgganaccttcngtgggacgggccattccacatcctcagtacgtactttcgtcaagaaacnctaactgtctcttacaaaatcggaaacngcctaggacgggaccgacggacacggtcgtactattagtgtgtagagtagtttagngggcgtagtcggcggttgggtaacgaacgtacgactacggacggtacgggggaccctaacgggg

SEQ ID NO: 320539 - DNA, 558 bp, Homo sapiens
  misc_feature: GZ8MTXP02HV9DX.19.67.G01.1.454.CMB.2.raw
  modified_base (424)..(424): a, c, t, g, unknown or other
  misc_feature (424)..(424): n is a, c, g, or t
  modified_base (505)..(505): a, c, t, g, unknown or other
  misc_feature (505)..(505): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtcgaaccctctggggtctccgtcagcagcgactgtattgcctggtccgccaggctccagggaagaggccgggagtgggtcgcgaggtatttttagaggtgggaccgactattctacggagacttccagttgggaggggccgattcgaccaatcctcccagacgtaacttttcncaagtaacacactgtctcttcaaattgaaacagcctagagggccgaggacacggcgtctattatgtgtgagtagtttaagnggcgtagtggtctgggtggactaggatcgaactcgggggaccgtaaaccgggg

SEQ ID NO: 320540 - DNA, 621 bp, Homo sapiens
  misc_feature: GZ8MTXP02HENHY.19.67.G01.1.454.CMB.2.raw
  modified_base (299)..(299): a, c, t, g, unknown or other
  misc_feature (299)..(299): n is a, c, g, or t
  modified_base (318)..(318): a, c, t, g, unknown or other
  misc_feature (318)..(318): n is a, c, g, or t
  modified_base (579)..(579): a, c, t, g, unknown or other
  misc_feature (579)..(579): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagccgtgggcggtctctgagctgtcctgtgaccctgtgggtctccgtcagcagcgactgtattgccgtgggtccncaggcctccgaggggaagnggccggaggtggggtcgcgtaggtttaatttttagaaggggttggggaaccgtacagtttccgtaacgggagacccttccgaggttggggacggggacccgtagttcccgaaccattccctacccgaagtaacgtaccttttcacaacgtaaacactactcgtctacttacaaattgaaacacgccgtaggacgggacccgaggaccgacggtccgtacttagttagttgtgtagtagttaggtttatggacgtagtcggngtggtggacagtacgtacgtacgacggggtaccgaaccgggg

SEQ ID NO: 320541 - DNA, 583 bp, Homo sapiens
  misc_feature: GZ8MTXP02JYYUW.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtcgcaactggtggagactgggcggaggcttggtccagcctgggcggtctctgagactgtcctgtcgaacccctcgtggggtctccgtcagcagcgactgtattgcctgggtccgccaggctccgagggaagaggccggaggtgggtcgctaggttatttttagagggttgggaccgactagtttcgtacggagacctccgagtgggagggccgattccacatcctccagtacgtacttttctacagtaacactactgtctcttacaaatgaaacagccgtaggacgggccgagaccgacggcgttactagttagttgtagtaggagtagtttacgtaggcgtacgtggtcgtgggtgacgtagactcgacggtcgggggacgtaacccgggg

SEQ ID NO: 320542 - DNA, 600 bp, Homo sapiens
  misc_feature: GZ8MTXP02I0J18.19.67.G01.1.454.CMB.2.raw
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttcctgctgcaatttcaggaggtgtccagtgtgaggtgcaactggtggagacgtgggcggaggcttggtccagccgtggggcggtctctgagactgtcctgtcgaccctgtggggtctccgtcagcagcgactgtatgcctggtccgcaggctcgagggagaggccggagtgggtcgctaggttattttagagggtggaccgactagttcgtacggagacctccgaggtgggacggggccgtagttccaaccgtatcctacccagtacgttacctttttcacgtaagaaccactacttcgtacttacttacaaaatcgaaacacgtccgtggacggggaccgaacggacgaccgggcgtacttagtttagttggttgtaggagttagtttacgtggacgtagtcggtgtaggtggacagacgtcgacggtcggggaccgtaacgggg

SEQ ID NO: 320543 - DNA, 638 bp, Homo sapiens
  misc_feature: GZ8MTXP02H7TAK.19.67.G01.1.454.CMB.2.raw
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtggcggaggcttggtccagccgtgggcggtctcgtgagactgtcctgtacgaccctgtgggtctcgtcagcagcgactgtattcggccgtgggtcccgccgagggcctaccgaaggggaaggacggggccgggaggtggggtcgtacgtagggtttagtttttaaggaggggtcgggtaccgactagtttccgaacggagaccttaccgagtgggggaacggcccgtaagttccaacccgtattcccaccgtagacgttactttcacaacgactacactgtcctacttaacgaaatgaactacgccgtaggacgggccgaggaccgacggtccgtagttagtttaagtggtagtaggagtttagttaagtggacgtagtgggtcgttgggaagtacgaagtactaccgacggtcggggtaccgaaccgggg

SEQ ID NO: 320544 - DNA, 575 bp, Homo sapiens
  misc_feature: GZ8MTXP02II1FE.19.67.G01.1.454.CMB.2.raw
  modified_base (386)..(386): a, c, t, g, unknown or other
  misc_feature (386)..(386): n is a, c, g, or t
  modified_base (409)..(409): a, c, t, g, unknown or other
  misc_feature (409)..(409): n is a, c, g, or t
  modified_base (422)..(422): a, c, t, g, unknown or other
  misc_feature (422)..(422): n is a, c, g, or t
  modified_base (432)..(432): a, c, t, g, unknown or other
  misc_feature (432)..(432): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactgggtggagactgggcggaggcttggtccaggccgtggggcggtctctggagactgtcctgtcgaaccctcgtggggtctccgtcagcagcgactgtattgcctgggtccgcaggcctccgaggggagacgggcggaggtgggtcgcaggtatttttagagggtggacgacagttctacggagactccngtgggaggccgattccgacatcncagagtactttcncaacgacacnctcgtctcttacaaattagaacacgtccgtggacgggccgaggaccgacggcctcgtattagttcgtggtgtaggttagttagtggtacgagtggcgtgggtggacgagtacgacgtacggtcgggggtaccgaaaccggggg

SEQ ID NO: 320545 - DNA, 559 bp, Homo sapiens
  misc_feature: GZ8MTXP02GXMPB.19.67.G01.1.454.CMB.2.raw
  modified_base (302)..(302): a, c, t, g, unknown or other
  misc_feature (302)..(302): n is a, c, g, or t
  modified_base (319)..(319): a, c, t, g, unknown or other
  misc_feature (319)..(319): n is a, c, g, or t
  modified_base (370)..(370): a, c, t, g, unknown or other
  misc_feature (370)..(370): n is a, c, g, or t
  modified_base (375)..(375): a, c, t, g, unknown or other
  misc_feature (375)..(375): n is a, c, g, or t
  modified_base (503)..(503): a, c, t, g, unknown or other
  misc_feature (503)..(503): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagccgtgggcggtctctgagactgtcctgtcgaaccctgtggggtctccgtcagcagcgactgtatcgcctgggtccncaggctccgagggaagnggccggagtgggtcgcgaggttattttagagggtggaccacattcacgganactcngtcgggagggccattcacatctccagagtacttttcactaagaactacactcgtctcttacaaaatgaaacagcctaggacgggccgaggaccgacggccgtactattagtgtgtagagtagtttagnggacgtagtcggcgttgggaagacgagactcgacggtcgggggaccaaaccggggg

SEQ ID NO: 320546 - DNA, 591 bp, Homo sapiens
  misc_feature: GZ8MTXP02HPZXW.19.67.G01.1.454.CMB.2.raw
  modified_base (357)..(357): a, c, t, g, unknown or other
  misc_feature (357)..(357): n is a, c, g, or t
  modified_base (374)..(374): a, c, t, g, unknown or other
  misc_feature (374)..(374): n is a, c, g, or t
  modified_base (522)..(522): a, c, t, g, unknown or other
  misc_feature (522)..(522): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctcgtggggtctccgtcagcagcgactgtatgcctggtccgccaggctccgagggaagaggccggagtgggtcgcaggttatttttagaggtggaccganagttctacggagactcngtgggagggccgattccacatcctccagacgtactttcgactaagaactacacttgtctacttacaaatagaaacacgtccgtaggacgggggaccgacgggaccacgggcccgtacttaatttagttggtgtaggagttaggtttangggtacgtagtcgggtcgtgggtaacggtacgaaggtactacggacggtcgggggtacgaacccggggg

SEQ ID NO: 320547 - DNA, 722 bp, Homo sapiens
  misc_feature: GZ8MTXP02HNE0A.19.67.G01.1.454.CMB.2.raw
  modified_base (191)..(191): a, c, t, g, unknown or other
  misc_feature (191)..(191): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttcctgctgcaatttcaggaggtgtccagtgtgaggtncaactggtggagacgtggcggaggcttggtccagccgtgggcggtctctgagactgtcctggtgaaccctcgtgggtctccgtcagcagcgactgtattgccgtcgggtccgccagggctccgaaggggaaggagggcccgggaggtgggtcgcgagggttagtttttaagtagggtaggggacccgaactagttacgtaaccgggagtaccttaccgagtggggaacggggcccgtaagttccaaccatcctacccaaggaacgtaccttttactacgaacgaaaccaacctaacttcgtaccttcctttaacaaaattacgaaaaccacgacccgtaggaacgggggacccgaaggaacccgacgggtacccccggttacgtttaaatttaacgtttgggttagttagggtaaacggttaaggtttttaacgacggggtacgtaaacggttcggggacgttaggggttgggaaaccgaaggtaacgttaccgaaccgggttaccgggggacccggtaaaaccccggggg

SEQ ID NO: 320548 - DNA, 773 bp, Homo sapiens
  misc_feature: GZ8MTXP02G7TGA.19.67.G01.1.454.CMB.2.raw
tcagtactctcgtgcacgaccggtgctcgatttagagtatacatattgggtttggggggagaggagcccagcactgggattccgaggtgtttccattcggtgctcagcactgaacacagaggactcaccatggagttttggctgaccttgggttttccttgctgcaatttcaggaggtgtccagtgtgaggtgcaactggtggagacgtggcggaggcttggtccagccgtgggcggtctctgagactgtcctgtcgaccctcgtgggtctcgtcagcagcgactgtatgccgtgggtccgccgaggcctccgaggggaaggacggaccggaggtcggggtcgcgtaggttagtttttagaggggttgggaccgacgtattcgtaacgggaagtacctaccgagtgggggaaacgggggcccgtaaagtttacccgaaacccgtacgttacccgtaccccgtaaaggtaaccggtttaaacccttttttacccgtaccgtaaaacggaaaacccttaaacccgtaaaccgtttcggtttacccttacctttaaacctaaaaacgtacggtaaaaccgtacggtaccccgttaggggaaccgggggaccccggggaaacgggaccgtaacccggggacccgtttacgttaagtttaagtttgggttaggttaggtaagggtttagttttaagtcggggacgtagttcggggtcgttagggggtcggaaacgtacggacttcggaaccggtcgggggtacccgtaaaaccggggg

SEQ ID NO: 320549 - DNA, 741 bp, Homo sapiens
  misc_feature: GZ8MTXP02I0L3A.19.67.G01.1.454.CMB.2.raw
  modified_base (310)..(310): a, c, t, g, unknown or other
  misc_feature (310)..(310): n is a, c, g, or t
  modified_base (313)..(313): a, c, t, g, unknown or other
  misc_feature (313)..(313): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttcctgctgcaatttcaggaggtgtccagtgtgaggtgcaacgtggtggagacgtgggcggaggcttggtccaggcccgtgggcggtcgtctggacgacgtcgtcctgtacgaccctgtgggtctcgtcagcagcgtactgtactgccgtcggtccnccngtcaccgagggaacgcggccggaggtcgggtcgacgttaaggtttatttttaggaggggtacggaccgtaacgtacgttcgtaacgggtacgtacccttaccgaggggttaccggggaacggggtaccctacgtttacccaaacccgtcttacccttaccgaaacgttaccggtttaccgttttaccaacggtaaacgtaaacccaaccttaacgttcttacccttaattaactaaaacgtacgaaaccggaacgttcccggtaggggaaccggggaccggaaacggacccgtaccggggtaacccgtttagttaagtttacgtggtaaggttacgggtagtttacggttggacggtcggtaggttacgggtggtaggtaacgtaacgtacggtacgtacggaccggggtaccgggaacccggtacgg

SEQ ID NO: 320550 - DNA, 608 bp, Homo sapiens
  misc_feature: GZ8MTXP02F43PY.19.67.G01.1.454.CMB.2.raw
  modified_base (299)..(299): a, c, t, g, unknown or other
  misc_feature (299)..(299): n is a, c, g, or t
  modified_base (552)..(552): a, c, t, g, unknown or other
  misc_feature (552)..(552): n is a, c, g, or t
  modified_base (567)..(567): a, c, t, g, unknown or other
  misc_feature (567)..(567): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctggggcggtctctgagactgtcctgtgaccctcgtggggtctccgtcagcagcgactgtatgcctgggtccncaggcctccgaggggaagacgggccgggagtcggggtcgcgtaggttattttagagggtggaccgacagttcacggagacctccgagtggggacgggaccgtattccgaacctatcctaccgagtacgtacttttcacaagaacacctactcgtctacttacaaaatcgaaacacgtcctagggaacggggaccgacgggaacgaccgggccgttacttagtttaagtggtagttacgaggttagttttaggnggtacgtacgtcggngtaggtaacgacagtactacgacggtcggggaccgtacggg

SEQ ID NO: 320551 - DNA, 715 bp, Homo sapiens
  misc_feature: GZ8MTXP02I2TWB.19.67.G01.1.454.CMB.2.raw
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctggggcggtctctgagactgtcctgtcgaaccctcgtggggtctccgtcagcagcgactgtattgcctgggtccgccaggcctccgagggaagaggccggagtggggtcgcgaggttatttttagagggttggggaccgactagttcgtacgggagaccttcccgagtcggggaggggcctacttccaccatccctccagtacgtacttttcacaagaaaccactactgtcctcttacaaattacgaaacctacgcccgttagggacgggggtacccgaaacggggacccgtaaccggggtcccggttaacttaagttttaacgttgggttacgggtttacggtaaacgggtttaaagggtttttaacgtacgggggtcggtaaagggtttcgggggacccggtttgggggtaaggggtaaccggtaacgggtacggttacccgtaaccggggtttaccggggggaaccccggttaaaacccgggggg

SEQ ID NO: 320552 - DNA, 602 bp, Homo sapiens
  misc_feature: GZ8MTXP02JCIBM.19.67.G01.1.454.CMB.2.raw
  modified_base (306)..(306): a, c, t, g, unknown or other
  misc_feature (306)..(306): n is a, c, g, or t
  modified_base (551)..(551): a, c, t, g, unknown or other
  misc_feature (551)..(551): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttgggtccagcccgtggggcggtctctgagactgtcctgtcgaaccctgtggggtctccgtcagcagcgactgtattgcctgggtccncaggcctaccgaggggaagaggccgggagtcgggtcgacgtaggtttatttttagaggggtcggggaccgtactatttcgaacgggagaccttcagtcggggaggggcctaattcaaccatcctaccagtagtacttttacacaagaaacactactgtccttacttaacaaaactagaaaccacgccgtaggacggggaccgaacgacgacggtccggtactattatgtgttgagtagtttacgnggtcgacgtggcgtggtaacgacgacgcgtacgacggtcggggacgaacgg

SEQ ID NO: 320553 - DNA, 586 bp, Homo sapiens
  misc_feature: GZ8MTXP02G4N64.19.67.G01.1.454.CMB.2.raw
  modified_base (299)..(299): a, c, t, g, unknown or other
  misc_feature (299)..(299): n is a, c, g, or t
  modified_base (525)..(525): a, c, t, g, unknown or other
  misc_feature (525)..(525): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagccgtgggcggtctctgagactgtcctgtcgaccctctggggtctccgtcagcagcgactgtatgcctggtccncaggctcgaggggaagaggccggagtggggtcgctagggtatttttagagggtgggaccgacattcacgggagacctccagtgggaggggccgattccgaccatcctaccagtacgtactttctcaagaacacactgtactcttacaaatgaaacagcccgtaggacggggaccgaacgggaccaccgggccgtactaattagttgtgttaggagtaggtttacgngggacgtagtgggacgtgggtaaggacaggtacgtacgacggtcggggaccgtaaccgggg

SEQ ID NO: 320554 - DNA, 764 bp, Homo sapiens
  misc_feature: GZ8MTXP02HLS7W.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtgggcggaggcttggtccagccgtgggcggtctctgagactgtcctgtacgaccctcgtgggtctccgcagcagcgactgtattcgccgtcgggtccgccgaggcctaccgaaggggaaggacgggccggaggtggggtcgacgtagggtttaagtttttagaggggttggggaccgactacgtttcgtaacgggagtaccgtccgagtcggggacgggcccgtaagttcccaaccacttccgtacccgaaggtaacgttaacctttttcacgtaaacgaaacctaacccgtaacgtttcgttacccttactttaaccgtaaaaattcggaaaaccaccggtaccgtacggggaaccgggggacccggaacggggaaccccgtaccgggtacccgttacgtttaacgtttaacgttggttaggttacgggtaaggtttagggtttttaaacggcggggtaccggtaaggttcggggtccggttagggggtaaccgggaaacgtagggttaacgtccggtaccgggggtacggggtaaccccgggaaacccggggg

SEQ ID NO: 320555 - DNA, 565 bp, Homo sapiens
  misc_feature: GZ8MTXP02HWYVL.19.67.G01.1.454.CMB.2.raw
  modified_base (517)..(517): a, c, t, g, unknown or other
  misc_feature (517)..(517): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcgtctctgagactgtcctgtgaaccctctggggtctccgtcagcagcgactgtatgcctgggtccgccaggctccgagggaagaggccggagtgggtcgcaggtatttttagaggttgggaccgacagttctacggagactccagtgggaaggggccgattccgaccatcctcccaggtacgtacttttctacagaaacaacaacttgtcttcttacaaaattggaaactagccgtagacggggccgaaggacgacgggccgtcgtattagtgtgtgagtagttanggcgagtggcgtggtggacgagactcgacggtcgggtaccgaacgggg

SEQ ID NO: 320556 - DNA, 663 bp, Homo sapiens
  misc_feature: GZ8MTXP02JSFD6.19.67.G01.1.454.CMB.2.raw
  modified_base (249)..(249): a, c, t, g, unknown or other
  misc_feature (249)..(249): n is a, c, g, or t
tcagtactctcgtgcacgaccggtgctcgatttagagtatacatattgggtttgggggtagctcaggaagcagagcctggagcatctccactatggcctgggctccactacttctcaccctcctcgctcactgcacaggttcttgggccaactttatgctgactcagccccactctgtgtcggagtctccggggaagacggtaaccatctttgcaccacaacagtggcaacattgccagctaattttgngcagtcgtaccagcagcgccggcacgtccccacatgtgatctatgagataatcaaagaccgtcgtcggggtcctgacgttcggtctcgtcgctcatcgacacgctcctccaactctcgcctccctacaccactctctacgactagaacgtacgtcggaacgggacgacgggtacctacgtaaaccttaaccttaccgttacgtacggttacgttacctttaaagtacggtaaacgttacgggacccggtacgggtttccgtaagtttcggggttcgggtttccgggttaccggggtaccgggggaaccgggggtaaaccaaacggtccgttaaccggttacccgtttaccggaacggttacccgaaccggacccggttaaccggcccgttaccccggtacccccgtttccccgg

SEQ ID NO: 320557 - DNA, 599 bp, Homo sapiens
  misc_feature: GZ8MTXP02IRUQU.19.67.G01.1.454.CMB.2.raw
  modified_base (318)..(318): a, c, t, g, unknown or other
  misc_feature (318)..(318): n is a, c, g, or t
  modified_base (334)..(334): a, c, t, g, unknown or other
  misc_feature (334)..(334): n is a, c, g, or t
  modified_base (373)..(373): a, c, t, g, unknown or other
  misc_feature (373)..(373): n is a, c, g, or t
  modified_base (407)..(407): a, c, t, g, unknown or other
  misc_feature (407)..(407): n is a, c, g, or t
  modified_base (423)..(423): a, c, t, g, unknown or other
  misc_feature (423)..(423): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagccgtgggcgtctctgagctgtcctgtcgaccctcgtggggtctccgtcagcagcgactgtattgcctgggtccgcaggctccgagggaagnggccggagtgggtcgngaggttatttttagagggtggacgactattcgtacgganacctccagtgggaggggccgattccgaccatccnccgagacgtcttttcnctaagaactacactgttcctacttacaaagtcgaaacacgccgtaggacggggacccgagggtaccgaccgggtccgttacgttatttaactttggtagttaggtaagtagttttacgtgggacgtagttgggcgtagggtggacaggacttcgacgtcgggggactaaccggggg

SEQ ID NO: 320558 - DNA, 653 bp, Homo sapiens
  misc_feature: GZ8MTXP02H0RKK.19.67.G01.1.454.CMB.2.raw
  modified_base (307)..(307): a, c, t, g, unknown or other
  misc_feature (307)..(307): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgaccttgggttttccttgctgcaatttcaggaggtgtccagtgtgaggtgcaactggtggagacgtggcggaggcttggtccagccgtgggcggtctctggagtactgtcctgtcgaacccttcgtggggtcctccgtcagcagcgactgtatgcctgggtccnccgaggctccgaaggggaagacgggccgggaggtgggtcgcgtaggttaatttttagagggtggaccgatagtttcgacgggatactccagtgggagggcccgtattaccaccatccctccgagacgtcttttaccacaacgaaaccacgtacttcgtaccttacttaacgaaatacggaaaacacggtacccgtagggaaccggggaccgaaggaacccgacgggtacccgtattacgtttaagttggtgttacggaaggttagtttaacggcgggtacgtacgtcgggacgtagggtaagacgtaacgtacgtacgtaccgggtacgggggtaccgaacccggg

SEQ ID NO: 320559 - DNA, 620 bp, Homo sapiens
  misc_feature: GZ8MTXP02HDKU0.19.67.G01.1.454.CMB.2.raw
  modified_base (276)..(276): a, c, t, g, unknown or other
  misc_feature (276)..(276): n is a, c, g, or t
  modified_base (300)..(300): a, c, t, g, unknown or other
  misc_feature (300)..(300): n is a, c, g, or t
  modified_base (315)..(315): a, c, t, g, unknown or other
  misc_feature (315)..(315): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagactggacggaggcttggtccagccgtgggcggtctctgagactgtcctgtcgaccctcgtgggtctccgtnagcagcgactgtatgcctggtccncagctccgaggaagnggccggaggtgggtcgcgtaggttattttagagggtggaccgactattcgacggatacgtccagtgggacggccgtattaccgactactccgtaccgagtacgttaccttttcgtacaaagtaacctactaacgttcgtactaccttacaaaagtcgaaacgagtcccgtaggacgggaccgaggaccgacggtccgtacttagttaacgttgtagttaggagttagtttacgtagggacgtagtcgggtcgttaggggtcgaacgaagtaacgtccgacggttcggggaccgtaaacccggggg

SEQ ID NO: 320560 - DNA, 719 bp, Homo sapiens
  misc_feature: GZ8MTXP02HQXAK.19.67.G01.1.454.CMB.2.raw
  modified_base (344)..(344): a, c, t, g, unknown or other
  misc_feature (344)..(344): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtggcggaggcttggtccaggccgtgggcggtctctgagctgtcctgtcgaccctcgtgggtctccgtcagcagcgactgtagttcgccgtgggtcccgccgaggctccgaggggagacggccgggaggtgggtcgngtaggttatttttaggagggtgggaccgtacgtagttcgtacggacgacctccgaggtggggacgggtcccgtagttaccacccgtaatcccgtacccagtagttaccttttcacaacgtaaccactacgttcgtaccttactttacaaaacgttcgtaaaccacggtacccgtaggggaccgggggtaccggaacggggaacccgacccggggttacccgttaccgtttaaagtttccgtttagggttaggttacggttaaggtttagggttttaaccggtgggggtaccgtaggtcggggttaccgtagggggttaacggaacgtaggtacggttacggaacccgggttcgggggaccccggtaaaccggggg

SEQ ID NO: 320561 - DNA, 616 bp, Homo sapiens
  misc_feature: GZ8MTXP02HIJ6G.19.67.G01.1.454.CMB.2.raw
  modified_base (272)..(272): a, c, t, g, unknown or other
  misc_feature (272)..(272): n is a, c, g, or t
  modified_base (313)..(313): a, c, t, g, unknown or other
  misc_feature (313)..(313): n is a, c, g, or t
  modified_base (368)..(368): a, c, t, g, unknown or other
  misc_feature (368)..(368): n is a, c, g, or t
  modified_base (458)..(458): a, c, t, g, unknown or other
  misc_feature (458)..(458): n is a, c, g, or t
  modified_base (536)..(536): a, c, t, g, unknown or other
  misc_feature (536)..(536): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttgtccagcctgggcggtctctgagactgtcctgtcgaccctgtgggtctccgtnagcagcgactgtatgcctgggtccgcaggctcgagggaagnggccggagtgggtcgcgtaggttatttttagagggtggaccgacattcgacgganacctcagtggggacggcctagttccaccatcctccagacgtacttttcacaagaacactaatcgttcctattaccaaaagtcgtaaaacncgtacgtagggacgggaccgacgggaccgaccggtaccgttacttagttagttgtaggtacgtaggttagtttacggnggtacgtaggttcgggtacggtggggtaacggtacgaaggtacgtaccggtacgggtaccgggggtaacccgtaacgggg

SEQ ID NO: 320562 - DNA, 583 bp, Homo sapiens
  misc_feature: GZ8MTXP02GCYM5.19.67.G01.1.454.CMB.2.raw
  modified_base (301)..(301): a, c, t, g, unknown or other
  misc_feature (301)..(301): n is a, c, g, or t
  modified_base (452)..(452): a, c, t, g, unknown or other
  misc_feature (452)..(452): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtcgaaccctcgtggggtctccgtcagcagcgactgtattgcctgggtccnccaggctccgagggaagaggccgggagtggggtcgcgaggttatttttagagggtgggaccgacagttctacggagacctccagtgggagggccgtagttccaaccatcctacccagtacgtacttttctacaagaaccacactgtacctnttacgaaatgaaacacgccgtagacggggaccgacggaccacggccgttactagttagtgtgtagagtagtttagtacggctagtggctgggtaagacgagtacgtacgacggtcgggaccgtaaccgggg

SEQ ID NO: 320563 - DNA, 559 bp, Homo sapiens
  misc_feature: GZ8MTXP02FHGZ2.19.67.G01.1.454.CMB.2.raw
  modified_base (460)..(460): a, c, t, g, unknown or other
  misc_feature (460)..(460): n is a, c, g, or t
  modified_base (510)..(510): a, c, t, g, unknown or other
  misc_feature (510)..(510): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccaggcctgggcggtctctgagactgtcctgtcgaaccctcgtggggtctccgtcagcagcgactgtattgccgtgggtccgccgaggcctccgaggggaagagggccgggaggtggggtcgcgtaggttattttagtaggttggggaccgacagttcgtacggagactccagtgggagggccgattcacactctccagagtactttctcagacacactgtctctacaaatgaaacngcctggacggggccgaggacgacggccgtctatattgtgtgagtagttanggcgagtggactgggtggacgagactcgacgtcggggccgtaaccgggg

SEQ ID NO: 320564 - DNA, 568 bp, Homo sapiens
  misc_feature: GZ8MTXP02IM96Q.19.67.G01.1.454.CMB.2.raw
  modified_base (249)..(249): a, c, t, g, unknown or other
  misc_feature (249)..(249): n is a, c, g, or t
  modified_base (288)..(288): a, c, t, g, unknown or other
  misc_feature (288)..(288): n is a, c, g, or t
  modified_base (303)..(303): a, c, t, g, unknown or other
  misc_feature (303)..(303): n is a, c, g, or t
  modified_base (387)..(387): a, c, t, g, unknown or other
  misc_feature (387)..(387): n is a, c, g, or t
tcagtactctcgtgcacgaccggtgctcgatttagagtatacatattgggtttgggggtagctcaggaagcagagcctggagcatctccactatggcctgggctccactacttctcaccctcctcgctcactgcacaggttcttgggccaactttatgctgactcacgcccactctgtgtcggagtcgtccggggaagacggtaaccatctttgcaccacaacagtgcaacattgccagctaattttgngcagtgtaccagcagcgcccgggcacgtcccccacatgngatctatgagataancaaaagccgtcgtcggggtccctgacttcggttctcgtcggcctccacgtcgacacgtcctccctcaactctccgccccttccncacccatctctcgactgaaagactcggaggacgaggctagaacctacttacgtgtactagttcttagtacgtatacggtcgcggtctacgtggtcggttcgttcgggacgggacgggtaacgaacggtcgtcggtaccgtcgtaacggtcgacggtccgaacgtccgtccgccccgtccgg

SEQ ID NO: 320565 - DNA, 635 bp, Homo sapiens
  misc_feature: GZ8MTXP02G1RE8.19.67.G01.1.454.CMB.2.raw
  modified_base (573)..(573): a, c, t, g, unknown or other
  misc_feature (573)..(573): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgaccttgggttttcctgctgcaatttcaggaggtgtccagtgtgaggtgcaacgtggtggagacgtgggcggaggcttggtccagccgtgggcggtctcgtgagctgtcctgtcgaccctgtgggtctcgtcagcagcgactgtatcgccgtggtccgcgaggccgtccgaggggaagcgggccgggaggtcgggtcgcgtaggtttaattttaggaggggtggaaccgtacagtttacgacggtacgacctccgaggtagggacggggaccgtacttccaacccgtatccctaccgaagtacgttactttccgacgaacgaaactacctactacgttctacttaacaaatcgaaacacggtccgagggaccgggaccgacggacgaccggtccgtacttagttagttggtaggtgtaagttagtttagnggtacgtagtggtcgttgggaacgtagaggtacgtacgacggtacggggaccgtaaccgggg

SEQ ID NO: 320566 - DNA, 554 bp, Homo sapiens
  misc_feature: GZ8MTXP02JRBM9.19.67.G01.1.454.CMB.2.raw
  modified_base (337)..(337): a, c, t, g, unknown or other
  misc_feature (337)..(337): n is a, c, g, or t
  modified_base (352)..(352): a, c, t, g, unknown or other
  misc_feature (352)..(352): n is a, c, g, or t
  modified_base (364)..(364): a, c, t, g, unknown or other
  misc_feature (364)..(364): n is a, c, g, or t
  modified_base (371)..(371): a, c, t, g, unknown or other
  misc_feature (371)..(371): n is a, c, g, or t
  modified_base (376)..(376): a, c, t, g, unknown or other
  misc_feature (376)..(376): n is a, c, g, or t
  modified_base (393)..(393): a, c, t, g, unknown or other
  misc_feature (393)..(393): n is a, c, g, or t
  modified_base (396)..(396): a, c, t, g, unknown or other
  misc_feature (396)..(396): n is a, c, g, or t
  modified_base (408)..(408): a, c, t, g, unknown or other
  misc_feature (408)..(408): n is a, c, g, or t
  modified_base (415)..(415): a, c, t, g, unknown or other
  misc_feature (415)..(415): n is a, c, g, or t
  modified_base (477)..(477): a, c, t, g, unknown or other
  misc_feature (477)..(477): n is a, c, g, or t
  modified_base (493)..(493): a, c, t, g, unknown or other
  misc_feature (493)..(493): n is a, c, g, or t
tcagtactctcgtgcacgaccggtgctcgatttagagtatacatattggggtttgggggggagaggagcccagcactgggattccgaggtgtttccattcggtgctcagcactgaacacagaggactcaccatggagttttggctgacctgggtttcctgctgcaatttcaggaggtgtccagtgtgaggtgcaactggtggagactgggcggaggcttggtccagccgtgggcggtctctgagactgtcctgtcgaaccctgtggggtctccggtcagcagcgtactggtattgcctgggtccgcaggctccgagggagtgggccggagtgggtcngtaggttattttagngggtggacctanttcaggnactcngtgggaggcctatcacntcncagagtactttncagaacncatgtctactacgtaaatgaacagcctggacgggccgaggtacacgggcctatagttagtgngtgaggtcgtttaggnggtacgtagtcggtgtagggaacgacgtaggactacggtacggtacggggaccgtaacggg

SEQ ID NO: 320567 - DNA, 686 bp, Homo sapiens
  misc_feature: GZ8MTXP02IEOYU.19.67.G01.1.454.CMB.2.raw
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactgggtggagactgggcggaggcttggtccagccgtggggcggtctcgtgagactgtcctgtcgaccctcgtggggtctccgtcagcagcgactgtattgcctgggtccgccaggctccgaggggaagagggccgggaggtggggtcgcgtaggttaatttttagtaggggtggggacccgacgtagtttacgtacggggagaaccttccgagttcgggggaacgggggcccgtaatttcccgaacctattcccgtacccaaggtacgttacctttttctaccaagtaaaccacgtaacttcgtaccttactttacaaaattacggtaaaaccaggacccgttgggaacggggaccggaacggggaaccgtaccgggtacccgttacgtttaatttagttaggtgttaggtaggttaggtttacgtgggtacgtacgtgggtcgttgggtaaggacgagactacgacggttcgggggacccgtaaccgggg

SEQ ID NO: 320568 - DNA, 571 bp, Homo sapiens
  misc_feature: GZ8MTXP02ITJH2.19.67.G01.1.454.CMB.2.raw
  modified_base (299)..(299): a, c, t, g, unknown or other
  misc_feature (299)..(299): n is a, c, g, or t
  modified_base (538)..(538): a, c, t, g, unknown or other
  misc_feature (538)..(538): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtcgaaccctctggggtctccgtcagcagcgactgtatgcctgggtccnccaggctccgagggaagaggccggagtgggtcgcgtaggtatttttagaggtgggaccgacagttctacggagacctccagttgggacgggtcccgaatttccgaacgtatcctcccagacgtactttctacagaacactactgtctcttacaaatgaaacagcctagacgggaccgacggacgacggtccgtactacttagtgtgtcgagtagtttacgtggcgtagtcggcgttggnggacaggtactcgacgtcggggacctaacgggg

SEQ ID NO: 320569 - DNA, 623 bp, Homo sapiens
  misc_feature: GZ8MTXP02F351Q.19.67.G01.1.454.CMB.2.raw
  modified_base (304)..(304): a, c, t, g, unknown or other
  misc_feature (304)..(304): n is a, c, g, or t
  modified_base (336)..(336): a, c, t, g, unknown or other
  misc_feature (336)..(336): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactgggtggagactgggcggaggcttggtccaggcctggggcggtctctgagactgtcctgtcgaccctgtggggtctccgtcagcagcgactgtatgcctgggtcccncaggctccgagggaagagggccggagtgggcngtaggttattttagagggtggaccactagttacgacgggagacctcgagtgggacgggcctattccactatcctaccaggacgttacttttcacaacgtaacacctactacgttcttacttacaaaatcgaaacacgaccgtagggacggggccgaacgggaccgaccgggtaccgttacttaagttagttaggtgtaggtaggttacgtttaggtgggtacgtagtcgggtgttggggtaacggacgaggtactacgtaacgggtcgggggaccgtaaaccggggg

SEQ ID NO: 320570 - DNA, 581 bp, Homo sapiens
  misc_feature: GZ8MTXP02I7VF1.19.67.G01.1.454.CMB.2.raw
  modified_base (251)..(251): a, c, t, g, unknown or other
  misc_feature (251)..(251): n is a, c, g, or t
  modified_base (447)..(447): a, c, t, g, unknown or other
  misc_feature (447)..(447): n is a, c, g, or t
tcagtactctcgtgcacgaccggtgctcgatttagagtatacatattgggtttggggggtagctcaggaagcagagcctggagcatctccactatggcctgggctccactacttctcaccctcctcgctcactgcacaggttcttgggccaactttatgctgactcagccccactctgtgtcggagtctccggggaagacggtaaccatctttgcacccacaacagtggcaacattgccagctaattttgngcagtggtaccagcagcgccggcacgtcccccacatgtgatctatgaggataaatcaaaagccgtcgtggggtccctgtactcggttctctcggctccatcgacagcctcctccaactcctcgccctccctaccaccctatccgtctgggactgaagactggaacgacgagctagactactatgtcagttcttaangatacgccgtcggtctagtggtcggttcggtcggggaccgggtaacgggaacctaacggtccgtaccggtacccgttaccggtaacggtccgaaccggacccggtacggtcccgtcccggtacccccgtaccgg

SEQ ID NO: 320571 - DNA, 592 bp, Homo sapiens
  misc_feature: GZ8MTXP02HYTYC.19.67.G01.1.454.CMB.2.raw
  modified_base (325)..(325): a, c, t, g, unknown or other
  misc_feature (325)..(325): n is a, c, g, or t
  modified_base (341)..(341): a, c, t, g, unknown or other
  misc_feature (341)..(341): n is a, c, g, or t
  modified_base (364)..(364): a, c, t, g, unknown or other
  misc_feature (364)..(364): n is a, c, g, or t
  modified_base (374)..(374): a, c, t, g, unknown or other
  misc_feature (374)..(374): n is a, c, g, or t
  modified_base (379)..(379): a, c, t, g, unknown or other
  misc_feature (379)..(379): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgaccttgggttttccttgctgcaatttcaggaggtgtccagtgtgaggtgcaactggtggagacgtgggcggaggtcttggtccaggccgtgggcggtctctgagtactgtcctgtcgaaccctcgtggggtctccgtcagcagcgactgtatgcctgggtccgccaggctccgagggaagnggccggagtgggtcgnaggttattttagaggtggacganattcgagganactcngtgggaggccgatcacatctccagagtacttttcacagaacacactgtctcttacaaatgaacagtccgaggagggaccgaggaccgaccgggcgtacttattagtgtggtacgtaaggtagtttaaagtgggtacgtaagtgggtcgtaggggttaacgggaaacaggtacgttaccggacggttaccgggggtaaccgtaaaccccggggg

SEQ ID NO: 320572 - DNA, 573 bp, Homo sapiens
  misc_feature: GZ8MTXP02J0R7D.19.67.G01.1.454.CMB.2.raw
  modified_base (323)..(323): a, c, t, g, unknown or other
  misc_feature (323)..(323): n is a, c, g, or t
tcagtactctcgtgcacgaccggtgctcgatttagagtatacatattggggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgccgtgggtccgccaggctccgagggaagnggccggagtgggtcgctaggttatttttagagggtgggacgactagttcgacggagcctccgagtgggaggggcccatttccgaccagtcctcccagacgtacttttcacagaacacactgtctacttacaaatgaaacagtccgtaggacgggccgaaggaccgaccggaccgttactatttaacgttcggtagtggagtagtttagtcggacgtagtggcgtgggtacgacagactcgacgtcggggg

SEQ ID NO: 320573 - DNA, 629 bp, Homo sapiens
  misc_feature: GZ8MTXP02FRZ9Q.19.67.G01.1.454.CMB.2.raw
  modified_base (334)..(334): a, c, t, g, unknown or other
  misc_feature (334)..(334): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggtttcctgctgcaattcaggaggtgtccagtgtgaggtgcaacgtgggtggagactgggcggaggcttggtccagcctgggcggtctctgagctgtcctgtgaaccctcgtggggtctccgtcagcagcgactgtattgcctgggtccgccaggctccgaggggaagaggccggagtggggtcncgtaggttatttagaggtgggaccgacattcgtacggagacctcagtgggacgggccgtattccgaacatcctaccagtacgtacttttcacaagaacactactgtactacttacaaaatcgaaacacgaccgtcggacgggacggaaccggaacggaaccggaccggttaccgttaacgtttaagtttagttaggttacggtaggttaaggtttaacggtttaggacggtacgtaggtcggttgggtaaggtacggaagtaacgtcgtaacgcgggggtaccggaaacccgggg

SEQ ID NO: 320574 - DNA, 621 bp, Homo sapiens
  misc_feature: GZ8MTXP02IANEN.19.67.G01.1.454.CMB.2.raw
  modified_base (331)..(331): a, c, t, g, unknown or other
  misc_feature (331)..(331): n is a, c, g, or t
  modified_base (397)..(397): a, c, t, g, unknown or other
  misc_feature (397)..(397): n is a, c, g, or t
  modified_base (559)..(559): a, c, t, g, unknown or other
  misc_feature (559)..(559): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgagggtgcaactggtggagacgtggcggaggcttggtccaggccgtgggccggtctcgtgagactgtcctgtcgaacccctcgtggggtctccgtcagcagcgactgtattcgcctcgggtccgccgaggcctccgaggggaagnggccgggaggtcggggtcgcgaggttaatttttagagggtgggaccgacgtagttcgtaacggganacctccgagtgggacgggtccgattccgacctatcctaccgagacgttacttttcgacaagtaacctacacttgtccttactacaaatcgaaacacgtccgtagggacggggaccgaggaaccgcgggtctacttagttagttgtgtaggtagtagtttagngggctagtcggggtactgggggtaagcgaagacgtccgacggtcgggggaccctaacggggg

SEQ ID NO: 320575 - DNA, 613 bp, Homo sapiens
  misc_feature: GZ8MTXP02GHPMD.19.67.G01.1.454.CMB.2.raw
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttgggccaggcctggggcgtctctgagactgtcctgtcgaaccctcgtggggtctccgtcagcagcgactgtatgcctgggtcccgccaggctccgaggggaagaggccggagtcggggtcgcgtagggttattttagagggtggacgacatctacggagactcagtggagggccattcaccatcctccagagtacttttctcagaaaccactactgttctacttacaaaattggaaactagccctagggacggggacccgtaacggaccgaacgggcccgttactaagtttattggtgttacgaaggtagtttaaacgtgggtacgtagttgggacgttggggttaacggaacgaaggtaactccggaacgtcgggggacccgaaaacccggggg

SEQ ID NO: 320576 - DNA, 647 bp, Homo sapiens
  misc_feature: GZ8MTXP02ISM5Q.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttctgctgcaatttcaggaggtgtccagtgtgaggtgcaacgtgggtggagacgtgggcggaggcttggtccagccgtgggcgtctctgagctgtcctgtcgaccctcgtgggtctcgtcagcagcgactgtattgccgtcggtccgcaggctccgagggagcggcggaggtcgggtcgcgtaggttattttagagggtgggaccgacgtattcgtacggacgtaccgttccgaggtcgggacggggaccgtacgttcccaaccgtacttcctacccgtagtacgttaccttttaccgtcaaacgaacaacctacttcgtccttacttaactaaaagtacgtaaacacgtccgtagggacggggccgaacgggaccgacgggtccgttacttatttacgtttgtaggttagtaggttagtttagtcgggtacgtacggtggtcgttgggtaacggacaggtacgttcggacggttcggggaccgtaaccgggg

SEQ ID NO: 320577 - DNA, 547 bp, Homo sapiens
  misc_feature: GZ8MTXP02HDLNY.19.67.G01.1.454.CMB.2.raw
  modified_base (254)..(254): a, c, t, g, unknown or other
  misc_feature (254)..(254): n is a, c, g, or t
  modified_base (294)..(294): a, c, t, g, unknown or other
  misc_feature (294)..(294): n is a, c, g, or t
tcagtactctcgtgcacgaccggtgctcgatttagagtatacatattgggtttggggggtagctcaggaagcagagcctggagcatctccactatggcctgggctccactacttctcaccctcctcgctcactgcacaggttcttgggccaactttatgctgactcagccccactctgtgtcggagtcgtccggggaagacggtaaccattcttttgcacccacaacagtggcaacattgccagctaattttgngcagtggtaccagcagcgcccgggcacgtcccccacatgngatctatgaggataatacaaagaccgtcgtcggggtccctgactcggtctcgtcggctccatcgacagcctcctccaactctcgccctccctcaccactctctgactgaagactaggacggacgacgctacgactacttacgtcgttacgtacgttacttagtagtagtacggccgtcggtctagtggtcggttcgttcgggcggacggacacgcgtacgacgtcgtaagcacgccgagcctccgccccgtcg

SEQ ID NO: 320578 - DNA, 564 bp, Homo sapiens
  misc_feature: GZ8MTXP02G2H3J.19.67.G01.1.454.CMB.2.raw
  modified_base (236)..(236): a, c, t, g, unknown or other
  misc_feature (236)..(236): n is a, c, g, or t
  modified_base (241)..(241): a, c, t, g, unknown or other
  misc_feature (241)..(241): n is a, c, g, or t
  modified_base (294)..(294): a, c, t, g, unknown or other
  misc_feature (294)..(294): n is a, c, g, or t
  modified_base (313)..(313): a, c, t, g, unknown or other
  misc_feature (313)..(313): n is a, c, g, or t
  modified_base (464)..(464): a, c, t, g, unknown or other
  misc_feature (464)..(464): n is a, c, g, or t
  modified_base (502)..(502): a, c, t, g, unknown or other
  misc_feature (502)..(502): n is a, c, g, or t
  modified_base (528)..(528): a, c, t, g, unknown or other
  misc_feature (528)..(528): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcgtcnctganactgtcctgtgaccctgtgggtctcgtcagcagcgactgtatgcctgggtccnccaggctccgaggggaagnggccggagtcgggtcgctagggttatttttagaggggtggaccgtactattcgacggagtacctcgagtggggacgggccctattccaccatcctaccgagtacgtacttttcacaagaacacactgtctacttacaaatgaaacagtccngggacgggccgaacggacacgggtcctgtattagttgngtgagtagttactgggacgtgtcggngttgggcgacagtacacgcgtcggggacaaccgggg

SEQ ID NO: 320579 - DNA, 600 bp, Homo sapiens
  misc_feature: GZ8MTXP02FWN5H.19.67.G01.1.454.CMB.2.raw
  modified_base (419)..(419): a, c, t, g, unknown or other
  misc_feature (419)..(419): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctgggcgtctctgagactgtcctgtcgaaccctcgtggggtctccgtcagcagcgactgtatgccgtggtccgcaggcctcgaggggaagagggccggaggtgggcgcgtaggttatttttagagggtgggaccgacgattcgacgggagacctcagtggaggccgatcacactctccagtactactttcanagaacactacgtacgtactacttacaaaattaggaaaccaacggccgtagggacggggaccgacggaccgaccggtcccgtacgttattagtgtgtagtaggttagtttagtgggacgtgtacgggtgtagggtaacggacgaggtacgttaccgacggttcgggggaccgtaaaccgggg

SEQ ID NO: 320580 - DNA, 634 bp, Homo sapiens
  misc_feature: GZ8MTXP02IAH3S.19.67.G01.1.454.CMB.2.raw
  modified_base (381)..(381): a, c, t, g, unknown or other
  misc_feature (381)..(381): n is a, c, g, or t
  modified_base (482)..(482): a, c, t, g, unknown or other
  misc_feature (482)..(482): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaaccggtggagactgggcggaggcttggtccagccgtggggcggtctctgagactgtcctgtcgaaccctcgtggggtctccgtcagcagcgactgtattgccgtgggtcccgcgaggctccgaggggaagaggccgggagtgggcgcgtaggttatttttagaggtgggacactagttcgtacgganactccagtggggagggcccgtaattccgacctatcctccaagtacgttacctttttaccacaagaaaccactacttcgttccttacttacaaatcgaaacngcctaggacgggaccggaaggacccgacgggccgttacttaacgtttattggtagtggtaagtaggttttagcggggtacgtaggtggtacgtggggttacggaacgacggtatccggaaccggtcgggggaacccacgggggtaaaccccg

SEQ ID NO: 320581 - DNA, 669 bp, Homo sapiens
  misc_feature: GZ8MTXP02HI96Q.19.67.G01.1.454.CMB.2.raw
  modified_base (319)..(319): a, c, t, g, unknown or other
  misc_feature (319)..(319): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagccgtgggcggtctctgagactgtcctgtgaccctcgtggggtctccgtcagcagcgactgtatgctggtccgcaggctccgagggaagnggccgggagtgggtcgcgtaaggtatttttagagggtgggacgacgtattacgtacggagtacctccgaagtgggacgggcccgtagttccaaccctaatccctacccgaaacgtacgttacctttttacgtacgaacgaaacctaacaaccgttcgtaccttaccttacctaaaattcggaaaccaggtacccgtagggaccggggacccgaacgggaacccgaccggtacccggttacttaagtttaacgtttggtaggttaggtaaacggtaacgtttaacggtgggtcgtaagtagggtcggttgggtacgggtaacgacggtacgtacggtaacggggtccgggg

SEQ ID NO: 320582 - DNA, 738 bp, Homo sapiens
  misc_feature: GZ8MTXP02IEKXQ.19.67.G01.1.454.CMB.2.raw
  modified_base (251)..(251): a, c, t, g, unknown or other
  misc_feature (251)..(251): n is a, c, g, or t
  modified_base (284)..(284): a, c, t, g, unknown or other
  misc_feature (284)..(284): n is a, c, g, or t
  modified_base (314)..(314): a, c, t, g, unknown or other
  misc_feature (314)..(314): n is a, c, g, or t
  modified_base (321)..(321): a, c, t, g, unknown or other
  misc_feature (321)..(321): n is a, c, g, or t
  modified_base (340)..(340): a, c, t, g, unknown or other
  misc_feature (340)..(340): n is a, c, g, or t
  modified_base (737)..(737): a, c, t, g, unknown or other
  misc_feature (737)..(737): n is a, c, g, or t
tcagtactctcgtgcacgaccggtgctcgatttagagtatacatattgggcttggtccagcctgggcggtctctgagactgtcctgtgaaccctctggggtctccgtcagcagcgactgtattgcctgggtccgccaggctccgagggaagaggccggagtgggtcgcaggttattttttagagggtgggacgactatttctacggagactccagtgggagggccattcaccatctccagagtactttttnacagaacacactgtctacttacaaaatcgaacngccgtggacgggccgaggaccacggccttntaatttnttgtgtgagtagttttagnggacgtagtgggcgttgggtagacgtaggcttccgaaccggtcgggggaccctacgggggaacccccttgggtacccacccggttcctcccgtacgacccgaccccttaccccgaacggaaccggggtccccctacgtttcccgggtccccctttcccccggcggggtaccccgtcccgttcggccccgtaccggaacgggtaccgccccgtaaccccgtaccgggaacggaacccggaccgtaaccggaccgggcccgggtaccccgttgggggccttccgggccgttacgggtaccgaaacggtacccttaccgttaccccgaaggttacggaacgtttaccgcgggacggtccggggtcacggggaaccgaacggcggaccagttcggacgcgng

SEQ ID NO: 320583 - DNA, 588 bp, Homo sapiens
  misc_feature: GZ8MTXP02F8BPS.19.67.G01.1.454.CMB.2.raw
  modified_base (319)..(319): a, c, t, g, unknown or other
  misc_feature (319)..(319): n is a, c, g, or t
  modified_base (524)..(524): a, c, t, g, unknown or other
  misc_feature (524)..(524): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttcctgctgcaatttcaggaggtgtccagtgtgaggtgcaactgggtggagactgggcggaggcttggtccagccgtggggcggtctctgagactgtcctgtcgaaccctcgtggggtctccgtcagcagcgactgtatgcctggccgcaggctccgagggaagnggccggagtgggtcgcgtaggttattttagagggtggaccgactattcgtacggagacctccgagtgggacgggccgtaattccgaaccatccctaccagtacgtacttttactacaagaacacactgtctactacaaatgaacacgctaggacggggaccgaaggaccacggccgtactattagttgtgtagagttagtttagnggtacgtagtcggcgtagggtaacggacgaaggtactcgacggtcgggggacctaaaccggggg

SEQ ID NO: 320584 - DNA, 559 bp, Homo sapiens
  misc_feature: GZ8MTXP02JT85E.19.67.G01.1.454.CMB.2.raw
  modified_base (316)..(316): a, c, t, g, unknown or other
  misc_feature (316)..(316): n is a, c, g, or t
  modified_base (416)..(416): a, c, t, g, unknown or other
  misc_feature (416)..(416): n is a, c, g, or t
  modified_base (448)..(448): a, c, t, g, unknown or other
  misc_feature (448)..(448): n is a, c, g, or t
  modified_base (502)..(502): a, c, t, g, unknown or other
  misc_feature (502)..(502): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgagtgcaactggtggagactggcggagcttggtccagcctgggcggtctctgagactgtcctgtgaaccctctggggtctccgtcagcagcgactgtattgcctgggtccgccaggctccaggggaagnggccggagtggggtcgctaggtatttttagaggtgggaccgacattctacgggagacctccagtggagggccgattcaccatcctccagagtacttttcncagtaacacactcgtctcttacaaatgaaacngcgtggacgggccgagacgacggctactattagttgtgtagtagttagtttagnggacgtagtcggcgtgggtaacgacgtagactcgacggtcggggacccggaacgggg

SEQ ID NO: 320585 - DNA, 607 bp, Homo sapiens
  misc_feature: GZ8MTXP02J2G3N.19.67.G01.1.454.CMB.2.raw
  modified_base (277)..(277): a, c, t, g, unknown or other
  misc_feature (277)..(277): n is a, c, g, or t
  modified_base (317)..(317): a, c, t, g, unknown or other
  misc_feature (317)..(317): n is a, c, g, or t
  modified_base (329)..(329): a, c, t, g, unknown or other
  misc_feature (329)..(329): n is a, c, g, or t
tcagtactctcgtgcacgaccggtgctcgatttagagtatacatattggggtttggggggagaggagcccagcactgggattccgaggtgtttccattcggtgctcagcactgaacacagaggactcaccatggagttttggctgacctgggttttcctgctgcaatttcaggaggtgtccagtgtgaggtgcaactggtggagacgtgggcggaggcttggccaggccgtggggcgtctctgagactgtcctgtcgaaccctgtggggtctccgtnagcagcgactgtatgccgtggtccgcaggctcgagggagnggcgagtgggcncgaggtattttagaggtggaccgactattcgacggagactcgagtgggacggccgattcaccatctaccagacgtacttttcacagacacacttgtcttacttacaaattagaaacaggcctaggacggggacccgaggaccgacgggtccgttacgttaagttacgttggtagtcggtaaggttagtttaaacggtgggtaccggagttcggggcgtttaggggaacggaaccgtaggtacgtacgtaccgggtacgggggaccgtaaacccggggg

SEQ ID NO: 320586 - DNA, 549 bp, Homo sapiens
  misc_feature: GZ8MTXP02J0XXP.19.67.G01.1.454.CMB.2.raw
  modified_base (373)..(373): a, c, t, g, unknown or other
  misc_feature (373)..(373): n is a, c, g, or t
  modified_base (415)..(415): a, c, t, g, unknown or other
  misc_feature (415)..(415): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaccctctgggtctccgtcagcagcgactgtattgcctgggtccgccaggctccgagggagaggccggagtgggtcgcaggtatttttagagggtggaccgacattctacggagacctccngtgggaggggccgattcacctatctcccagacgtacttttcncagaacacactgtctcttacaaatgaactagcctggacgggccgagacgacggccgtctattatgtgtgagtagttagtaggcgtagtcggtcgtggtggacaggactcgacggtcggggaccgtaaccggggg

SEQ ID NO: 320587 - DNA, 630 bp, Homo sapiens
  misc_feature: GZ8MTXP02JL8Y1.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttcctgctgcaatttcaggaggtgtccagtgtgaggtgcaacgtggtggagacgtggcggaggcttgggtcccagccgtggggcggtctctgagctgtcctgcgaccctcgtggggtctccgtcagcagcgatgtattcgccgtgggtcccgccaggtcctccgaggggaagacggccggaggtgggtcgcgtaggttatttttagagggttgggaaccgactagtttccgtaacgggataccgtcagtcggggacggggcccgtattccaccgtatccctacccgagtacgtacttttcactaacgtaacacgacttcgtctacttacaaatcgaaacacgccgtgggacggggccgacggaccaacgggtccgtagttaacttagttgtggtagtaggttagtttagcgggtaacgtcgtggcgttaggggtaagacgaagtacgtccgaacggtcggggacctaaaccggggg

SEQ ID NO: 320588 - DNA, 582 bp, Homo sapiens
  misc_feature: GZ8MTXP02JS49P.19.67.G01.1.454.CMB.2.raw
  modified_base (375)..(375): a, c, t, g, unknown or other
  misc_feature (375)..(375): n is a, c, g, or t
  modified_base (520)..(520): a, c, t, g, unknown or other
  misc_feature (520)..(520): n is a, c, g, or t
tcagtactctcgtgcacgaccggtgctcgatttagagtatacatattgggtttgggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctcgtggggtctccgtcagcagcgactgtattgcctgggtccgccaggctccgagggaagaggacggaggtgggcgcagggttatttttagagggtgggaccgacgattcgtacggganacttccagtgggaggggccgtattccaaccgattcctcccgagacgtacttttcactaacgaacactactgtcctcttacaaatgaaacagcctagacgggccgagaccgacggccgtactattagtgtagtcggagtagtttangggacgagtcggagttgggtaaggacaggtactacgtacgtccgggggacgtaacccggggg

SEQ ID NO: 320589 - DNA, 615 bp, Homo sapiens
  misc_feature: GZ8MTXP02JQ5AK.19.67.G01.1.454.CMB.2.raw
  modified_base (322)..(322): a, c, t, g, unknown or other
  misc_feature (322)..(322): n is a, c, g, or t
  modified_base (445)..(445): a, c, t, g, unknown or other
  misc_feature (445)..(445): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtgggcggaggcttggtccagccgtgggcggtctctgagctgtcctgtcgaccctgtgggtctccgtcagcagcgactgtattcgccgtgggtccgcaggcctcgaggggaacgngggccggaggtgggtcgcgtaggttatttttaggagggtacgggaccgactagttcgtaacggagtactccgagtggggacgggtccgattccgaacctattcctccagtacgtacttttccncaagaaccacacttcgtaccttcttacaaatacgaacacggtaccgtagggacggggacccggaaggaccgtaccggccgttacttagttagttgtgtaggtaggttagttagtggtacgtgtcggtgtggaaggactaagacgtacgacggtacgggacgtaaccgggg

SEQ ID NO: 320590 - DNA, 598 bp, Homo sapiens
  misc_feature: GZ8MTXP02GXSSA.19.67.G01.1.454.CMB.2.raw
  modified_base (302)..(302): a, c, t, g, unknown or other
  misc_feature (302)..(302): n is a, c, g, or t
  modified_base (321)..(321): a, c, t, g, unknown or other
  misc_feature (321)..(321): n is a, c, g, or t
  modified_base (386)..(386): a, c, t, g, unknown or other
  misc_feature (386)..(386): n is a, c, g, or t
  modified_base (530)..(530): a, c, t, g, unknown or other
  misc_feature (530)..(530): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtggcggaggcttggtccagcctgggcggtctctgagactgtcctgtcgaaccctcgtggggtctccgtcagcagcgactgtatgcctgggtccnccaggctccgaggggaagnggccggagtgggtcgcgtaggttatttttagagggtgggaccgtacattcgtacggagacctccngtgggagggccgattccacatcctaccagtacgtacttttcactaagaacactactgtctacttacaaatcgaaacagacctaggacgggaccgaaggaccgaacggggtcctactagttagttggtagtgaggtagtttacgngggacgtacgtgggcgtagggtcggaacgtaggtacgtacgtacggtcgggggaccgtaaaccggggg

SEQ ID NO: 320591 - DNA, 575 bp, Homo sapiens
  misc_feature: GZ8MTXP02FXQY7.19.67.G01.1.454.CMB.2.raw
  modified_base (404)..(404): a, c, t, g, unknown or other
  misc_feature (404)..(404): n is a, c, g, or t
  modified_base (424)..(424): a, c, t, g, unknown or other
  misc_feature (424)..(424): n is a, c, g, or t
  modified_base (513)..(513): a, c, t, g, unknown or other
  misc_feature (513)..(513): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaccctctgggtctccgtcagcagcgactgtattgcctggtccgccaggctccgagggaagaggccggaggtgggtcgcgtaggttatttttagtaggtggggaccgactattcgtacggagaccttccgagtgggacgggccgattcaccntcctccagtacgtactttcncaagaacacacttgtctacttacaaatgaaacacgccgtggacgggccgaggacgacggccttctattagtgtgtagtagtagtttagnggacgtagtggcgtgggtaacggaacgagtacgtcgaacggtcgggggacccgtaaacgggg

SEQ ID NO: 320592 - DNA, 589 bp, Homo sapiens
  misc_feature: GZ8MTXP02HNC4E.19.67.G01.1.454.CMB.2.raw
  modified_base (222)..(222): a, c, t, g, unknown or other
  misc_feature (222)..(222): n is a, c, g, or t
  modified_base (294)..(294): a, c, t, g, unknown or other
  misc_feature (294)..(294): n is a, c, g, or t
  modified_base (308)..(308): a, c, t, g, unknown or other
  misc_feature (308)..(308): n is a, c, g, or t
  modified_base (353)..(353): a, c, t, g, unknown or other
  misc_feature (353)..(353): n is a, c, g, or t
  modified_base (380)..(380): a, c, t, g, unknown or other
  misc_feature (380)..(380): n is a, c, g, or t
  modified_base (386)..(386): a, c, t, g, unknown or other
  misc_feature (386)..(386): n is a, c, g, or t
tcagtactctcgtgcacgaccggtgctcgatttagagtatacatattgggtttggggggtagctcaggaagcagagcctggagcatctccactatggcctgggctccactacttctcaccctcctcgctcactgcacaggttcttgggccaactttatgctgactcagccccactctgtgtcggagtctccggggaagacggtaaccatctttgcaccccanaacagtggcaaacattgccagctaattttgtgcagtggtaccagcagcgcccgggcacgtcccccacattgnatctatgagataancaaagccgtgtcggggtccctgattcggtctcgcgcctcatcganacgcctcctccaactctcgccctcccncacccntcctctgactagaagacgtagaggacgtaggcctagaaccttactacgtgttactacgttcttatagacgtacgccggtcggttacctagtggttcgggtcggttaccggggcgggaaaccgggacgtaacgccgttacgaaccccggttctaacggggtccaacggaccccaagggtccctacccgggtcccccgttcccgg

SEQ ID NO: 320593 - DNA, 658 bp, Homo sapiens
  misc_feature: GZ8MTXP02JJM74.19.67.G01.1.454.CMB.2.raw
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggtttcctgctgcaatttcaggaggtgtccagtgtgaggtgcaactggtggagactggcggaggcttggtccagcctggggcgtctctgagctgtcctgtgaccctgtgggtctccgtcagcagcgactgtattgcctgggtccaccgaggcctaccgaaggggaagagggccggaggtcggggtcgcgtaggttatttttagagggtgggaccgactagttcgaacggagacctcgagtcgggacgggccgtaattccgaaccgtatccctaccgagtacgttacttttcacaacgtaacacctacgtcgtaccttacgttaacaaaagttcgaaaactacggacccgttagggacgggggacccgaaacgggaccgtacccggggtaccgttacgttaatttacgttggtaggttaggtaacggttaggtttaagtcgggtacgtagttcggggtacttggggtaaggactagacgtaccgtacggtcgggggaccgtaaaccgggg

SEQ ID NO: 320594 - DNA, 624 bp, Homo sapiens
  misc_feature: GZ8MTXP02IWYQX.19.67.G01.1.454.CMB.2.raw
  modified_base (331)..(331): a, c, t, g, unknown or other
  misc_feature (331)..(331): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttcctgctgcaatttcaggaggtgtccagtgtgaggtgcaacgtggtggagactgggcggaggcttgggtccaggccgtgggccggtctctgagactgtcctgtcgaaccctcgtggggtctccgtcagcagcgactgtatcgccgtgggtccgccaggcctccgagggaaggnggcccgggaggtgggcgcgtaggttattttagagggtgggactacattcgacggacgctccagtgggacggccgattcacctatctaccagacgtactttcacacgaacactactcgtcttacttaacaaacttacggaaaccacggtaccgacgggaaccggggaccggaacgggaccgaaccggtccggttactaacgtttagttacggtggttagtaggttaagtttacgtagggtacgtaggttgggtaacgtggggtacggacgtaggtactacgaacggtccggggg

SEQ ID NO: 320595 - DNA, 603 bp, Homo sapiens
  misc_feature: GZ8MTXP02J2WYO.19.67.G01.1.454.CMB.2.raw
  modified_base (235)..(235): a, c, t, g, unknown or other
  misc_feature (235)..(235): n is a, c, g, or t
  modified_base (240)..(240): a, c, t, g, unknown or other
  misc_feature (240)..(240): n is a, c, g, or t
  modified_base (280)..(280): a, c, t, g, unknown or other
  misc_feature (280)..(280): n is a, c, g, or t
  modified_base (310)..(310): a, c, t, g, unknown or other
  misc_feature (310)..(310): n is a, c, g, or t
  modified_base (318)..(318): a, c, t, g, unknown or other
  misc_feature (318)..(318): n is a, c, g, or t
  modified_base (393)..(393): a, c, t, g, unknown or other
  misc_feature (393)..(393): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctggcggggacatcgtgatgacccagtacccagactcactggctgtgtctcgtgggcgagaccggccacaatcaactgcaggtccagccagactntttcnccacctacaaagaactaaaactcttagcctggtaaccaanagacgaccaggaccagcctactagttgctntattacgnggtcttcgtacgcgacgtaacgttccggggtccctagaccccgtacgttccggggcaggtcgggtcgtggggacngtaacttccactctacacctatccagcacgcctacgcgaggctaggaaacgtgttcggtagtaccttagtttactacgtgtacaagtacttaaatttcgtttttactacgtcccgttacggttacggtacccgttcggaccggaaagggtaccgaggggtaacaaacgtcgaacggtaacgagtggtacgcgtcgactaccagttcttcg

SEQ ID NO: 320596 - DNA, 597 bp, Homo sapiens
  misc_feature: GZ8MTXP02INNSO.19.67.G01.1.454.CMB.2.raw
  modified_base (264)..(264): a, c, t, g, unknown or other
  misc_feature (264)..(264): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttcctgctgcaattcaggaggtgtccagtgtgaggtgcaactgggtggagacgtgggcggaggcttggccagcctggggcggtctcgtgagactgtcctgtcgaaccctntggggtctccgtcagcagcgactgtatgcctggtccgccaggctcgagggaagcggcggaggtgggtcgcgtaggttattttagagggtgggaccgactagttcgtaacggagacctccagtcgggaacggggtccgtattccgacgtactctacccgagtacgtacctttacgtcaagaacactacttcgtacttctacgaaatcgaaacacgccgtaggacgggaccgaggaccacgggtctacgtatttacgtgtgtagagttagtttagaggtcgtagtcggactgggtaaggacaggtacacgacggtacggggaccgtaaaccgggg

SEQ ID NO: 320597 - DNA, 632 bp, Homo sapiens
  misc_feature: GZ8MTXP02H4UCV.19.67.G01.1.454.CMB.2.raw
  modified_base (309)..(309): a, c, t, g, unknown or other
  misc_feature (309)..(309): n is a, c, g, or t
  modified_base (326)..(326): a, c, t, g, unknown or other
  misc_feature (326)..(326): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgaccttgggttttccttgctgctaatttcgaggaggtgtccagtgtgaggtgcaacgtggtggagacgtgggcggaggtcttggtccaggccgtgggcggtctcgtgagtctgtcctgtcgacccgtgtgggtctccgtcagcagcgactgtattgccgtggtccncgaggctccgagggagnggccggaggtgggtcgcgaggtttatttttagagggtcggaccactagttcgacggagtactccaggtcgggaggcccgtattccacccgtattccgtccgaagtacgtttacttttaccacgaacgtaaacctacacttgttaccttacgttaactaaagtacgactaacggtcgtacgggacgggccgaaggaccgacgggtacccgtagttacgttagtggttagagtaggttagtttagcggtacgtagtcggtcgtgggtaacgacgtaagtcgtacgaccggtcgggaccgaacccgggg

SEQ ID NO: 320598 - DNA, 564 bp, Homo sapiens
  misc_feature: GZ8MTXP02G9B1G.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtgggcggaggcttggtccagcctgggcggtctctgagactgtcctgtcgaccctctgggtctccgtcagcagcgactgtatgcctggtccgccaggctccgagggaagaggccggagtgggtcgcgaggttatttttagagggttgggaccgactattcgtacggagacctcagtgggagggccgagttccaccatcctccagacgtactttctacagaacacactgtctcttacaaatgaaacagccgtaggacgggacgacggacgacggcgtactattagttgtgtagagttagtttagtgggcgtagtggcgtgggtgacgagagtcgacggttcggggaccgtaaccgggg

SEQ ID NO: 320599 - DNA, 716 bp, Homo sapiens
  misc_feature: GZ8MTXP02HMM94.19.67.G01.1.454.CMB.2.raw
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtggcggaggcttggtccagccgtgggcggtctctgagactgtcctgtgaccctgtgggtctccgtcagcagcgactgtattgccgtggtccgccaggctccgagggaagcgggccggagtgggtcgcgtaggttatttttagagggtggaccgtacgtattcgtacggagtaccgtcgagtcggggacgggtccgtatttccgaacctattccctaccgaagtacgttaccttttcgtacaaacgtaaaccaccgtacgttacgttaccttactttaacaaaacgttacgaaaaccgtacgtacccgttagggaaccgggggacccggaacgggaacccggtaccgggtacccggtttacgttaacgttttagttcggttaggttaggtaaggtttaggttttaagtacggggtaccgttaggttcggggtaaccgttgggggttaacgggacgtaacgggttacgtaccggtaaccgggtccgggggtaacccggtaaaacccggggg

SEQ ID NO: 320600 - DNA, 586 bp, Homo sapiens
  misc_feature: GZ8MTXP02G9COG.19.67.G01.1.454.CMB.2.raw
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtgggcggaggcttggtccaggccgtgggcgtctcgtgagctgtcctgtcgaaccctcgtggggtctccgtcagcagcgactgtatgccgtgggtccgcgaggctccgagggagagggccggaggtgggtcgcgtaggttagtttttagagggtgggacgacagttcgtacggagcgtccgagtggggacgggccgtattccgaacctctctacccgagtacgtacttttcactaacgaacactactgtctacttacaaatcgaacagccgtggacgggccgaggacgacggccgtacgtattgttcgtgtgtaggttagttagtggtacgtagtgggaacgtgggtacggacgagtcgtacgacggtacggggg

SEQ ID NO: 320601 - DNA, 787 bp, Homo sapiens
  misc_feature: GZ8MTXP02HAC8B.19.67.G01.1.454.CMB.2.raw
  modified_base (278)..(278): a, c, t, g, unknown or other
  misc_feature (278)..(278): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgaccttgggttttccttgctgcaatttcaggaggtgtccagtgtgaggtgcaacgtggtggagacgtgggcggaggcttggtccagccgtggggcggtctcgtgagctgtcctgtcgaccctcgtgggtctcgtnagcagcgactgtagttcgccgtcgggtccgcgacggcctaccggaaggggaacggacggggccgggtaggttcggggtacgtcggtaagggtttatttttaggaggggtacgggaaccgtacgtacgttacgtaacgggacgtaccgtaccgaggttacggggacggggtaccgtacgttaccaacccgtacgttacccgttaacccgaaggttaaccggtttacctttttaccgaacgtaaaccgtaaaccctaaccgttaccgttacgttacctttaccgtttaaacaaaacgtacgtaaaccgtacggtaccggttaacgggaccggggaacccggtaaacggaccggtaacccggggttaccttacgtttaatttaaggttggttagttacgggtaaggtttaaggttttacggacggggtaccggttaagggttcggtcggttagggtcgggtaacgtaaggtacgtacgtaccgggtacgggggaacccgtaaaccccggggg

SEQ ID NO: 320602 - DNA, 648 bp, Homo sapiens
  misc_feature: GZ8MTXP02JW1A8.19.67.G01.1.454.CMB.2.raw
  modified_base (305)..(305): a, c, t, g, unknown or other
  misc_feature (305)..(305): n is a, c, g, or t
  modified_base (468)..(468): a, c, t, g, unknown or other
  misc_feature (468)..(468): n is a, c, g, or t
tcagtactctcgtgcacgaccggtgctcgatttagagtatacatattggggtttgggggggagaggagcccagcactgggattccgaggtgtttccattcggtgctcagcactgaacacagaggactcaccatggagtttggctgacctgggttttcctgctgcaatttcaggaggtgtccagtgtgaggtgcaactggtggagactgggcggaggcttgggtccaggccgtggggcggtctctgagactgtcctgtcgaaccctcgtggggtctccgtcagcagcgactgtatgcctgggtccncaggctccgagggaagaggccggaggtgggtcgcgtaggtatttttagagggtgggaccgacattcgtacggagacctcgagtcgggaggggccgtagttcaccatcctccagtagtacttttcacaagacacacttgtcctctttaacaaaagttgaaaccncgtacccgtagggacggggaccgaagggaccaccggggtaccgttctaacgtttagttcggtggtaggtacggttagtttacgtaggggtccgtaaggtcgggtcggtttgggggtaacgggaaccgtaaaggtacgttaccgaaacggggttccgggggtaacccgtaaaccccggggg

SEQ ID NO: 320603 - DNA, 562 bp, Homo sapiens
  misc_feature: GZ8MTXP02HR5R3.19.67.G01.1.454.CMB.2.raw
  modified_base (288)..(288): a, c, t, g, unknown or other
  misc_feature (288)..(288): n is a, c, g, or t
  modified_base (331)..(331): a, c, t, g, unknown or other
  misc_feature (331)..(331): n is a, c, g, or t
  modified_base (345)..(345): a, c, t, g, unknown or other
  misc_feature (345)..(345): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggctttgggtccaggccgtggggcggttctcgtgagactgtcctgtcgaaccctcgtggggtctcccgtnagcagcgactgtattgcctgggtccgcaggctccgagggaagnggccggagtgggcncgtaggtattttagagggtggacacgtattcgtacggagactccgaagtggggacggtccgtattccgaaccatcctacccgagtaacgtacttttcacaagaaacacactgtctctacaaatcgaactagctaggaggccgagacgacggctacgtattatgtgtgagtagttagtcgacgagtggaacgttggagacaagctacgacggacgggg

SEQ ID NO: 320604 - DNA, 631 bp, Homo sapiens
  misc_feature: GZ8MTXP02HRB32.19.67.G01.1.454.CMB.2.raw
  modified_base (284)..(284): a, c, t, g, unknown or other
  misc_feature (284)..(284): n is a, c, g, or t
  modified_base (518)..(518): a, c, t, g, unknown or other
  misc_feature (518)..(518): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgaccttgggttttccttgctgcaatttcaggaggtgtccagtgtgaggtgcaacgtgggtggagacgtgggcggaggcttggtccagccgtggggcggtctctgagactgtcctgtcgaccctgtggggtctccgtnagcagcgactgtattgccgtgggtcccgccgacggccgtaccgaggggaacggacgggcccgggtaggtggggtcgcgttaagggtttatttttaggtaggggtggggacgtactagtttactaacgagtacgacttccgagtacggggacgggtccgattacccaccctatcccaccgaagtacgttaccttttacgacaagtaaccactactgtcctacttacaaatgaacncgcgtaggacgggaccggacgggacgaccgggtccgtacttagtttacgttgtagttggaggttacgttttaggcggtgtagtggtgtagggtacgacgagtacgtcggacgg

SEQ ID NO: 320605 - DNA, 812 bp, Homo sapiens
  misc_feature: GZ8MTXP02IYR2L.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactgggtggagacgtgggcggaggcttggtccaggccgtggggcggtctcgtgagactgtcctgtcgaaccctcgtggggtctccgtcagcagcgactgtatgcctggtccggccaggctccgagggaagacggccggaggtgggtcgcgtaggttagtttttagtagggtgggaccgtactagttcgtacggagacctccgagtggggaggggaccgtattccaccgtaacttccgtacctagtacgttaccttttaccgtacaacgtaaaacctacctaaccgtttacggttaccttaccgtttaacctaaaaacgttaccgtaaaacccgtaccggttaccggttacgggtaaaccggggggtaccccggaaacgggggaacccggtaacccgggggttacccggttaaccgtttaaacgtttttaaggtttcgggtttagggttaacgggtaagggttttaaacggggtttttaaaggttcgggggttaaaccgggttagggttaccgggggttccggtttacgggggttaaaggggtaacggttaaacggtacggttaccggtaacccggggtttaccggggggaaccccggtttaaaaacccccggggggg

SEQ ID NO: 320606 - DNA, 510 bp, Homo sapiens
  misc_feature: GZ8MTXP02JXY36.19.67.G01.1.454.CMB.2.raw
  modified_base (235)..(235): a, c, t, g, unknown or other
  misc_feature (235)..(235): n is a, c, g, or t
  modified_base (339)..(339): a, c, t, g, unknown or other
  misc_feature (339)..(339): n is a, c, g, or t
  modified_base (381)..(381): a, c, t, g, unknown or other
  misc_feature (381)..(381): n is a, c, g, or t
  modified_base (384)..(384): a, c, t, g, unknown or other
  misc_feature (384)..(384): n is a, c, g, or t
  modified_base (386)..(386): a, c, t, g, unknown or other
  misc_feature (386)..(386): n is a, c, g, or t
  modified_base (390)..(391): a, c, t, g, unknown or other
  misc_feature (390)..(391): n is a, c, g, or t
  modified_base (393)..(393): a, c, t, g, unknown or other
  misc_feature (393)..(393): n is a, c, g, or t
  modified_base (395)..(395): a, c, t, g, unknown or other
  misc_feature (395)..(395): n is a, c, g, or t
  modified_base (399)..(400): a, c, t, g, unknown or other
  misc_feature (399)..(400): n is a, c, g, or t
  modified_base (402)..(402): a, c, t, g, unknown or other
  misc_feature (402)..(402): n is a, c, g, or t
  modified_base (409)..(409): a, c, t, g, unknown or other
  misc_feature (409)..(409): n is a, c, g, or t
  modified_base (411)..(411): a, c, t, g, unknown or other
  misc_feature (411)..(411): n is a, c, g, or t
  modified_base (415)..(415): a, c, t, g, unknown or other
  misc_feature (415)..(415): n is a, c, g, or t
  modified_base (417)..(417): a, c, t, g, unknown or other
  misc_feature (417)..(417): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttcctgctgcaatttcaggagtgtccagtgtgaggtgcaactggtggagactgggcggaggcttggccagcctgggcggtcnctgagactgtcctgtgaaccctctggggtctcgtcagcagcgactgtattgcctggtccgccaggctccagggaagaggcgggatgggtcgcaggtatttttanaggtggacgcatctacgagactcatgaggccgattcacatcncanancttnnananacanncnctacaananacancngacggacgacgacgacgcgactatatgtgtagagtagttagtagacgacgtacgacgtaggaagacgacgactacgacggtacggacggacgg

SEQ ID NO: 320607 - DNA, 559 bp, Homo sapiens
  misc_feature: GZ8MTXP02HIVFZ.19.67.G01.1.454.CMB.2.raw
  modified_base (417)..(417): a, c, t, g, unknown or other
  misc_feature (417)..(417): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtggcggaggcttggtccagcctggcggtctctgagactgtcctgtgaaccctctggggtctccgtcagcagcgactgtatgcctgggtccgccaggctaccgagggaagaggccggagtgggtcgcgtaggttatttttagaggtgggaccgactattctacggagactcgagtgggagggccagttcaccatctccagacgtactttcnaagaacacactgtctacttacaaactgaaacagacctaggacggggaccgaggaccacggccgtacttattagttgtgtagagttagtttacgtggacgtagtcggctgggtgacgagactcgacgtcggggaccaacgggg

SEQ ID NO: 320608 - DNA, 604 bp, Homo sapiens
  misc_feature: GZ8MTXP02JCEQH.19.67.G01.1.454.CMB.2.raw
  modified_base (278)..(278): a, c, t, g, unknown or other
  misc_feature (278)..(278): n is a, c, g, or t
  modified_base (486)..(486): a, c, t, g, unknown or other
  misc_feature (486)..(486): n is a, c, g, or t
  modified_base (549)..(549): a, c, t, g, unknown or other
  misc_feature (549)..(549): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactgggtggagacgtgggcggaggcttggtccaggccgtggggcggtctctgagactgtcctgtcgaccctgtgggtctcgtnagcagcgactgtactgccgtcgggtcccgcagggcctccggaaggggaacgagggccggaggtgggtcgcgtaggttatttttagaggggtgggaccgtactagttcgaacgggataaccgtccgagtggggacggggcctagttccgacctatcctaccgagtactactttcacagaacacacttgtcctacttacaaatcgaaacncgtccgtaggacggggaccgaggaccgacggcgttactattagtgtgtagagtagtttacggnggtacgtgtcggtgtggtaagacgacgtacgacggtacggtacggaccgtaacgg

SEQ ID NO: 320609 - DNA, 552 bp, Homo sapiens
  misc_feature: GZ8MTXP02GML6R.19.67.G01.1.454.CMB.2.raw
  modified_base (507)..(507): a, c, t, g, unknown or other
  misc_feature (507)..(507): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctgggcggtctctgagactgtcctgtgaaccctcgtggggtctccgtcagcagcgactgtattgcctgggtccgccaggctccgagggaagaggccgggaggtggggtcgcgtaggtatttttagagggtggggacgacattcgtacggagctccagtgggagggccattcgaccatcctccagagtacttttcacacgaacacactgtcctattacaaatgaacagcctagacgggccgaggacgacggcgtctattagtgtgtgagtagttagngggcgtagtggcgtgggtacggacgagacgtacgacgtacggggg

SEQ ID NO: 320610 - DNA, 592 bp, Homo sapiens
  misc_feature: GZ8MTXP02F1UZF.19.67.G01.1.454.CMB.2.raw
  modified_base (307)..(307): a, c, t, g, unknown or other
  misc_feature (307)..(307): n is a, c, g, or t
  modified_base (332)..(332): a, c, t, g, unknown or other
  misc_feature (332)..(332): n is a, c, g, or t
  modified_base (372)..(372): a, c, t, g, unknown or other
  misc_feature (372)..(372): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctggggcggtctctgagactgtcctgtcgaaccctgtggggtctccgtcagcagcgactgtatgcctggtccgcaggcncgagggagaggccggaggtgggtcncgtaggttattttagaggtgggaccgactattcgacgganacctcgagtgggacgggccgattccacatctccagtacgtactttcacaagaacacactcgtctacttacaaaatcgaaacacgtccgtagggacggggacccgaacgggaccgtacgggcccgttacttagttagttggtggttagaggttagtttagtgggacgtagtgggcgttagggaaggacaggtactcgacggtcgggggacccgtaacgggg

SEQ ID NO: 320611 - DNA, 584 bp, Homo sapiens
  misc_feature: GZ8MTXP02JOWXB.19.67.G01.1.454.CMB.2.raw
  modified_base (318)..(318): a, c, t, g, unknown or other
  misc_feature (318)..(318): n is a, c, g, or t
  modified_base (334)..(334): a, c, t, g, unknown or other
  misc_feature (334)..(334): n is a, c, g, or t
  modified_base (511)..(511): a, c, t, g, unknown or other
  misc_feature (511)..(511): n is a, c, g, or t
  modified_base (526)..(526): a, c, t, g, unknown or other
  misc_feature (526)..(526): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctgggcggtctctgagactgtcctgtgaaccctgtggggtctccgtcagcagcgactgtattgcctgggtccgccaggcctcgagggaagnggccggagtggggtcncgaggttatttttagagggtgggaccgactagttctacggtagaacctccgagtcggggaacggggtcccgtattccgaaccctatccctaccagtacgtactttctacagtaaacacactgtctacttacaaatgaactacgcctggacggccgaggacgacggcgtctatagtgngtagtagtagttagnggcgtagtggtcgtagggtcggaacgagtacgtcgacgttcgggggacaacccggggg

SEQ ID NO: 320612 - DNA, 530 bp, Homo sapiens
  misc_feature: GZ8MTXP02F6273.19.67.G01.1.454.CMB.2.raw
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctgggcggtctctgagactgtcctgtgaaccctctggggtctccgtcagcagcgactgtattgcctgggtccgccaggctccgagggaagaggcccgggagtgagtcgcaggtatttttagtagggtgggacgacattcacggagactccatggagggccgattcaccatcctccagtagacttttcacagaaacacactgtctcttacaaatgaacagcctgacgggccgaggacacggccgtctatattgtgtgagtagtttatggcgagtggcgtaggtcggagacgactctacgg

SEQ ID NO: 320613 - DNA, 555 bp, Homo sapiens
  misc_feature: GZ8MTXP02GLI92.19.67.G01.1.454.CMB.2.raw
  modified_base (530)..(530): a, c, t, g, unknown or other
  misc_feature (530)..(530): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttcctgctgcaatttcaggaggtgtccagtgtgaggtgcaactggtggagactgggcggaggcttggtccagccgtggggcggtctctgagactgtcctgtgaaccctcgtggggtctccgtcagcagcgactgtattgcctggtccgcaggctccgagggaagacggccgggagtgggtcgcgtaggttatttttagaggtgggacgactattcgtacggagctccagtgggacgggccgattcgaccatctaccgagacgtacttttctcagaacactactgtctacttacaaatgtaacagccgtagacgggaccgaggaccgacggccgtacttattagttgtgtgtaggtagttagtggcgtagtggngtggtagacagactcgagtccgggg

SEQ ID NO: 320614 - DNA, 615 bp, Homo sapiens
  misc_feature: GZ8MTXP02G5NFY.19.67.G01.1.454.CMB.2.raw
  modified_base (194)..(194): a, c, t, g, unknown or other
  misc_feature (194)..(194): n is a, c, g, or t
  modified_base (285)..(285): a, c, t, g, unknown or other
  misc_feature (285)..(285): n is a, c, g, or t
  modified_base (313)..(313): a, c, t, g, unknown or other
  misc_feature (313)..(313): n is a, c, g, or t
  modified_base (419)..(419): a, c, t, g, unknown or other
  misc_feature (419)..(419): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtncaacgtggtggagacgtgggcggaggcgttggtccaggcccgtggggccggttctctgagctgtcctgtcgaccctcgtcgggtctccgtnagcagcgactgtacttgccgtgggtccnccgaggcctaccgaggggaagacgggccggaggtcgggtcgcgtaggttattttagaggtgggacatattcgaggcgactccagtggggacggccgtattccgacnctctaccagtacgtactttcacaagaacacgtactgtacctcttaacaaatcgaaacacgtcgtaggacgggaccgacggacgaccgggtccgttactagtttagtagttgtagtaggtaggtttagtggtacgtgtcgggtgtagggtaacgacgtacggtataccggtacggtaccggggacgtaaacccgggg

SEQ ID NO: 320615 - DNA, 636 bp, Homo sapiens
  misc_feature: GZ8MTXP02JQLIB.19.67.G01.1.454.CMB.2.raw
  modified_base (238)..(238): a, c, t, g, unknown or other
  misc_feature (238)..(238): n is a, c, g, or t
  modified_base (255)..(255): a, c, t, g, unknown or other
  misc_feature (255)..(255): n is a, c, g, or t
  modified_base (296)..(296): a, c, t, g, unknown or other
  misc_feature (296)..(296): n is a, c, g, or t
tcagtactctcgtgcacgaccggtgctcgatttagagtatacatattgggtttgggggtagctcaggaagcagagcctggagcatctccactatggcctgggctccactacttctcaccctcctcgctcactgcacaggttcttgggccaactttatgctgactcacgccccactctgtgtcggagtcgtccggggaagacggtaaccattctttgccacccacaacagtggacaacnttgccagctaattttgngcagtggtacagcagcgccgggcacgttcccccactattgngatctatgagataatcaaaagtaccgtcgtcggggtccctgacttcggtctgtccgcctccatcgacacgtcctccctacctactcctccgccctccctaccaccctatccgtctacgggactaggaaacgacgtcggaacggacgacggactacggtaaacttaccttaacgtgttaccgtagtttaccttaagtgtaactcggcccgtcggttactagttcggtacggttccggttacggggacgggtaacgggaaccgtaaacggtccgtaccggtacccgtacggttaacgaccggaccgacccggaacggtccctcccgggtacccccttaccgg

SEQ ID NO: 320616 - DNA, 598 bp, Homo sapiens
  misc_feature: GZ8MTXP02F44LT.19.67.G01.1.454.CMB.2.raw
  modified_base (322)..(322): a, c, t, g, unknown or other
  misc_feature (322)..(322): n is a, c, g, or t
  modified_base (337)..(337): a, c, t, g, unknown or other
  misc_feature (337)..(337): n is a, c, g, or t
  modified_base (365)..(365): a, c, t, g, unknown or other
  misc_feature (365)..(365): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgctaatttcaggaggtgtccagtgtgaggtgcaactggtggagacgtgggcggaggcttggtccaggccgtggggcggtctcgtgagactgtcctgtcgaccctcgtggggtctcgtcagcagcgactgtattgccgtggtccgcaggcctcgagggagnggccggagtgggtcncgtaggttattttagagggtggaccganagttcgacggagactcgagtgggacggccgtattccacctactctaccagtacgtactttacacgaagaaacacctacttcgtacttacttacaaaattggaaacacggtccgagggtaacgggaccgaacggaccgaccggtcgttacgttcttaagtttgttagtggtagtagtttaggttatggcgtagtggtcgtgggtacgacgtagacgtcgacggtcgggacccgg

SEQ ID NO: 320617 - DNA, 550 bp, Homo sapiens
  misc_feature: GZ8MTXP02HPOY9.19.67.G01.1.454.CMB.2.raw
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctcgtggggtctccgtcagcagcgactgtatgcctgggtccgccaggctccagggaagaggccggagtgggtcgctaggtatttttagaggttgggaccgacattcgtacggagactccagtgggaagggccgattcaccgatcctccagacgtactttctcagaacacactgtctcttcaaatgaacagcctgacgggccgaggacacggccttctattatgtgtgtaagagtttagtggacgtagtggtcgtggtaaggacagtactacgacgtcgggggaccaaccgggg

SEQ ID NO: 320618 - DNA, 557 bp, Homo sapiens
  misc_feature: GZ8MTXP02JHT8Q.19.67.G01.1.454.CMB.2.raw
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctggggcggtctctgagactgtcctgtgaccctcgtggggtctccgtcagcagcgactgtatgcctggtccgccaggctccgaggggaagaggccggaggtgggtcgcgtaggttattttagagggtggacgacattctacggagactccagtgggagggccgtattcacatctccgagagtactttctcagaacacactgtctcttacaaatgaacagtccgtaggacgggccgaggacacggtccgtctattagttgtagtgtagtgtttaagcggtcgtagtcggtcgtgggtgacgagacgtcgacggtcggggaccgtaaccgggg

SEQ ID NO: 320619 - DNA, 607 bp, Homo sapiens
  misc_feature: GZ8MTXP02GS4BH.19.67.G01.1.454.CMB.2.raw
  modified_base (571)..(571): a, c, t, g, unknown or other
  misc_feature (571)..(571): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccggcctgtgcggtctctgagactgtcctgtgaaccctctggggtctccgtcagcagcgactgtattgcctggtccgccaggctccgagggaagaggcccggagtgggtcgcgaggtatttttagaggtgggacgtacattctacgggagacctccaagtcgggagggcccgattcaccatctccagagtacttttctacagaacacaactgtctcttacaaattgaacacgccctaggacggggccgaaggaccgaacgggccccgttacgtaagtttaacgtttggtggttggtaaacggtagttttaaacgtgggaccgtaagtttggggaaccgtttggggngggtaaccgaggtaacgttcgaacggttccgggggg

SEQ ID NO: 320620 - DNA, 582 bp, Homo sapiens
  misc_feature: GZ8MTXP02JU9VX.19.67.G01.1.454.CMB.2.raw
  modified_base (250)..(250): a, c, t, g, unknown or other
  misc_feature (250)..(250): n is a, c, g, or t
  modified_base (358)..(358): a, c, t, g, unknown or other
  misc_feature (358)..(358): n is a, c, g, or t
  modified_base (376)..(376): a, c, t, g, unknown or other
  misc_feature (376)..(376): n is a, c, g, or t
  modified_base (383)..(383): a, c, t, g, unknown or other
  misc_feature (383)..(383): n is a, c, g, or t
  modified_base (388)..(388): a, c, t, g, unknown or other
  misc_feature (388)..(388): n is a, c, g, or t
tcagtactctcgtgcacgaccggtgctcgatttagagtatacatattgggtttgggggtagctcaggaagcagagcctggagcatctccactatggcctgggctccactacttctcaccctcctcgctcactgcacaggttcttgggccaactttatgctgactcagccccactctgtgtcggagtctccggggaagacggtaaccatcttttgcacccacaacagtggcaacattgccagcaattttgngcagtggtaccagcagcgcccgggcacgttcccccaccattgtgatctatgaggataatcaaaagccgtctggggtccctgactcggttctcgtcggcctcatcgacncgcctcctaccactctcncctcccncaccntctctgactagaagacgtggacggacgaggtctagtacctactacgtcgtactagttacttagtgtacgtacggccggtcgtactagttcgggttcggttcgggtacggggacgggacgggaaccgacggtccgtacggtacccgtcggtaacggtccgaaccggaccgtacggcccgtacccggtccccgtcg

SEQ ID NO: 320621 - DNA, 697 bp, Homo sapiens
  misc_feature: GZ8MTXP02G3O6L.19.67.G01.1.454.CMB.2.raw
  modified_base (297)..(297): a, c, t, g, unknown or other
  misc_feature (297)..(297): n is a, c, g, or t
  modified_base (370)..(370): a, c, t, g, unknown or other
  misc_feature (370)..(370): n is a, c, g, or t
  modified_base (376)..(376): a, c, t, g, unknown or other
  misc_feature (376)..(376): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcgtctctgagctgtcctgtgaccctcgtgggtctccgtcagcagcgactgtattgcctgggtccncaggctccgagggaagaggccggaggtgggtcgcgtaggttattttagaggtggaccgacattacgtacgganacctcngtgggaggccgattcacagtcctaccagtagtactttacgtacaacgaaacctacctacttcgttaccttacctttaacaaaagttacgaaaccgtacgtacccgttagggaacgggggacccggaaacgggaacccgacccggggtacccgttacgtttaatttaacggtttggtaggttacgggtaacgtttaaggtttttacggtaggggtaccggttaacggttaggggtccggtttacgggggttaacgggtaacgaacggttaacggttaccgaacggggtttaccggggggacccgtttaaaacccccgggggg

SEQ ID NO: 320622 - DNA, 707 bp, Homo sapiens
  misc_feature: GZ8MTXP02IL18B.19.67.G01.1.454.CMB.2.raw
  modified_base (272)..(273): a, c, t, g, unknown or other
  misc_feature (272)..(273): n is a, c, g, or t
  modified_base (297)..(297): a, c, t, g, unknown or other
  misc_feature (297)..(297): n is a, c, g, or t
  modified_base (335)..(335): a, c, t, g, unknown or other
  misc_feature (335)..(335): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggccagcctggggcgtctcgtgagactgtcctgtcgaccctgtgggtctcgnngcagcgactgtatgcctgggtccncaggcctaccgaggggaagcgggccggaggtcgggtcncgtagggttatttttagaggggtcggaccgtactatttcgaacggataccgtccgaggttcggggaacgggtcccgtaattcccaacctattcccgtaccgaaggtaccgtttaccttttaccacgtaaacgaaacctaccgtaacgttcgttaccttacttaacaaaacgttcggaaaacctcggtaccccgtagggacgggggacccggaacgggtaccgaccggggtacccgttacgttaacgttttaaggtcggttaggttacggtaaaggtttaggttttaacggtggggtaccgtaggttacggtcgttaggggtaagaaccgtaggtacgtacggaccgggttcgggggaaccctaaaccggggg

SEQ ID NO: 320623 - DNA, 561 bp, Homo sapiens
  misc_feature: GZ8MTXP02HXKIY.19.67.G01.1.454.CMB.2.raw
  modified_base (319)..(319): a, c, t, g, unknown or other
  misc_feature (319)..(319): n is a, c, g, or t
  modified_base (454)..(454): a, c, t, g, unknown or other
  misc_feature (454)..(454): n is a, c, g, or t
  modified_base (484)..(484): a, c, t, g, unknown or other
  misc_feature (484)..(484): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctgggcggtctctgagactgtcctgtgaccctctggggtctccgtcagcagcgactgtatgcctggtccgccaggctccgagggaagnggccggagtgggtcgcaggtatttttagtagggtggacgacattcgtacggagctccagtggacgggccgatttcgaccatcctcccagacgtaacttttctcacgtaacacactagtctcttacaaatgaaacngcctggacgggccgagggaccacggccgtntacttagttggtgtgacgtagtttaagtgggtacgagttgggaacgttggaggtacgagacttacgaacgtcggggg

SEQ ID NO: 320624 - DNA, 610 bp, Homo sapiens
  misc_feature: GZ8MTXP02GTICJ.19.67.G01.1.454.CMB.2.raw
  modified_base (380)..(380): a, c, t, g, unknown or other
  misc_feature (380)..(380): n is a, c, g, or t
  modified_base (412)..(412): a, c, t, g, unknown or other
  misc_feature (412)..(412): n is a, c, g, or t
  modified_base (550)..(550): a, c, t, g, unknown or other
  misc_feature (550)..(550): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagccgtgggcgtctcgtgagactgtcctgtcgaccctcgtgggtctccgtcagcagcgatgtattgccgtggtccgccgaggctaccgaaggggaagacggccgggaggtgggtcgctaggttatttttagaggtggaccgtacattcgtacgganactcgagtcggggaggccgtacttcgaacctntacctccagacgtacttttacgcaagaacactacttgtccttacttaacaaattacgaaacgacgtaccgtagggacggggaccgaacggaccgtacggtcccgtagttattacgttgtagtgaagttagtttaacgnggacgtagtgggcgttggcggtaagacgtacgtacgacggtcggggaccgtaaaccgggg

SEQ ID NO: 320625 - DNA, 590 bp, Homo sapiens
  misc_feature: GZ8MTXP02F5N20.19.67.G01.1.454.CMB.2.raw
  modified_base (297)..(297): a, c, t, g, unknown or other
  misc_feature (297)..(297): n is a, c, g, or t
tcagtactctcgtgcacgaccggtgctcgatttagagtatacatattgggtttggggggtagctcaggaagcagagcctggagcatctccactatggcctgggctccactacttctcaccctcctcgctcactgcacaggttcttgggccaacttttatgctgactcacgccccactctgtgtcggagtcgtccggggaagacggtaaccatcttttgccacccacaacagtggcaacattgccagctaattttgtgcagtggtaccagcagcgccgggcacgttcccccacattgngatctatgagataatacaaagaccgtcgtcggggtccctgactcggttctctcggctccatcgacacgctcctaccaactctcgcccctccctcaccattctctggactgaagtactggacggacgaggctagaacctactactgtacagttacttagacgtagtacggcccgtggtctagttcggtcggttcgttacggggacgggtaacgggacccaaaggtcctacggtacccgttacgtaacggtaccgacggtacccccgaaggtcccgtacccgtcccccgttccgg

SEQ ID NO: 320626 - DNA, 656 bp, Homo sapiens
  misc_feature: GZ8MTXP02G8K9D.19.67.G01.1.454.CMB.2.raw
  modified_base (304)..(304): a, c, t, g, unknown or other
  misc_feature (304)..(304): n is a, c, g, or t
  modified_base (388)..(388): a, c, t, g, unknown or other
  misc_feature (388)..(388): n is a, c, g, or t
  modified_base (589)..(589): a, c, t, g, unknown or other
  misc_feature (589)..(589): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgaccttgggttttccttgctgcaatttcaggaggtgtccagtgtgaggtgcaactggtggagacgtgggcggaggcttggtccagccgtgggcggtctcgtgagactgtcctgtcgaccctcgtggggtctccgtcagcagcgactgtatgcctgggtccncaggctaccgaaggggaagacgggccggaggtcgggtcgcgtaaggttatttttagagggtggaccgactatttcgaacggganactccgagtcgggaacgggcccgtaattccacgattccaccgaagtacgttacttttacacaaagaacacctacttcgtaccttacgttacaaaagtcgaaaacgtacgtaccgtagggaccggggaccggaacggtaaaccggaccggtccgttaaacgtttatttaagttgttaggtacggtaaggtttacgtttacgngggtacgtagtggtcgttggggaacgtacgaagtcgtacgtacgggtcggggacccgtaaccggggg

SEQ ID NO: 320627 - DNA, 615 bp, Homo sapiens
  misc_feature: GZ8MTXP02GTC1J.19.67.G01.1.454.CMB.2.raw
  modified_base (566)..(566): a, c, t, g, unknown or other
  misc_feature (566)..(566): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttcctgctgcaatttcaggaggtgtccagtgtgaggtgcaacgtggtggagactgggcgggaggtcttggtccagccgtggggcggtctctgagactgtcctgtcgaaccctgtggggtctccgtcagcagcgactgtattgccgtggtccgccgaggccgtccgaggggaaggcgggcccgggaggtcggggtcgcgtaggttatttttagaggggtggacacagttcgacggagcctaccagtcgggaggccgtattcacctagtcacccgagtacgtactttctacaacgaaccactacttcgtacttaccttagaaaactcgaacagtccggaggacgggaccgaacgggaccgaaccgggtcccgtagtaatttagttacggtggttagtaggttacgtttagngggactggtacggtgtgggtagacaggtaacgtcgtacggtaccggggg

SEQ ID NO: 320628 - DNA, 619 bp, Homo sapiens
  misc_feature: GZ8MTXP02JBWOC.19.67.G01.1.454.CMB.2.raw
  modified_base (238)..(238): a, c, t, g, unknown or other
  misc_feature (238)..(238): n is a, c, g, or t
  modified_base (245)..(245): a, c, t, g, unknown or other
  misc_feature (245)..(245): n is a, c, g, or t
  modified_base (286)..(286): a, c, t, g, unknown or other
  misc_feature (286)..(286): n is a, c, g, or t
  modified_base (290)..(290): a, c, t, g, unknown or other
  misc_feature (290)..(290): n is a, c, g, or t
  modified_base (461)..(461): a, c, t, g, unknown or other
  misc_feature (461)..(461): n is a, c, g, or t
  modified_base (477)..(477): a, c, t, g, unknown or other
  misc_feature (477)..(477): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctggcggggacatcgtgatcgacccagtacccagactcactggctgtgtctcgtgggcgagacggccaacaatcaactgcaggtccagaccagaactnttttccnccacctaccaaagaaacaaaacttctagcctagtaaccaanaganacagacagcctacaagttcgctactaatttacgtggtacctttacgacgacgtacgtaaacgttccggggtacctagaccccggtacgttccggggacacggggtcggtactaggggactagtactttccacttctacaacctatcgaagcacgccagcgagctagaaagngtgtgtattagtttanacgtgatacgtattaaatttctttacgtactccgtcggtagtacgtaccggaacggaaacgggacggtaacggtaaagtaaacgtacgaaacggtaacgtaacggtcggtacggtactacgacctaactacgttacgttacg

SEQ ID NO: 320629 - DNA, 819 bp, Homo sapiens
  misc_feature: GZ8MTXP02IVCNC.19.67.G01.1.454.CMB.2.raw
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttcctgctgcaatttcaggaggtgtccagtgtgaggtgcaactgggtggagacgtgggcgggaggcttgggtccaggcctggggcggtctctgagactgtcctgtgaaccctcgtcgggtctccgtcagcagcgactgtattgcctgggtccgccgaggcctccgagggaaggacgggccgggaggtggggtcgcgtaggttagtttttagtacggggtggggacgacgtagtttacgtacggaacgacgttccgaagttcggggaacggggtcccggtaatttaccaacccgtaaacttccttacccgaagtaacggttacctttttacctacgtaaacggtaaacctaaccaccttacgtaccctttaccgtttaaccctaaaaatttacgggaaaacctacggtacccggtttacgggaaccgggggtacccgggaaacggggaacccgtaacccgggggtaccccgtttaaccgtttaaacggtttaaacgttttacggggtttcggtttaaggggttaacgggtttaaagggttttttaaagggttcgggggttacccgggttaaaacggtttacgggggtaacggtttgggggttaacgggggaacccgtaaggttaaacggtttaccggtaaccggggtttaaccccgggggggg

SEQ ID NO: 320630 - DNA, 574 bp, Homo sapiens
  misc_feature: GZ8MTXP02HQK39.19.67.G01.1.454.CMB.2.raw
  modified_base (536)..(536): a, c, t, g, unknown or other
  misc_feature (536)..(536): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggtttccttgctgcaatttcaggaggtgtccagtgtgaggtgcaactggtggagactggcggaggcttgggtccagcctgggcggtctctgagactgtcctgtgaaccctctgggtctcgtcagcagcgactgtattgcctgggtccgccaggctccgagggaagaggccggagtgggtcgcgaggtatttttagaggtggacgactattcgacggagactcagtgggaggccgtattccgaccagtctacccagtagtactttctacaagtaacacgaacttgtctcttacaaaattcgaaacacggtcctaggacggggaccgaggaacgaccggccggtacttagttagttgtgtagtaggtagttaagttggacgtagtcggntgggtgacgaggactacgacggtcggggaccaacgggg

SEQ ID NO: 320631 - DNA, 774 bp, Homo sapiens
  misc_feature: GZ8MTXP02IMTAW.19.67.G01.1.454.CMB.2.raw
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactgggtggagacgtgggcggaggcttggtccagccgtgggcggtctcgtgagactgtcctatcgaccctcgtggggtctccgtcagcagcgactgtatcgccgtcgggtccgccgaggcctccgaaggggaacggacgggacccgggagggttcggggtcggcgtaagggttagtttttagtaggggtaggggaacgtacgtagtttacgtaaccgggacgaccgtaccgaaggtacgggggacggggtacccgtaacgttaccgaaccctaacttccgtaacccgaaggtaacgttaaccctttttccgtaaccgtaaacggtaaaacctaacccgtaaccttcgttaccctttacctttaaacctaaaaagttacgtaaaacgtaccggtacccggttacggggaaccgggggacccggtaaacggggaacccgtaacccggggtccccgtttaacgtttaagtttaacgtttcgggtacggtttaggtaaaggttacggttttaaggtcggggtacgtaaggttcgggtaacgtggggtacggacggagtacgtacggtacggtaccggggg

SEQ ID NO: 320632 - DNA, 638 bp, Homo sapiens
  misc_feature: GZ8MTXP02IERK6.19.67.G01.1.454.CMB.2.raw
  modified_base (192)..(192): a, c, t, g, unknown or other
  misc_feature (192)..(192): n is a, c, g, or t
  modified_base (382)..(382): a, c, t, g, unknown or other
  misc_feature (382)..(382): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttcctgctgcaatttcaggaggtgtccagtgtgagggtncaactgggtggagacgtggcggaggcttggtccagcctgggcggtctctgagactgtcctgtacgaccctcgtggggtctccgtcagcagcgactgtattgcctgggtccgccaggctccgaggggaagcgggccggaggtggggtcgcgaggttatttttagaggggtggaccgtactagttcacgganaccgtccagtcgggaaggcccgattccaccgtatcctacccgagacgttactttctacaagtacacactgtacctactacaaaatgaaacagtccgtagggacgggtaccgacggaccgtaccgggtccgtacgttatttagttggttagtaggtaaggttaggtttaagtcggggtacgtacggttggggtacgtggggtaaggtaaccgaggtactacggtaaccgggtcgggggaacccggtaaacccggggg

SEQ ID NO: 320633 - DNA, 599 bp, Homo sapiens
  misc_feature: GZ8MTXP02H3VVW.19.67.G01.1.454.CMB.2.raw
  modified_base (303)..(303): a, c, t, g, unknown or other
  misc_feature (303)..(303): n is a, c, g, or t
  modified_base (464)..(464): a, c, t, g, unknown or other
  misc_feature (464)..(464): n is a, c, g, or t
  modified_base (532)..(532): a, c, t, g, unknown or other
  misc_feature (532)..(532): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagccgtggggcggtctcgtgagactgtcctgtcgaccctgtggggtctccgtcagcagcgactgtattgcctgggtccnccaggctccgaaggggaagaggccgggagtggggtcgcgtaggttatttttaagagggtagggaccgactatttcgtaacggagactccagtgggagggccagttccaccatcctaccaagagtactttcacaagaacacatgcttctacaaatgaaaccngcctggacgggaccgaggaccgacggtcccgtattaagttattagtggtgtaaggtagttttaacggnggacgtagtggtacgtgggtaaggaacgaacggtacgttaccgacgggtacggggaccgtaacgggg

SEQ ID NO: 320634 - DNA, 517 bp, Homo sapiens
  misc_feature: GZ8MTXP02FQRN8.19.67.G01.1.454.CMB.2.raw
  modified_base (199)..(199): a, c, t, g, unknown or other
  misc_feature (199)..(199): n is a, c, g, or t
  modified_base (352)..(352): a, c, t, g, unknown or other
  misc_feature (352)..(352): n is a, c, g, or t
  modified_base (370)..(370): a, c, t, g, unknown or other
  misc_feature (370)..(370): n is a, c, g, or t
  modified_base (378)..(378): a, c, t, g, unknown or other
  misc_feature (378)..(378): n is a, c, g, or t
  modified_base (403)..(403): a, c, t, g, unknown or other
  misc_feature (403)..(403): n is a, c, g, or t
  modified_base (416)..(416): a, c, t, g, unknown or other
  misc_feature (416)..(416): n is a, c, g, or t
  modified_base (423)..(423): a, c, t, g, unknown or other
  misc_feature (423)..(423): n is a, c, g, or t
  modified_base (429)..(429): a, c, t, g, unknown or other
  misc_feature (429)..(429): n is a, c, g, or t
  modified_base (436)..(436): a, c, t, g, unknown or other
  misc_feature (436)..(436): n is a, c, g, or t
  modified_base (449)..(449): a, c, t, g, unknown or other
  misc_feature (449)..(449): n is a, c, g, or t
tcagtactctcgtgcacgaccggtgctcgatttagagtatacatattgggtttggggggtagctcaggaagcagagcctggagcatctccactatggcctgggctccactacttctcaccctcctcgctcactgcacaggttcttgggccaactttatgctgactcacgccccactctgtgtcggagtctccggggaanacggtaaccatcttttgcacccacaacagtgcaacattgccagctaattttgtgcagtggtaccagcagcgcccgggcacgttcccccacatcgtgatcatgagtataatacaaaagccgtgtcggggtcctgatcggtctctgctcatcganacgctccacaactcgccncccttccncactatctcgtagactgaaagtacngaaggacgaggcngactacntgtacngtcttangaatcgcgcgtanagtgcgtcgtgggcggacggacagcgtacgaccgtacgaaggtcacgccgaaggcctccgacccgtcg

SEQ ID NO: 320635 - DNA, 582 bp, Homo sapiens
  misc_feature: GZ8MTXP02HNWWE.19.67.G01.1.454.CMB.2.raw
  modified_base (383)..(383): a, c, t, g, unknown or other
  misc_feature (383)..(383): n is a, c, g, or t
  modified_base (406)..(406): a, c, t, g, unknown or other
  misc_feature (406)..(406): n is a, c, g, or t
  modified_base (420)..(420): a, c, t, g, unknown or other
  misc_feature (420)..(420): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagccgtgggcggtctctgagactgtcctgtgaccctcgtgggtctccgtcagcagcgactgtatgcctggtccgccaggctccgagggaaggaggccggaggtgggtcgcgtaggttatttttagtagggtgggaccgacattctacggagacctccngtgggagggccgattcaccatcnccagagtactttcncagaacacactgtctcttacaaatgaacacgtccgtaggacggggaccgagggaccgacggtccgtacttagttagttgtgtagagttagtttagtagggcgtagtcgggtgtgggtaacggagagaacgttcgaccggttcggggacccgtaaaccggggg

SEQ ID NO: 320636 - DNA, 608 bp, Homo sapiens
  misc_feature: GZ8MTXP02GCP7P.19.67.G01.1.454.CMB.2.raw
  modified_base (319)..(319): a, c, t, g, unknown or other
  misc_feature (319)..(319): n is a, c, g, or t
  modified_base (412)..(412): a, c, t, g, unknown or other
  misc_feature (412)..(412): n is a, c, g, or t
  modified_base (539)..(539): a, c, t, g, unknown or other
  misc_feature (539)..(539): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcgtctctgagactgtctgtcgaccctgtgggtctcgtcagcagcgactgtatgccgtgggtcccgccgaggcctaccgaggggaagngggccggaggtcgggcgcgtaggtttattttagagggttcgggacgtactagttcgtacggagtacctcagtcgggaggccgtatcactatcncagatactttcacaagaacactactgtcttacttactaaatcgaaacacgtacctaggacggggaccgaaggaccgaaccgggtccgtacgttattagttggtgttaggtaaggttaggttttaacnggggtaccgtagttagggcgttagggtaacgtacgaagtcgtacggacgtcgggggacctaaccggggg

SEQ ID NO: 320637 - DNA, 633 bp, Homo sapiens
  misc_feature: GZ8MTXP02GUIFW.19.67.G01.1.454.CMB.2.raw
  modified_base (277)..(277): a, c, t, g, unknown or other
  misc_feature (277)..(277): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtgggcggaggcttggtccagccctggggcggtctctgagactgtcctgtcgaccctgtgggtctccgtnagcagcgactgtatgcctggtccgcgaggctccgagggaagcggccggaggtgggtcgcgtaaggtttatttttagagggtgggaacccgtactatttacgacggaggaccttaccgaggtgggggaacgggtcccggaactttccaacctattccctacccgaaaggtacgttacctttttacacgtaaacgaaacctacctacttcgttcttaccttaacaaaacttcggaaacacgtcgtaggaacggggccgaaggtacgaccggtcgtactagttagtgtgtacgagtagttcgaggcgtagtcggtgttgggtaagacgagactacggacgtcgggggacgtaaccgggg

SEQ ID NO: 320638 - DNA, 851 bp, Homo sapiens
  misc_feature: GZ8MTXP02IA7SH.19.67.G01.1.454.CMB.2.raw
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgaccttgggttttccttgctgcaatttcaggaggtgtccagtgtgaggtgcaacgtggtggagacgtgggcggaggtcgttggtccagccgtggggcgtctcgtgagtactgtcctgtcgaaccctcgtcggggtctccgtcagcacgcgactgtatgccgtcggtccgccgaggcctccggagggaacggacggccgggaggtcggtcgcgtaggttattttaggacgggtagggacacgtagttcgtaacggtacgcctccgaagtcggggtacgggtaccgtagttacccgaacctacttaccctaccgtaaacggtaaccgtttaccttttaccgttaccgaaaacggtaaacccgtaaacctaaccgttcggtttaccctttaccgtttaaactaaaaacgtttacggaaaacccgtaccgggtacccgttaacgggggaaccgggggtaccccgggaaacggggtaacccccgggtaaccgggggtaccccctttagtttaaaaccggtttaaacggttttcggttaaggggttaacggggttaacgggtttaaacggggttttttaaacggtacgggggttaaacccggggtaacggtttagggggtcccggggtttaagggggtaacccggggtaaaggttaaaccgggaaaaccggtttcccggggttaaaccgggggtttaacccccggggggg

SEQ ID NO: 320639 - DNA, 783 bp, Homo sapiens
  misc_feature: GZ8MTXP02FIQOE.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaattttcaggaggtgtccagtgtgaggtgcaactggtggagactgggcggaggcttggtccaggccgtggggcggtctcgtgagactgtcctgtcgaaccctcgtggggtctccgtcagcagcgactgtattgcctgggtcccgccgaggcctccgaaggggaagagggccggaggtggggtcgcgtaggtttatttttagtagggtgggaacccgactagttcgtacgggacgaccttccgagtggggacggggtcccgtatttccgaacctacgtccttacccgaaggtaccgttaacctttttccgtaccgaaagtaaaacccacctaaccgttacggttcccttaccgtttaaccaaaaaagttcggaaaaaccgcggtaccccgttaagggggaacggggggtaccccggaaacgggggaaccccgaacccgggggtaccccggtttaaccttaagtttaacggttttgggttcggtaagggtaagggttagggtttttaaagcgggggtaccggtaagggtttcgggggccgttttagggggtaacggaaaccggtaggaaacggtttcccggaaacggggttccggggggaccccgtaaaacccggggggg

SEQ ID NO: 320640 - DNA, 544 bp, Homo sapiens
  misc_feature: GZ8MTXP02FGCJT.19.67.G01.1.454.CMB.2.raw
  modified_base (421)..(421): a, c, t, g, unknown or other
  misc_feature (421)..(421): n is a, c, g, or t
  modified_base (503)..(503): a, c, t, g, unknown or other
  misc_feature (503)..(503): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcgtctctgagactgtcctgtgaaccctctggggtctccgtcagcagcgactgtattgcctgggtccgccaggctccaggggaagaggccggagtggggtcgcgtagggttatttttagtaggggtgggaccgacattcgtacgggagactccagtgggagggccgattcaccatctccagagtactttcncagaaccacactgtctcttcaaaatgaaactagcctagacgggccgaggacacggccgtctattattgtgtgagtagtttanggtcgatggctggtgacagactcgacgtggggccaacgggg

SEQ ID NO: 320641 - DNA, 799 bp, Homo sapiens
  misc_feature: GZ8MTXP02FNMUF.19.67.G01.1.454.CMB.2.raw
  modified_base (245)..(245): a, c, t, g, unknown or other
  misc_feature (245)..(245): n is a, c, g, or t
  modified_base (320)..(320): a, c, t, g, unknown or other
  misc_feature (320)..(320): n is a, c, g, or t
  modified_base (335)..(335): a, c, t, g, unknown or other
  misc_feature (335)..(335): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctggcggggacatcgtgatgacccagtacccagactcactggctgtgtctcgtgggcgaggacggccaacaatcaactgcaggtccagaccagaactattttccnccacctacaaagaaactaaaacttctaacgcctaggaaccaacgagacgaccaaggacacgccctactaagttcnctactaagtttacgngggtccttcgtacgcgtacgtaacgttccggggtaccctaggacccccggtacggttcccgggggactacggggtccggggttacgtacggggtacctaggttaacttttacccgaaccttcctaaccaaacccgtattaccgaacggtacccgaacgtcccgttacggacccgaagggtaccgttaagggaaaagtgtagggtacgggttaacctttaaagggtttttaacttaaccggtggttaaccgtaaaggttaacctttaaaacgtttttacttttttacccgttaactttcccccggttaccggggttacgggttaacccgggtttaacccggggaaacccggtaaaaccgggggtaaccggtaaagggggttaaacgtaaaacgttccggaaaacgaaccggttaaaacgttgggtaaccggtcgtaccggaccctaaacctacgtttctttccgg

SEQ ID NO: 320642 - DNA, 562 bp, Homo sapiens
  misc_feature: GZ8MTXP02FN8Y2.19.67.G01.1.454.CMB.2.raw
tcagtactctcgtgcacgaccggtgctcgatttagagtatacatattgggtttggggggtagctcaggaagcagagcctggagcatctccactatggcctgggctccactacttctcaccctcctcgctcactgcacaggttcttgggccaactttatgctgactcagccccactctgtgtcggagtctccggggaagacggtaaccatcttttgcacccacaacagtggcaacattgccagcaaattttgtgcagtggtaccagcagcgcccgggcacgttcccccaccattgtgatctatgaggataatacaaagaccgtctggggtccctgatcggtctctcggctccatcgacacgctcctccaactctcgcctccctcaccatcctctgactagaagactgacggacgacgtctcgactactacgttgtccagttcctttaagtgaattaggcccggtcggtcctagttggtcggttcgttcgggacgggacggaaccgaacgcgtacgccgttacgtaacggtcgacgcccgaaggtccgtcccgtccccgtccgg

SEQ ID NO: 320643 - DNA, 692 bp, Homo sapiens
  misc_feature: GZ8MTXP02HRDXA.19.67.G01.1.454.CMB.2.raw
  modified_base (280)..(280): a, c, t, g, unknown or other
  misc_feature (280)..(280): n is a, c, g, or t
  modified_base (308)..(308): a, c, t, g, unknown or other
  misc_feature (308)..(308): n is a, c, g, or t
  modified_base (614)..(614): a, c, t, g, unknown or other
  misc_feature (614)..(614): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtgggcggaggcttggtccaggccgtgggcggtctctgagtactgtcctgtcgaaccctgtggggtctccgtnagcagcgactgtatcgccgtcgggtccnccgaggcctaccggaaggggaaggacgggccgggaggttcggggtcgacgtaggtttatttttagaggggtcgggaccgactattcgtaacggggataccgttaccaggtggggacgggccgtattaccacattccaccgaagtacgttaccttttcacgaacgaactacctacgttcgtaccttaccttaactaaaattcggaaacctacggtacccttaggggaccgggggacccgaaggggtacccgaaccgggtccgttacgttaagtttagttggtagttggaaagttaggttttaacggngggtacgtaggtcggtacggtagggtaacggaacgtacggtacgtaccggtacgggtaccgggggtacccgtaacggg

SEQ ID NO: 320644 - DNA, 660 bp, Homo sapiens
  misc_feature: GZ8MTXP02I6TJC.19.67.G01.1.454.CMB.2.raw
  modified_base (306)..(306): a, c, t, g, unknown or other
  misc_feature (306)..(306): n is a, c, g, or t
  modified_base (405)..(405): a, c, t, g, unknown or other
  misc_feature (405)..(405): n is a, c, g, or t
  modified_base (588)..(588): a, c, t, g, unknown or other
  misc_feature (588)..(588): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagactgggcggaggcttggtccagccgtgggcggtctctgagctgtcctgtcgaccctgtggggtcctccgtcagcagcgactgtattcgcctcgggtcccncgaggcctccggaaggggaacggagggccgggaggtcgggtcgcgtaaggtttatttttaggaggggtcggaccgactagttcgtaacggagacctacnggtggggacggggcctattccgaaccctatccctaccaagtacgttactttcacgaacgaaaccacctactcgttaccttacttaacaaaattcgaaacacggtccgtaggacggggacccgaaggacccgtacgggtacccgttattacgttagttgtaggtaggtaggttaaggtttacgngggtacgtaggtcggtcggtagggtaaggacgtagtacgtccgtacggtcgggggacccgtaaacccggggg

SEQ ID NO: 320645 - DNA, 647 bp, Homo sapiens
  misc_feature: GZ8MTXP02GCKES.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttcctgctgcaatttcaggaggtgtccagtgtgaggtgcaactgggtggagactgggcggaggcttggtccagccgtgggcggtctctgagactgtcctgtcgaaccctgtggggtctccgtcagcagcgactgtatcgccgtgggtccgccaggctccgaaggggagagggccggaggtgggcgcgtaggttattttagagggtggacgactagttcgacggagactcgagtgggacgggccattccaccatcctaccagtacgtacttttcacaacgaaacactactgtcctacttacaaaatcgaaacacgtccgtagggacggggaccgaacgggaccgtaccgggtccgttacgttagtttacgtttgggtaggttaggtaaaggttaggttttaagcggggtacggtaacggttcgggtcggttaggggtcggtaaacgtacggtaacgttccgaaccggttcggggggaccccgtaaaaccggggg

SEQ ID NO: 320646 - DNA, 640 bp, Homo sapiens
  misc_feature: GZ8MTXP02HMIVQ.19.67.G01.1.454.CMB.2.raw
  modified_base (443)..(443): a, c, t, g, unknown or other
  misc_feature (443)..(443): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagccgtgggcggtctctgagactgtcctgtcgaaccctcgtggggtctccgtcagcagcgactgtattcgccgtgggtccgccaggctccgaggggaagacgggccggaggtggggtcgcgtaggttatttttagagggttgggaccgtacgtagttcgtacgggagtacctccgagtggggacgggccgtattccaccatccaccagacgtactttcncagaacactactcgtctacttacaaattgaaacacgtcctaggacgggaccgacggaccgaccgggtccgttacttaagtttaagttggtagtaggtaaggttaggttttaagtacggggtcgtaacgttggggtccgttggggtaacggacgaaggtacgttacggaccggttacgggggaccgtaaacccggggg

SEQ ID NO: 320647 - DNA, 653 bp, Homo sapiens
  misc_feature: GZ8MTXP02I3CA7.19.67.G01.1.454.CMB.2.raw
  modified_base (222)..(222): a, c, t, g, unknown or other
  misc_feature (222)..(222): n is a, c, g, or t
  modified_base (226)..(226): a, c, t, g, unknown or other
  misc_feature (226)..(226): n is a, c, g, or t
  modified_base (251)..(251): a, c, t, g, unknown or other
  misc_feature (251)..(251): n is a, c, g, or t
tcagtactctcgtgcacgaccggtgctcgatttagagtatacatattgggtttggggggtagctcaggaagcagagcctggagcatctccactatggcctgggctccactacttctcaccctcctcgctcactgcacaggttcttgggccaactttatgctgactcagccccactctgtgtcggagtcgtccggggaagacggtaaccatctttgcacccanaacngtgcaacattgccagctaattttgngcagtggtaccagcagcgcccgggcacgtcccccacatgtgatctatgagataatcaaagaccgtcgtcggggtccctgacttcggtctcgtacggctccgatcgacacgtcctcctccaactctccgccctccctcaccagtcctcgtggacctagaagtacgtaggaacggtacgaggtactgtaacctacttaccgtggttaccgtaagttcctttaagtacgtaagttacggcccggtacgggttacctaggttcgggttacgggtttccggtttaccgggggaccggggtaaacgggtaaccgaaacgggttcccgtaccggtacccggttaccgtaacggggttaccaccggttaccccggaacggtcccgtaccccggtacccccgtttcccggg

SEQ ID NO: 320648 - DNA, 565 bp, Homo sapiens
  misc_feature: GZ8MTXP02H14CN.19.67.G01.1.454.CMB.2.raw
  modified_base (191)..(191): a, c, t, g, unknown or other
  misc_feature (191)..(191): n is a, c, g, or t
  modified_base (258)..(258): a, c, t, g, unknown or other
  misc_feature (258)..(258): n is a, c, g, or t
  modified_base (371)..(371): a, c, t, g, unknown or other
  misc_feature (371)..(371): n is a, c, g, or t
  modified_base (378)..(378): a, c, t, g, unknown or other
  misc_feature (378)..(378): n is a, c, g, or t
  modified_base (443)..(443): a, c, t, g, unknown or other
  misc_feature (443)..(443): n is a, c, g, or t
  modified_base (507)..(507): a, c, t, g, unknown or other
  misc_feature (507)..(507): n is a, c, g, or t
  modified_base (521)..(521): a, c, t, g, unknown or other
  misc_feature (521)..(521): n is a, c, g, or t
tcagtactctcgtgcacgaccggtgctcgatttagagtatacatattgggtttgggggagaggagcccagcactgggattccgaggtgtttccattcggtgctcagcactgaacacagaggactcaccatggagttttggctgacctgggttttccttgctgcaatttcaggaggtgtccagtgtgaggtncaactggtggagactggcggaggcttggtccagcctgggcgtctctgagactgtcctgtgaaccctntggggtctccgtcagcagcgactgtattgcctgggtccgccaggctccagggaagaggccggagtggggtcgcagggtatttttagaggttgggaccgactatttcgacgganacttccngtgggagggcccgattccgaccatccctccagagtactttctacagaacacatgctctacaaatnaaacagtccgtaggacgggaccgaggacgacggccgtactattagtgtgtagagtagtttacgnggcgtacgtcggtntggtaaggacgtaagcgtacgacggttcggggaccgaaccgggg

SEQ ID NO: 320649 - DNA, 733 bp, Homo sapiens
  misc_feature: GZ8MTXP02I3IE0.19.67.G01.1.454.CMB.2.raw
  modified_base (328)..(328): a, c, t, g, unknown or other
  misc_feature (328)..(328): n is a, c, g, or t
tcagtactctcgtgcacgaccggtgctcgatttagagtatacatattggggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtgggtggagacgtgggcggaggcttggtccaggccgtgggcggtctcgtgagactgtctgtcgaaccctcgtggggtctccgtcagcagcgactgtatgccgtgggtccgccaggctccgaggggaagnggccggaggtgggtcgcgtaaggttatttttagaggggtcgggaccgtactagttacgaacgggacgtaccgttccagggttcggggaacggggcccgtatttccaacccgaacttccgacccgaagttaaacgttacctttttcaacaacgtaaaccactacccttgttccctactttaacaaaacgtcgtaaaaccacggtacccgttagggaaccgggggcccgaaacggggaccgacccggggtaccccggtttaacttagttaaacggtttggtacggttacggtaaggtttaaaggttttagaccggggacgttacgttgggggtaccttgggggttaacggaaccgtaacggtacttacccggtaacggggtacgggggaaccccgtaaacccggggg

SEQ ID NO: 320650 - DNA, 637 bp, Homo sapiens
  misc_feature: GZ8MTXP02JJ21Y.19.67.G01.1.454.CMB.2.raw
  modified_base (303)..(303): a, c, t, g, unknown or other
  misc_feature (303)..(303): n is a, c, g, or t
  modified_base (321)..(321): a, c, t, g, unknown or other
  misc_feature (321)..(321): n is a, c, g, or t
  modified_base (336)..(336): a, c, t, g, unknown or other
  misc_feature (336)..(336): n is a, c, g, or t
  modified_base (382)..(382): a, c, t, g, unknown or other
  misc_feature (382)..(382): n is a, c, g, or t
  modified_base (573)..(573): a, c, t, g, unknown or other
  misc_feature (573)..(573): n is a, c, g, or t
  modified_base (609)..(609): a, c, t, g, unknown or other
  misc_feature (609)..(609): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagactgggcggaggcttggtccagccgtgggcggtctctgagactgtcctgtcgaaccctcgtggggtctccgtcagcagcgactgtatgcctgggtccncaggcctccgagggaagnggccggagtgggtcncgtaggttatttttagagggtggaccgtactagttcgtaacggganaccttccgaggtcggggacggggcccgtaattccaaccgtatccctaccgagtacgttacctttcgtacaaacgaacacctacttcgttaccttacttaacaaaagttcgaaaaccacggcccgtagggacggggacccgaaggtaccgaccgggtccgttactagtttatgtgtaggtaggttagttagngggacgtagtcgggtacgtgggtaagacgtagtacncggtacggtcggggaccgtaaaccgggg

SEQ ID NO: 320651 - DNA, 639 bp, Homo sapiens
  misc_feature: GZ8MTXP02IRWNN.19.67.G01.1.454.CMB.2.raw
  modified_base (306)..(306): a, c, t, g, unknown or other
  misc_feature (306)..(306): n is a, c, g, or t
  modified_base (324)..(324): a, c, t, g, unknown or other
  misc_feature (324)..(324): n is a, c, g, or t
  modified_base (385)..(385): a, c, t, g, unknown or other
  misc_feature (385)..(385): n is a, c, g, or t
  modified_base (494)..(494): a, c, t, g, unknown or other
  misc_feature (494)..(494): n is a, c, g, or t
  modified_base (581)..(581): a, c, t, g, unknown or other
  misc_feature (581)..(581): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttcctgctgcaatttcaggagtgtccagtgtgaggtgcaagtggtggagacgtgggcggaggcttggtccaggcccgtggggccggtctcgtgagtactgtcctgtcgaccctgtgggtctccgtcagcagcgactgtatgccgtggtccncgaggctccgagggaagngggccggaggtcgggcgcgtaggttattttagagggtcggacgtactagttcgtacggtanacttcgagtggggaacgggccgtacttaccgactaacgtcctaccgaagacgttactttcgtacaagaaacactaactcgtaccttacttaaccaaaattacgaaaccngtacccgttaggaccggggaccgaaggaacccgacgggttacccgtattaagtttagttggtagtaggtagttaggtttagtacggngtagtggtcgtgggtaaggacgtagtacgtacgtacggtcgggggtaccaaccggggg

SEQ ID NO: 320652 - DNA, 566 bp, Homo sapiens
  misc_feature: GZ8MTXP02ILPHT.19.67.G01.1.454.CMB.2.raw
  modified_base (298)..(298): a, c, t, g, unknown or other
  misc_feature (298)..(298): n is a, c, g, or t
  modified_base (405)..(405): a, c, t, g, unknown or other
  misc_feature (405)..(405): n is a, c, g, or t
  modified_base (420)..(420): a, c, t, g, unknown or other
  misc_feature (420)..(420): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaattcaggaggtgtccagtgtgaggtgcaactggtggagacgtgggcggaggcttggccagcctgggcgtctctgagctgtcctgtgaacccctgtgggtctccggtcagcagcgactgtatgcctgggtccncaggctccgagggaagacggccggagtgggtcgcaggttattttagagggttcgggaccgtacatttcgtacggagtactccagtgggaggccgattccgacatccnccagacgtactttcnagaacactactgtactacttcaaaattcgaaacacgtcctaggacgggaccgaagggacaacgggccgtacttatttatgtgtagagtagtttagtggacgagtacggctgggtgacagactacacggtacgggaccgtaacgggg

SEQ ID NO: 320653 - DNA, 551 bp, Homo sapiens
  misc_feature: GZ8MTXP02GMKPV.19.67.G01.1.454.CMB.2.raw
  modified_base (520)..(520): a, c, t, g, unknown or other
  misc_feature (520)..(520): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtatgcctggtccgcaggctccgagggaagaggccggaggtgggtcgcgtaggtatttttagagggtgggacgacagttcgtacggagactccagtgggagggccgattcgacctatctccagacgtactttctacagaacacactgtcttactacaaatgaacacgcctaggacgggccgaggacgacggccgtatattattgtgttagagtagttagtcggacgtagtggngtgggtacggacagactacgacggtacgggg

SEQ ID NO: 320654 - DNA, 635 bp, Homo sapiens
  misc_feature: GZ8MTXP02IPXAE.19.67.G01.1.454.CMB.2.raw
  modified_base (285)..(285): a, c, t, g, unknown or other
  misc_feature (285)..(285): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttcctgctgcaatttcaggagtgtccagtgtgaggtgcaacgtgggtggagactgggcggaggtcctttggtccagccgtggggccggtctctgagtctgtcctgtcgaccctcgtggggtctccgtnagcagcgactgtatcgccgtggtccgcaggctccgagggagcggccgggagtgggtcgcgtaggttatttttagagggtcgggactactagtttcgaacggacgtcctccgaggtcggggacgggtccgatttccaacctatcctaccgtaagtacgtactttttacacgaccgtaaacactaacttcgtaccttacttacaaatacgaacctacgccgtacggacgggaccgaacggaccgacgggtcccgttactagtttacgtttcggtgttagtaggttaagtttagtcgggtacgtaggttggaacgtggggttacgacgtagtacgtacggtaacggtccgggg

SEQ ID NO: 320655 - DNA, 625 bp, Homo sapiens
  misc_feature: GZ8MTXP02FVSNB.19.67.G01.1.454.CMB.2.raw
  modified_base (279)..(279): a, c, t, g, unknown or other
  misc_feature (279)..(279): n is a, c, g, or t
  modified_base (454)..(454): a, c, t, g, unknown or other
  misc_feature (454)..(454): n is a, c, g, or t
  modified_base (535)..(535): a, c, t, g, unknown or other
  misc_feature (535)..(535): n is a, c, g, or t
  modified_base (556)..(556): a, c, t, g, unknown or other
  misc_feature (556)..(556): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgctaatttcaggaggtgtccagtgtgaggtgcaacgtgggtggagacgtgggcggagggcttgggtccaggccgtggggcgtctctgagctgtctgtcgacctgtgggtctccgtnagcagcatgtatcgccgtgggccgccaggcctccggaaggggaaggcggccgggaggtgggtacgcgttaggttattttagaggggtgggaaccacatttcgacggagaccttcaggtgggacggggtcctattccaacatccctacgaagtacgttacttttcacaacgaaacnctaacttcgtcttacctataaaatgaaacacgtccgaggacgggaccgacggaccgaccggtccgtattagttagtttggngttaggtagttagtttacggnggtgtacggtggacggttgggaacggactaacggtataccggacgggtccggggaccggtaaaccgggg

SEQ ID NO: 320656 - DNA, 635 bp, Homo sapiens
  misc_feature: GZ8MTXP02J3B8U.19.67.G01.1.454.CMB.2.raw
  modified_base (270)..(270): a, c, t, g, unknown or other
  misc_feature (270)..(270): n is a, c, g, or t
  modified_base (350)..(350): a, c, t, g, unknown or other
  misc_feature (350)..(350): n is a, c, g, or t
  modified_base (378)..(378): a, c, t, g, unknown or other
  misc_feature (378)..(378): n is a, c, g, or t
  modified_base (540)..(540): a, c, t, g, unknown or other
  misc_feature (540)..(540): n is a, c, g, or t
  modified_base (582)..(582): a, c, t, g, unknown or other
  misc_feature (582)..(582): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtgagacgtggcggaggcttggccagccgtgggcgtctctgagctgtctgtcgacctcgtgggtctccgtnagcagcgactgtatcgccgtggtccgcaggctccgaagggaggtacgggccgggagtgggtcgcgtaggtttattttagngggtaggacctactagttcgtacggganaccgttcgagtgggacgggtccgtattccacctactccgtacccgaaggtacttaacctttttcaacgaacgaacctacctaacgttcgtaccttacttaaccaaagttacgaaacacgtccgtagggacggggaccgacggaaccgtaccggtacccgttnttagtttaattggtggttagaagttaggtttaagcggtacgngtcggtacgtggggtaagacgagtactacgacgggtcggggaccgtaaccggg

SEQ ID NO: 320657 - DNA, 538 bp, Homo sapiens
  misc_feature: GZ8MTXP02I6O32.19.67.G01.1.454.CMB.2.raw
  modified_base (286)..(286): a, c, t, g, unknown or other
  misc_feature (286)..(286): n is a, c, g, or t
  modified_base (290)..(290): a, c, t, g, unknown or other
  misc_feature (290)..(290): n is a, c, g, or t
  modified_base (344)..(344): a, c, t, g, unknown or other
  misc_feature (344)..(344): n is a, c, g, or t
  modified_base (360)..(360): a, c, t, g, unknown or other
  misc_feature (360)..(360): n is a, c, g, or t
  modified_base (369)..(369): a, c, t, g, unknown or other
  misc_feature (369)..(369): n is a, c, g, or t
  modified_base (380)..(380): a, c, t, g, unknown or other
  misc_feature (380)..(380): n is a, c, g, or t
  modified_base (433)..(433): a, c, t, g, unknown or other
  misc_feature (433)..(433): n is a, c, g, or t
  modified_base (526)..(526): a, c, t, g, unknown or other
  misc_feature (526)..(526): n is a, c, g, or t
tcagtactctcgtgcacgaccggtgctcgatttagagtatacatattgggtttgggggtagctcaggaagcagagcctggagcatctccactatggcctgggctccactacttctcaccctcctcgctcactgcacaggttcttgggccaactttatgctgactcacgcccactctgtgtcggagtctcggggaagacggtaaccatctttgcacccacaacagtggacaacattgccagctaatttgtgcagtggtaccagcagcgccggcacgtccccacatgnatcntgagataatcaaaacgcgtcgtcgggtccctgattcggtctcgagctcatcgancgctccaccactcgcnccctacccncactctcgtcngactagacgtagaggacgacgagctacgacttacgtatcgtatacgttattanacgacgtcggtcgacgtctagttcgtcggtacgtcggggacggtacgacacggctaccggtccgtacgtaacgaccgacggaccgacggtccnccgtcccgtacg

SEQ ID NO: 320658 - DNA, 608 bp, Homo sapiens
  misc_feature: GZ8MTXP02G98M7.19.67.G01.1.454.CMB.2.raw
  modified_base (466)..(466): a, c, t, g, unknown or other
  misc_feature (466)..(466): n is a, c, g, or t
  modified_base (552)..(552): a, c, t, g, unknown or other
  misc_feature (552)..(552): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagccgtgggcggtctctgagactgtcctggtcgaccctcgtggggtctccgtcagcagcgactgtattgccgtgggtccgccgaggcctccgaggggaagacgggccggaggtggggtcgcgtaggttatttttagagggtgggaccgacattcacggagtacctccagtgggagggccgattccaccatcctaccagacgtcttttcactagaaacacactgtcctcttacaaatcgaaacngccgtaggacgggccgacggacaccgggtccgtactagttattggtagtaggtagttagtttagtcggggtacgtagttcgggggngttagggaacggtacgtaagtacgtacggtacgggtaccggggacccgtaacgggg

SEQ ID NO: 320659 - DNA, 589 bp, Homo sapiens
  misc_feature: GZ8MTXP02HOURJ.19.67.G01.1.454.CMB.2.raw
  modified_base (480)..(480): a, c, t, g, unknown or other
  misc_feature (480)..(480): n is a, c, g, or t
  modified_base (573)..(573): a, c, t, g, unknown or other
  misc_feature (573)..(573): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggagtgtccagtgtgaggtgcaacgtggtggagactgggcggaggctttggtccagccgtgggcggtctctgagactgtcctgtgaaccctcgtggggtctccgtcagcagcgactgtattcgccgtgggtccgcaggctaccgaggggaaggaggccgggaggtgggtcgcgtaggttactttttagagggtggggacgtactattcgtaacggagacctccgagtggacggggccgtattccgaccatcctccgaagacgtacttttcactacgaacacactgtctacttacaaatgtaaacngaccgtaggacggcgaggacgcggaccgttactagttattcggtgtagtacggtagtttactggacgtaggtggcgttgggacgacgagtacncgtaacggtccggggg

SEQ ID NO: 320660 - DNA, 583 bp, Homo sapiens
  misc_feature: GZ8MTXP02HHN1Q.19.67.G01.1.454.CMB.2.raw
  modified_base (301)..(301): a, c, t, g, unknown or other
  misc_feature (301)..(301): n is a, c, g, or t
  modified_base (318)..(318): a, c, t, g, unknown or other
  misc_feature (318)..(318): n is a, c, g, or t
  modified_base (335)..(335): a, c, t, g, unknown or other
  misc_feature (335)..(335): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtgggcggaggcttggtccagcctgggcgtctctgagactgtcctgtcgacccgtgtggggtctccgtcagcagcgactgtattgcctgggtccncaggctccgagggaagnggccggaggtgggtcgngtaggtatttttagaggtggacgactattcgacggagactcgagtgggacggccgattccacactccacgtagacgtactttcacaacgacactactcgtcttactactaaactgaaacagtcctaggacgggaccgaacggacgacggccgtacttagtttagtgtagtagtagttagtttagtcggacgtagtcggtcgtaggggtaagtacgagtacgtacgacggtcgggaccgtaacccgggg

SEQ ID NO: 320661 - DNA, 655 bp, Homo sapiens
  misc_feature: GZ8MTXP02HWK4B.19.67.G01.1.454.CMB.2.raw
  modified_base (375)..(375): a, c, t, g, unknown or other
  misc_feature (375)..(375): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagccgtgggcggtctctgagactgtcctgtcgaaccctgtgggtctccgtcagcagcgactgtatgcctgggtccgccaggcctcgagggaacgaggccggagtcgggtcgcgtaggttatttttagagggtggaccgatattcgacgganacctcagtggacggcgattcgacctatcctccaagtacgttacttttcactaacgaaacacgtaacttcgtaccttacgttacaaaagttcgaaaaccgtacggtacccgtagggaaccgggggaccccgaaggggaacccgaaccggggtcccgttacttaaagtttagttaggttggttaggaggtttaaggttttacgggcgggtacgtacggtcgggtacgtagggtaacggaacgtacggtacgtacggaccgggtcggggaaccgtaaccgggg

SEQ ID NO: 320662 - DNA, 661 bp, Homo sapiens
  misc_feature: GZ8MTXP02J2S75.19.67.G01.1.454.CMB.2.raw
  modified_base (318)..(318): a, c, t, g, unknown or other
  misc_feature (318)..(318): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgacaacgtggtggagacgtgggcggaggcttggtccaggccgtggggccgtctctgagctgtcctgtcgacccgtgtcggggtctccgtcagcagcgatgtattcgccgtggtcccgcaggcncgagggagcggcggaggtcggcgcgtaggttattttaggacgggtggacgactagttcgacggagtcctacgagtcgggagggccgtacttacgaccctatcccacgaacgtacgttacttttacgcaagaaaccctactaaccggttcttaccttacctttaacaaagtacggaacctacgtacccggtaggacgggggacccgaacggggtacccgaccggggtaccccttagttacgtttaagtttcgggagttgtaaagggttaggtttaacgggacgggtacgtaggtcgggtcggtacgggtacggaacgtaacgtacgtaccggtacggggtcggg

SEQ ID NO: 320663 - DNA, 597 bp, Homo sapiens
  misc_feature: GZ8MTXP02GPL0K.19.67.G01.1.454.CMB.2.raw
  modified_base (237)..(237): a, c, t, g, unknown or other
  misc_feature (237)..(237): n is a, c, g, or t
  modified_base (313)..(313): a, c, t, g, unknown or other
  misc_feature (313)..(313): n is a, c, g, or t
  modified_base (390)..(390): a, c, t, g, unknown or other
  misc_feature (390)..(390): n is a, c, g, or t
  modified_base (428)..(428): a, c, t, g, unknown or other
  misc_feature (428)..(428): n is a, c, g, or t
  modified_base (433)..(433): a, c, t, g, unknown or other
  misc_feature (433)..(433): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagactatttcnccacctcaagaacaaaacttctagcctggtaccaacagacgaccaaggacagcctcctaagttcgctctatttacngggtccttactactcgcgtaaacgttcggggtccctgaccccgtagttcccggggcaggcgggtctggggacaggtntttccactctacaccatcagcagcctgcaggctagaanagtgnggtctaagtttactactgtacagtacttaagtttctttttactacgtacccttcggttacgggtaccgtttaccgggaccgaaacggggacgtacggggttaggaaaactccgaaaggaacgttaacgtgggtacggcttacggcctaacccgtatccgtttcg

SEQ ID NO: 320664 - DNA, 698 bp, Homo sapiens
  misc_feature: GZ8MTXP02I63MA.19.67.G01.1.454.CMB.2.raw
  modified_base (382)..(382): a, c, t, g, unknown or other
  misc_feature (382)..(382): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactgggtggagacgtgggcggaggcttggtccaggccgtgggcggtctctgagctgtcctgtcgaccctgtggggtctccgtcagcagcgactgtattcgcctgggtccgccaggctccgaagggaagacggccggagtcgggtcgcgtaggttatttttagagggtggaccgactagttcgacgganacctccagtgggacgggccgattccacgatcctaccgagtacgtacttttcacaacgaaacacctaacttcgttaccttacttaacgtaaaattcgaaaccgtaacggtcccgtaggggaccgggggaccgaaacgggaacccgaccgggtaccccggtttacttaacgttttaagttgggttacgttacgggtaaggtttaaggtttttacggaggggtaccggtaagttaccgggggtcgttagggggttaagggaaacgtaagggtaaccgtaccggtaaccgggttcgggggaaccccgtaaaacccggggg

SEQ ID NO: 320665 - DNA, 578 bp, Homo sapiens
  misc_feature: GZ8MTXP02G9TK8.19.67.G01.1.454.CMB.2.raw
  modified_base (303)..(303): a, c, t, g, unknown or other
  misc_feature (303)..(303): n is a, c, g, or t
  modified_base (424)..(424): a, c, t, g, unknown or other
  misc_feature (424)..(424): n is a, c, g, or t
  modified_base (513)..(513): a, c, t, g, unknown or other
  misc_feature (513)..(513): n is a, c, g, or t
  modified_base (532)..(532): a, c, t, g, unknown or other
  misc_feature (532)..(532): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtggtgaggtgcaacgtggtggagactggcggaggcttggtccagccgtgggcggtctctgagactgtcctgtgaaccctcgtgggtctccgtcagcagcgactgtatgctggtccncgaggctccgaggacgaggccgggagtgggtcgcgaggtatttttagaggttagggacgacgtagttcgtaggacgcgtccagtggaggccgattcgaccatcaccagacgtacttttcanacgaacacgtactgtacttacttacaaaattcgaacacgtaccgtaggacgggaccgaaggaccacgggtacctcgtaattagttacgnggttagaagttgttaacgnggaccgagtcggcgtgggtagtacgagtacttacgaacgtcggggg

SEQ ID NO: 320666 - DNA, 680 bp, Homo sapiens
  misc_feature: GZ8MTXP02IH23S.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtgggcggaggcttggtccaggccgtgggcgtctcgtgagactgtcctgtcgaccctgtggggtctccgtcagcagcgactgtatcgcctggtccgccaggctccgaggggagaggccgggagtcggggtcgcgtaggttattttagagggtgggaccgactagttcgtacggagtacctccgaggttgggaacggggcccgtatttaccgacctaactcccgtaccgaaagacgttactttttccacgtaaacgtaaaccactacttcggttaccttacttaacaaattacgaaacacgtaccgtagggaacgggggacccgaaggggaccgtacgggtcccgttaccgttagtttaacgttggtaggttacggtagtttaacggtttagttggggaccgttagtacggggtacgtggggtaaggaacgtaacggtacgtacggaccgggtagggggacctaaaccggggg

SEQ ID NO: 320667 - DNA, 573 bp, Homo sapiens
  misc_feature: GZ8MTXP02JKAW0.19.67.G01.1.454.CMB.2.raw
  modified_base (177)..(177): a, c, t, g, unknown or other
  misc_feature (177)..(177): n is a, c, g, or t
  modified_base (252)..(252): a, c, t, g, unknown or other
  misc_feature (252)..(252): n is a, c, g, or t
  modified_base (301)..(301): a, c, t, g, unknown or other
  misc_feature (301)..(301): n is a, c, g, or t
  modified_base (340)..(340): a, c, t, g, unknown or other
  misc_feature (340)..(340): n is a, c, g, or t
  modified_base (388)..(388): a, c, t, g, unknown or other
  misc_feature (388)..(388): n is a, c, g, or t
  modified_base (456)..(456): a, c, t, g, unknown or other
  misc_feature (456)..(456): n is a, c, g, or t
  modified_base (482)..(482): a, c, t, g, unknown or other
  misc_feature (482)..(482): n is a, c, g, or t
  modified_base (534)..(534): a, c, t, g, unknown or other
  misc_feature (534)..(534): n is a, c, g, or t
  modified_base (539)..(539): a, c, t, g, unknown or other
  misc_feature (539)..(539): n is a, c, g, or t
  modified_base (552)..(552): a, c, t, g, unknown or other
  misc_feature (552)..(552): n is a, c, g, or t
  modified_base (556)..(556): a, c, t, g, unknown or other
  misc_feature (556)..(556): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttcctgctgcaatttcaggaggtntccagtgtgaggtgcaactggtggagactgggcggaggcttggccagcctggggcgtctcgtgagctgtcctgtnaacccctgtggggtctccgtcagcagcgactgtattcgcctagggtccnccgaggcctaccgaggggacgaggccggtaggtgggtcncgtaaggttatttttagagggttggaacccgactagttctaacggganaccgttccagtcgggaacggggcctaacgttccacctatcctaccgagacgtactttcacaagaaccncgactgtctattacaaattcgaaacncgtcgaggacggacgagacgacggtctatagttagtgagtgtagtgttacgngacgngtcgcgtggcganacgncgacgtcggacgtacgg

SEQ ID NO: 320668 - DNA, 561 bp, Homo sapiens
  misc_feature: GZ8MTXP02FUTWH.19.67.G01.1.454.CMB.2.raw
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctggggcggtctctgagactgtcctgtgaaccctctggggtctccgtcagcagcgactgtatgcctgggtccgccgaggctccgaggggaagaggcccgggagtggggtcgcgaggtatttttagtagggtgggacgacattcgacggagctccagtgggagggccgattcaccatctcccagacgtacttttctacacgaacacactcgtcttacttacaaattgaaacagcctagacgggccgaaggacgaccggccgtactattattggtgtagaggtagtttagtggacgtagtggcgtgggtagacgagactcgacgtacggggg

SEQ ID NO: 320669 - DNA, 569 bp, Homo sapiens
  misc_feature: GZ8MTXP02JNYTS.19.67.G01.1.454.CMB.2.raw
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttcctgctgcaatttcaggaggtgtccagtgtgaggtgcaactggtggagactgggcggaggcttggtccagccgtgggcggtctctgagactgtcctgtgaaccctcgtggggtctccgtcagcagcgactgtatgccgtggtccgccgaggctccgagggaagacggccggaggtgggtcgcgtaggttatttttagagggtggacgtacgattcgtacggagctccgagtggaggccgattcactatctccagacgtctttctcagaacacactgtctacttacaaatgaacagcgtgacggaccgaggtacgacggccgttactagttacgttggtgttacgtaggtagtttagtcggtcgaagtggaacgtgggtacggaccgagtacgttacgacggtaccggggg

SEQ ID NO: 320670 - DNA, 636 bp, Homo sapiens
  misc_feature: GZ8MTXP02ITO6A.19.67.G01.1.454.CMB.2.raw
  modified_base (335)..(335): a, c, t, g, unknown or other
  misc_feature (335)..(335): n is a, c, g, or t
  modified_base (401)..(401): a, c, t, g, unknown or other
  misc_feature (401)..(401): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtgggcggaggcttggtccaggccgtggggcggtctcgtgagactgtcctgtcgaccctcgtcgggtctccgtcagcagcgactgtattcgccgtcgggtcccgccgaggctaccgaggggaacggnggccggaggtgggtcgcgtaggttatttttagagggtggaccgactagttcgtacggactacgtcnggtgggacgggtccgtacttccgactactctaccgagtacgttactttcactaaagaaactactacgttcgtctacttacgaaagtcgaaacacgtcgtaggacggggacccgaaggaccgtacggtccgttattagtttagtgtgttaggagttaggtttagtacgggacgtaggtcggtcgttagggtaaggaacgtagtaacgtcgacggttcgggggaccgtaaaccgggg

SEQ ID NO: 320671 - DNA, 620 bp, Homo sapiens
  misc_feature: GZ8MTXP02JDOLT.19.67.G01.1.454.CMB.2.raw
  modified_base (394)..(394): a, c, t, g, unknown or other
  misc_feature (394)..(394): n is a, c, g, or t
  modified_base (577)..(577): a, c, t, g, unknown or other
  misc_feature (577)..(577): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttcctgctgcaatttcaggaggtgtccagtgtgaggtgcaactggtggagactgggcggaggcttggtccagcctgggcgtctctgagctgtcctgtcgaccctcgtggggtctccgtcagcagcgactgtattcgcctgggtcccgcgacgccaccggagggaacggcgggcggaggtcgggtcgacgtaggtttatttttaggagggtcggaccgactagtacgtacggactactcgnggtggggacggtaccgtacttaccgactactccctaccgagtacgttactttctacaagactacgacttcgtactcttaacaaagtacgtaaacacgcgtacgggacgggaccgaacgggtacaccggggtcctacttagttagtggttaggtacgtaaggttgttacgagtcggagttcggngttgggaagacaggtacgcgtacgggtcggacggtaacccggg

SEQ ID NO: 320672 - DNA, 620 bp, Homo sapiens
  misc_feature: GZ8MTXP02G0ZFA.19.67.G01.1.454.CMB.2.raw
  modified_base (252)..(252): a, c, t, g, unknown or other
  misc_feature (252)..(252): n is a, c, g, or t
  modified_base (290)..(290): a, c, t, g, unknown or other
  misc_feature (290)..(290): n is a, c, g, or t
  modified_base (376)..(376): a, c, t, g, unknown or other
  misc_feature (376)..(376): n is a, c, g, or t
tcagtactctcgtgcacgaccggtgctcgatttagagtatacatattgggtttgggggtagctcaggaagcagagcctggagcatctccactatggcctgggctccactacttctcaccctcctcgctcactgcacaggttcttgggccaactttatgctgactcacgccccactctgtgtcggagtcgtccggggaagacggtaaccatctttgcacccacaacagtggcaacattgccagctaattttgngcagtgtaccagcagcgccggcacgtcccccacattgngatctatgagataatacaaagaccgtcgtgggtccctgactcggtctctcggctccatcgacacgcctccctaccaactccgtccnccctccctcaccctacgttctcgtcgactacgaaacgtacgtgggaacggacggacgggctacgtaaacctaccgttaaacgttcgttacgtacgtttaccgttaagtacgtaacgtcggtcccggtacggttccgtagttcggttcgggttcggttcggggacgggtacgggaccgtaacgcgtaccggaccgttacgtaacggtcaacggtacccgaacggtccctcccggccccgttccgg

SEQ ID NO: 320673 - DNA, 621 bp, Homo sapiens
  misc_feature: GZ8MTXP02JQ4KV.19.67.G01.1.454.CMB.2.raw
  modified_base (310)..(310): a, c, t, g, unknown or other
  misc_feature (310)..(310): n is a, c, g, or t
  modified_base (353)..(353): a, c, t, g, unknown or other
  misc_feature (353)..(353): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtgggcggaggcttggtccagccgtgggcggtcgctggacgacgtgtcctgtagaccctgtgggtctcgcagcagcgactgtattcggccgtcgggccgccgnggcctaccgaaggggaacgagggccgggaggtcggggtaccgngtagggttatttttaggaggggttacgggaccgtactagttcgaacggagacctcaggtgggacggcctatccacatcctaccgagtacttacttttcacaacgaacctactacgttcgtactacttaactaaagtagaaacgacgacgacgggacgggaccggacggacggacggtacgtacttagttagttgtgtaggtagtagttagtggtacgtacgtcggtgtggtaaggtacgacgtacgtacggacggacgggacggacgg

SEQ ID NO: 320674 - DNA, 669 bp, Homo sapiens
  misc_feature: GZ8MTXP02GBSNW.19.67.G01.1.454.CMB.2.raw
  modified_base (378)..(378): a, c, t, g, unknown or other
  misc_feature (378)..(378): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggtagttttggctgacctgggttttccttgctgcaatttcaggaggtgtccagtgtgaggtgcaacgtggtggagacgtgggcggaggcttggtccaggccgtggggcggtctcgtgagactgtcctgtcgaccctcgtgggtctccgtcagcagcgactgtattcgccgtggtccgcaggctccgagggaagaggccggaggtgggcgcgtaggttattttagaggtggacgactattcgacgganacctcgagtcgggacggggccgtattccgaaccagttcctaccgaagtacgttacttttacacgtaagaaaccacctacttcgttacttaccttaactaaaagttacggaaactaacggtcccgtacggaacggggaccgaacgggaaccgaccgggtcccgttacgttaagtttaagtttggttcgtacggtaaggttagttttacggtagggtacggtagtcggggtcgttaggggaacggtaacgaaggtactacggtacggttacgggggacccgtaaacccggggg

SEQ ID NO: 320675 - DNA, 718 bp, Homo sapiens
  misc_feature: GZ8MTXP02I5EUO.19.67.G01.1.454.CMB.2.raw
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtgggcggaggcttggtccaggccgtggggcggtctcgtgagactgtcctgtcgaccctgtgggtctccgtcagcagcgactgtattcgcctgggtccgcgaggcctccgaggggaagagggccggaggtcgggtcgcgtaggttatttttagaggggtggaccgtactagttcgtaacgggacgtaacctccgaggtggggaacggggtccgtattaccgaacctattcccgtaccgaagtacggttaacctttttcacgtaaacgtaactacctaacgttcgttaccttacttaactaaaattacgaaacgacgtacccgtagggaacggggacccggaaacgggaccgtaccggggtacccgttaacgttaagtttaacgtttcggtaggttacggtaggttaacggtttaggtacgggtacggtaggttccgggtacggttaggggtaagggaaccgtaaggtaccgtacggtaaccggttccgggggaacccgtaaaacccggggg

SEQ ID NO: 320676 - DNA, 758 bp, Homo sapiens
  misc_feature: GZ8MTXP02HM7VQ.19.67.G01.1.454.CMB.2.raw
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgaccttgggttttccttgctgcaatttcaggaggtgtccagtgtgaggtgcaacgtggtggagacgtgggcggaggcttggtccaggccgtggggcggttctcgtgagactgtcctgtcgaccctcgtgggtctccgtcagcagcgatggtattggccgtcgggtccgccgaggcctaccggaagggaacggacgggcccgggtaggtcggggtcgacgtaggtttagtttttagacggggtacggggacgtactacgtttacgacgggacgtaccgtccgtaaaggtggggaaccgggtaccgtactttaccaaaccctacgttcctaccgaaggtacgttacctttttccgacgtaaacgtaaacctaccgtaacttcgttaccttaccgttaaacctaaagttaacgtaaacgacgtcccggtaagggaacccggggacccggtaaacgggacccggaaccgggttaccccggttaacgttaacgttttaagtttacgggttggttacggttaaggttaaaggtttttaacgcggggtacgttaacgggtgttccgggttaggggaaccggtagtaacggtacgtttaccggaccgggtaaccggggg

SEQ ID NO: 320677 - DNA, 567 bp, Homo sapiens
  misc_feature: GZ8MTXP02FT429.19.67.G01.1.454.CMB.2.raw
  modified_base (426)..(426): a, c, t, g, unknown or other
  misc_feature (426)..(426): n is a, c, g, or t
  modified_base (526)..(526): a, c, t, g, unknown or other
  misc_feature (526)..(526): n is a, c, g, or t
  modified_base (543)..(543): a, c, t, g, unknown or other
  misc_feature (543)..(543): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctggggcggtctctgagactgtcctgtgaaccctctggggtctccgtcagcagcgactgtattgcctgggtccgccaggctccgagggaagaggcccgggaggtggggtcgcgaggttatttttagtaggtggggacgacattcgtacggagctccatgggagggccgattcaccatctcccagagtacttttcncacgaaccacactagtcttacttaccaaaattgaaacacgccgtaggacggggccgaagggaccgaccgggccgtctattagttgtgtgagtagtttagnggtcgagtggcgtgggngtacgagactacgacgtacggggg

SEQ ID NO: 320678 - DNA, 650 bp, Homo sapiens
  misc_feature: GZ8MTXP02JP1I7.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgctaatttcaggaggtgtccagtgtgaggtgcaacgtggtggagacgtgggcggaggcttggtccaggccgtgggcgtctctgagctgtctgtcgaccctcgtgggtctccgtcagcagcgactgtattcgccgtggtccgccgaggcctaccggaggggaaacggcgggcgggaggtgggtcgcgtaggtttagtttttaggagggtagggaccgtactagttacgtaacggacgacttaccgagtgggaacgggtccgtattccgaaccgtactcctaccgaagtacgttacctttcacaacgaacacctacttcgtcctacttacaaagtagaaacgacgccgtacggacggggaccgaacggacgaccggtccgttactagttaacgttgtggtaggaagttagtttaggtacggtcggtagtcgggtacgtaggggcggtaacgaggtacgtcgacgggtcggggaccggtaaacccgggg

SEQ ID NO: 320679 - DNA, 669 bp, Homo sapiens
  misc_feature: GZ8MTXP02I3V6P.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttcctgctgcaatttcaggaggtgtccagtgtgaggtgcaactggtggagacgtgggcggaggcttggtccaggccgtggggcgttctcgtgagtactgtcctgtcgaccctgtgggtctcgcagcagcgactgtattgcctgggtccgcaggcctccgaaggggaagaggccggagtcgggtcgcgtaggttatttttagagggtggaccacgtattcgacggagtacctccgaggtcgggaacgggccgtaattccacctacgtctaccagtacgttacttttcacgtaaagaactaccacgttcgtctacgttacaaaattcgaaacgagtcccgtagggacggggaccccgaaagggaccgtaaccggggtcccttacgttaaagtttcgttagggtacggttaagggttaggttaaggttttaacggtggggtaccgtaaggttgggccggtaggggtaacggaacgtaagtaccgtacggaaccggtcgggggaacccgtaaaccgggg

SEQ ID NO: 320680 - DNA, 586 bp, Homo sapiens
  misc_feature: GZ8MTXP02JRFBY.19.67.G01.1.454.CMB.2.raw
  modified_base (539)..(539): a, c, t, g, unknown or other
  misc_feature (539)..(539): n is a, c, g, or t
  modified_base (552)..(552): a, c, t, g, unknown or other
  misc_feature (552)..(552): n is a, c, g, or t
  modified_base (557)..(557): a, c, t, g, unknown or other
  misc_feature (557)..(557): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgacggaggcttggtccagcctgggcggtctctgagactgtcctgtcgaaccctctggggtctccgtcagcagcgactgtattgcctgggtccgccaggctccgagggaagaggccggagtgggtcgcgtaggttatttttagtagggtggggacccgacgtatttcgtacgggagaacctccagtcggggagggccgattccgacctatcctcccgagacgttaccttttctacaagaacacactgttcctacttacaaaatgaaacacgccctggacggggccgaagggaccaccgggccgtcttattagttgtggtagagttagtttagnggtacgagtcggngtggngacgagactcgacggtcgggaccgacggg

SEQ ID NO: 320681 - DNA, 618 bp, Homo sapiens
  misc_feature: GZ8MTXP02GJLBD.19.67.G01.1.454.CMB.2.raw
  modified_base (405)..(405): a, c, t, g, unknown or other
  misc_feature (405)..(405): n is a, c, g, or t
  modified_base (409)..(409): a, c, t, g, unknown or other
  misc_feature (409)..(409): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagtttggctgacctgggttttcctgctgcaattcaggaggtgtccagtgtgaggtgcaacgtggtggagacgtgggcggaggcttggtccaggccgtggggcggtctcgtgagtactgtcctgtcgaccctgtgggtctcgtcagcagcgactgtatgccgtggtccgccgaggctaccgaggggaagagggccggaggtgggtcgcgtaggtttattttagagggtggaccacgattcgtaggagacctcagtgggaggccgattccacntccncagacgtactttcacaagaacactacttcgtccttacttacaaaagttacgaaacgacgtaccgtagggaccggggaccgaacggaccgaaccggtccggttacttagtttagtggtgtaggtagttagttttagcgggtacgtacgtgggcgtttgggaacggtaacgaggtacgtacggacgggtcgggggacccgtaaacccgggg

SEQ ID NO: 320682 - DNA, 666 bp, Homo sapiens
  misc_feature: GZ8MTXP02FHWM8.19.67.G01.1.454.CMB.2.raw
  modified_base (387)..(387): a, c, t, g, unknown or other
  misc_feature (387)..(387): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccaggcctgggccggtctctgagactgtcctgtcgaaccctcgtggggtctccgtcagcagcgactgtattgccgtgggtcccgccaggcctccgaaggggaagagggccgggaggtggggtcgcgtaggttatttagtagggtgggaccgactagttcgacgganaccttcgagtcggggaggggtccgtattccgaaccatcctccgagtaacgttacttttcctacgaaagaaaccaccgacttacgtccttacttaacaaaactggaaaacctacgccgtaggaacgggggacccgaacggaaccgaccggtccgtacgtaattacgtttggtaggtacggtaagttaggttttaacggcgggttacggtagttcgggacgttagggtaacggtaacgtaacggtactaccggtacgggtcgggggacccgtaaaccgggg

SEQ ID NO: 320683 - DNA, 593 bp, Homo sapiens
  misc_feature: GZ8MTXP02JA8T4.19.67.G01.1.454.CMB.2.raw
  modified_base (263)..(263): a, c, t, g, unknown or other
  misc_feature (263)..(263): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagtttggctgacctgggtttcctgctgcaatttcaggagtgtccagtgtgaggtgcaacgtggtggagactgggcggaggcttggtccagccgtgggcggtctctgagactgtcctgtcgaccctntggggtctccgtcagcagcgactgtattgccgtggtccgcgaggctccgaggggaagaggccgggaggtgggtcgcgtaggttagtttttagagggtgggactacattcgtaacggagacctccgaagtcgggaacggggccatttccgacctatcctaccgagtacgtacttttctacaacgtaaaccactaacttgtactacttaccaaatcggaaacacgtccgtaggacgggaccgagggaccgtacggccgtactagttattggtgtagagtagtttagtcggtacgtgttggaacgtggtacggacgagactcgacggtcgggg

SEQ ID NO: 320684 - DNA, 609 bp, Homo sapiens
  misc_feature: GZ8MTXP02GMWR6.19.67.G01.1.454.CMB.2.raw
  modified_base (193)..(193): a, c, t, g, unknown or other
  misc_feature (193)..(193): n is a, c, g, or t
  modified_base (310)..(310): a, c, t, g, unknown or other
  misc_feature (310)..(310): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtncaactgggtggagactgggcggaggcttgggtccaggccgtggggcggtctctggagactgtcctggtcgaaccctgtggggtctccgtcagcagcgactgtattgccgtgggtccnccaggcctaccgaaggggaagagggccggaggtggggtcgcgtaggttattttagaggggtgggaccgactattcgtaacggagaccttcgagtcgggacgggccgtagttccaacctatcctacagtacgtacttttcacaagaacactaactgtcctacttacaaatcgaaacacgccgtaggacgggaccgaacggacgaccggtccgtactattagttagtgtagtaggtagtttagtaggtacgagtggcgtgggtaagacgagactcgacggtacggggaccgtaaaccgggg

SEQ ID NO: 320685 - DNA, 679 bp, Homo sapiens
  misc_feature: GZ8MTXP02GEU0N.19.67.G01.1.454.CMB.2.raw
  modified_base (301)..(301): a, c, t, g, unknown or other
  misc_feature (301)..(301): n is a, c, g, or t
  modified_base (438)..(438): a, c, t, g, unknown or other
  misc_feature (438)..(438): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagccgtgggcgtctctgagactgtcctgtcgaccctcgtgggtctccgtcagcagcgactgtatgccgtgggtccgcnggctaccgaggggaacgagggccggaggtggggtcgcgtaggttatttttagtaggggtgggaccgtactagtacgtacggagacctcaggtcgggacgggccgtattacaccatccgtccagtacgtccttttacncgaaacgaacacctacttcgtaccttacttacgaaaacttacgaaactcggtaccttacggggaacggggacccgggaaacgggaccgtaaccgggtcccggtttaacttaaagtttaacgtttcggttaggtaggttaacggttaaggttttaacggtggggtaccgtaagttcgggtcgttaggggtaacggaacgtaaggtacgtcgtaaacgggtcggggtaccggtaaacccgggg

SEQ ID NO: 320686 - DNA, 663 bp, Homo sapiens
  misc_feature: GZ8MTXP02IY2Q9.19.67.G01.1.454.CMB.2.raw
  modified_base (302)..(302): a, c, t, g, unknown or other
  misc_feature (302)..(302): n is a, c, g, or t
  modified_base (338)..(338): a, c, t, g, unknown or other
  misc_feature (338)..(338): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagccgtgggcggtctctgagctgtcctgtcgaccctcgtggggtctccgtcagcagcgactgtattgccgtgggtccnccaggcctccgaagggaagaggccggagtgggtcgntaggttattttagagggtggatgactattcgacggagactcagtggacggccgattcacctatcctaccgagtacgtacttttctacgaacgaacctaactaccttgtaccttcttaaaccaaaagttcgaaaaccgacgacccttaggggaaccggggcccggaaacgggacccgtaacccggggtacccggttatttaacgtttaagtttggttacggttaggtaaaggttacgttttaaggtagggtcggttaagtcggggtagttaaggggtacgggtaacgaaagggaccttaccggaccgggttacgggggtaacccgg

SEQ ID NO: 320687 - DNA, 584 bp, Homo sapiens
  misc_feature: GZ8MTXP02IBBKF.19.67.G01.1.454.CMB.2.raw
  modified_base (262)..(262): a, c, t, g, unknown or other
  misc_feature (262)..(262): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtggcggaggcttggtccagccgtgggcgtctctgagctgtcctgtgaccctcgnggggtctcgtcagcagcgactgtattgcctgggtccgccaggctccgagggaagaggccgggagtggggtcgcgtaggtatttttagagggtgggaccgacatttcgacgggagacctccgagtgggagggcccgtattccgaccatcctccagacgtactttcacagaacacactgtctctacaaatgaaactgccgtaggacgggccgaggaccgacggccgtacgttattagttggtcgtaggagttaggtttaatcgggacgtagtcgggtcgtagggtggacaaggtacttacgacggtcgggggaccaaccggggg

SEQ ID NO: 320688 - DNA, 623 bp, Homo sapiens
  misc_feature: GZ8MTXP02JTFU1.19.67.G01.1.454.CMB.2.raw
  modified_base (276)..(276): a, c, t, g, unknown or other
  misc_feature (276)..(276): n is a, c, g, or t
  modified_base (319)..(319): a, c, t, g, unknown or other
  misc_feature (319)..(319): n is a, c, g, or t
  modified_base (337)..(337): a, c, t, g, unknown or other
  misc_feature (337)..(337): n is a, c, g, or t
  modified_base (381)..(381): a, c, t, g, unknown or other
  misc_feature (381)..(381): n is a, c, g, or t
  modified_base (472)..(472): a, c, t, g, unknown or other
  misc_feature (472)..(472): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagccgtggggcggtctctgagactgtcctgtgaccctcgtgggtctccgtcngcagcgactgtattgcctgggtcccgcaggctccgagggaagngggccggaggtgggtcgngtaggttattttagaggtgggaccgacattcgacggagactccngtcgggagggtcctattccacgatccgtaccagtacgtacttttcacgaacgtaaacaccacttgtacttaccttactaaaagtcgaaacncggtacccgtgggacggggacccgaagggaccgaccgggtccgttatacgtttagtgtggttaggagttagtttagcgggtacgtacgttggggtacgtggggtaacggagtacggtactacggaacggtcgggggacccggtaaacgggg

SEQ ID NO: 320689 - DNA, 671 bp, Homo sapiens
  misc_feature: GZ8MTXP02GO5TG.19.67.G01.1.454.CMB.2.raw
  modified_base (443)..(443): a, c, t, g, unknown or other
  misc_feature (443)..(443): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggagtgtccagtgtgaggtgcaactggtggagactgggcggaggcttggtccagcctgggcgtctctgagactgtcctgtcgaaccctgtggggtctccgtcagcagcgactgtattgcctgggtccgccaggctccgaggggaagcgggccggagtgggtcgcgtaggttattttagagggtggacccgacattcgtacggagacctcgagtcgggacgggtccgtattaccacatcctacccagtacgtaccttttcgactaagaaacnctaactcgttcctacttacaaaagttcgaaaccgcggtacctagggaaccgggggacccgaacgggacccgtaaccgggtcccgttaccgttaacgttttaacgttcggttaggtacggtaaaggttacggtttttaaaggtcggggtaccgtaggttccgggtgttaggggtaaggaaccgtaaggtacgtaccggtaacggtcgggggtaacccctaaaccggggg

SEQ ID NO: 320690 - DNA, 682 bp, Homo sapiens
  misc_feature: GZ8MTXP02GWSLF.19.67.G01.1.454.CMB.2.raw
tcagtactctcgtgcacgaccggtgctcgatttagagtatacatattggggtttgggggagctacaacaggcaggcaggggcagcaagatggtgttgcagacccaggtcttcatttctctgttgctctggatctctggttcctggcggggacatcgtgatcgacccagtacccagactcactggctgtgtctcgtgggcgagacggccaacaatcaactgcaggtccagccaagaactattttccaccacctaccaaagaaactaaaaacttcttacgacctacggtaaccaacagacgaccgaggacacgccctacctaaagtcgacttctaactttacgtgggtccttacgtacggccgtacgtaacgttcccggggtcccttacgggaacccccgtacggttccgggggacctacggggtccggggtacgtacggggaccgtagttactttccgaccttccgtacacctactcacgccgagcctggacgacggctaggaaagtgtggtacggtacttaaggttttactacgtgtactacgtattaaacttttctttttactacgttcccgttacggtaggtaacccgtttccgggaaccgtaaacggggaccggtaagggtacgtaaacgtaccgaaggaaccgtaacgtgggtacgcgtcgaccgtactacttcgttc

SEQ ID NO: 320691 - DNA, 771 bp, Homo sapiens
  misc_feature: GZ8MTXP02FW6OD.19.67.G01.1.454.CMB.2.raw
  modified_base (312)..(312): a, c, t, g, unknown or other
  misc_feature (312)..(312): n is a, c, g, or t
  modified_base (344)..(344): a, c, t, g, unknown or other
  misc_feature (344)..(344): n is a, c, g, or t
  modified_base (386)..(386): a, c, t, g, unknown or other
  misc_feature (386)..(386): n is a, c, g, or t
tcagtactctcgtgcacgaccggtgctcgatttagagtatacatattggggtttgggggggagaggagcccagcactgggattccgaggtgtttccattcggtgctcagcactgaacacagaggactcaccatggagtttggctgacctgggttttcctgctgcaatttcaggaggtgtccagtgtgagggtgcaacgtgggtggagacgtgggcggagggcttgggtccaggccgtggggcggtctctgagactgtcctgtcgaaccctcgtggggtcctccgtcagcagcgactgtattgcctgggtccncaggctcgaggggaagaggccggagtgggtcncgtaggttattttagagggtgggaccactattacgtaggganactccgaggtgggacggggtccattccgaacatcctaccgagtacgtacttttacacgaaagtaaaccacctaacttcgttaccttaccttaacaaaaagttcggaaaacctacggtaccccttaggggaaaccgggggacccggtaaaacgggaacccggtaaacccgggggtcccccgttttaacggttaaacttttaaacgggtttcgggtaacgggtttacgggtaaaacggggtttaaaggttttacgggtaagggggtaccgtaaacgggtttacgggggtccgtttaaggggggttaacggggaaaccgtaaagggtaaccgttaaccggtaaacccgggggttccgggggggtaaaccccgtaaaaccccggggggg

SEQ ID NO: 320692 - DNA, 600 bp, Homo sapiens
  misc_feature: GZ8MTXP02FZ4Z3.19.67.G01.1.454.CMB.2.raw
  modified_base (281)..(281): a, c, t, g, unknown or other
  misc_feature (281)..(281): n is a, c, g, or t
  modified_base (306)..(306): a, c, t, g, unknown or other
  misc_feature (306)..(306): n is a, c, g, or t
  modified_base (323)..(323): a, c, t, g, unknown or other
  misc_feature (323)..(323): n is a, c, g, or t
tcagtactctcgtgcacgaccggtgctcgatttagagtatacatattggggtttgggggggagaggagcccagcactgggattccgaggtgtttccattcggtgctcagcactgaacacagaggactcaccatggagttttggctgacctgggttttcctgctgcaatttcaggaggtgtccagtgtgaggtgcaacgtgggtggagacgtgggcggaggcttggccaggccgtggggcggtctctgagactgtcctgtcgaccctcgtggggtctccgtnagcagcgactgtatgccgtggtccncaggctccgagggaagnggcggagtgggtcgcgtaggttattttagagggtggaccgactagttcgacggagacctcgagtggggacgggccgtattccaactactcctacgagtacgtactttcgcaacgaacactactcgttctacttacaaatcgaaactacggccgtaggacgggccgaacggaccgacggcgttacttattagttcgtgtaggtagtagtttagacgggtcgtagtcgggtcgtagggtcggaacaggtactcggacggtacgggggaccgtaacgggg

SEQ ID NO: 320693 - DNA, 570 bp, Homo sapiens
  misc_feature: GZ8MTXP02FRVO4.19.67.G01.1.454.CMB.2.raw
  modified_base (317)..(317): a, c, t, g, unknown or other
  misc_feature (317)..(317): n is a, c, g, or t
  modified_base (444)..(444): a, c, t, g, unknown or other
  misc_feature (444)..(444): n is a, c, g, or t
  modified_base (454)..(454): a, c, t, g, unknown or other
  misc_feature (454)..(454): n is a, c, g, or t
  modified_base (538)..(538): a, c, t, g, unknown or other
  misc_feature (538)..(538): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttcctgctgcaatttcaggaggtgtccagtgtgaggtgcaactggtggagactgggcggagcttggtccagcctgggcgtctctgagactgtcctgtcgaaccctcgtggggtctccgtcagcagcgactgtattgcctgggtccgcaggcctcgaggggaagnggccggagtgggcgcgtaggttattttagagggtggaccgacgtattcgacggacgactcagtggacgggccgtattccgacatctaccgagacgtacttttcacaagtaacactactgtctactanaaatcgaaanacgccgtagacggggccgaacggaccacggccgtacttagttatcgtagtagaggttagtttagaggcgtagtcggcgttaggngacagtactcgaacgtcggggacctaacgggg

SEQ ID NO: 320694 - DNA, 616 bp, Homo sapiens
  misc_feature: GZ8MTXP02HZIL4.19.67.G01.1.454.CMB.2.raw
  modified_base (364)..(364): a, c, t, g, unknown or other
  misc_feature (364)..(364): n is a, c, g, or t
  modified_base (379)..(379): a, c, t, g, unknown or other
  misc_feature (379)..(379): n is a, c, g, or t
  modified_base (451)..(451): a, c, t, g, unknown or other
  misc_feature (451)..(451): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtgggcggaggctttggccagccgtgggcgtctctgagactgtcctgtgaaccctgtgggtctacgtcagcagcgactgtattcgccgtgggtccgcaggctcgaggagaggcgtagtggcgcgtaggtatttttagacgggtgggacacgtnttacgtacgggaacncgttccgaagtcggggacggggtaccatttccgacctatcctaccagtagtacctttctagaacgactaacncttgtctacttacaaatcgtaacagtccgtaggacgggaccgagggacccgacggggtcccttacgttaagtttagttggtagtggtaaggtaggtttaaagccgggtacgtaagtgggtaagttacggggtaggacgtacgtacgtacggtaacgggtccgggg

SEQ ID NO: 320695 - DNA, 719 bp, Homo sapiens
  misc_feature: GZ8MTXP02HT9QG.19.67.G01.1.454.CMB.2.raw
tcagtactctcgtgcacgaccggtgctcgatttagagtatacatattgggtttggggggagaggagcccagcactgggattccgaggtgtttccattcggtgctcagcactgaacacagaggactcaccatggagttttggctgaccttgggttttccttgctgcaatttcaggaggtgtccagtgtgaggtgacaacgtggtaggagacgtgggcggaggtcgttggtccagccggtgggcgtctctggacgtctgtcctgtacgacccgtcgtgggtcctccgtcacgcagcgtactgtagttcgccgtcgggtccgccgacggcctaccggaagggaacggacgggccggaggtcgggtaccgcgtaaggtttaatttttacggaggggtacggaacccgtaactagtttaccgtaacgggtacgtacctccgaggtcggggacggtaccgtactttccgaacctactcctaccgaagtacgttaccttttacgaacgaagaaacctactacgttcgtaccttactaactaaaacgttacgaacgtacggtcccgtaggggaaccggggacccgaagggaaccgtacccgggtaccgttacttaacgtttagttaggtagtaacggtaagtttaggtttaagcgggtacgtacggtggtacgtaggggtaagaacgaggtacgtacggtaccgggacggggacccggtaaaccggg

SEQ ID NO: 320696 - DNA, 602 bp, Homo sapiens
  misc_feature: GZ8MTXP02IYRWF.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtggggtgcaactggtggagactggcggaggcttggtccagcctgggcgtctctgagactgtcctgtgaaccctcgtgggtctccgtcagcagcactgtattcgccgtgggtcccgcgacggctaccgaggggaaggacggccggaggtcggggtcgcgtaggttatttttagtagggtgggacgactagttctacgggagtactccgagtggggacgggccgtacttccgaccatcctccgagtacgtaccttttcacacgaacactactgtctctacaatagaacagccgtaggacgggcgaaacggcgacggtaccgtactagtttagtggtggtagtaggttaggttttagcgggtacgtacgtggcgtgggtaggaacgtagactcgacgtcggggcccaacggggtacccg

SEQ ID NO: 320697 - DNA, 606 bp, Homo sapiens
  misc_feature: GZ8MTXP02HUD0G.19.67.G01.1.454.CMB.2.raw
  modified_base (276)..(276): a, c, t, g, unknown or other
  misc_feature (276)..(276): n is a, c, g, or t
  modified_base (307)..(307): a, c, t, g, unknown or other
  misc_feature (307)..(307): n is a, c, g, or t
  modified_base (366)..(366): a, c, t, g, unknown or other
  misc_feature (366)..(366): n is a, c, g, or t
  modified_base (374)..(374): a, c, t, g, unknown or other
  misc_feature (374)..(374): n is a, c, g, or t
  modified_base (402)..(402): a, c, t, g, unknown or other
  misc_feature (402)..(402): n is a, c, g, or t
  modified_base (541)..(541): a, c, t, g, unknown or other
  misc_feature (541)..(541): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttcctgctgcaatttcaggaggtgtccagtgtgaggtgcaactgggtggagacgtgggcggaggcttggtccagccgtgggcgtctcgtgagactgtcctgtacgaccctgtgggtctccgtnagcagcgatgtatgcctggtccgcgaggtcnccgagggagaggcggagtgggcgctagtatttttagaggtggaccatagttcgacgganaccgtacngtaggacggccgtactcgaccattcccncagtacgttactttacacaacgaaactccgtaacttcgtaccttactacaaaagttcgaaaccgacgttaccgagggaacgggacccgaaggacccgaacgggtaccgtactttagttatgtggtagaggttagttagnggggtactaggtggtcggttaggaacggacaggtacctgaaccggttcgggacccggtaaccggg

SEQ ID NO: 320698 - DNA, 594 bp, Homo sapiens
  misc_feature: GZ8MTXP02FG0WE.19.67.G01.1.454.CMB.2.raw
  modified_base (371)..(371): a, c, t, g, unknown or other
  misc_feature (371)..(371): n is a, c, g, or t
  modified_base (525)..(525): a, c, t, g, unknown or other
  misc_feature (525)..(525): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttcctgctgcaatttcaggaggtgtccagtgtgaggtgcaactgggtggagactgggcggaggcttggtccagcctggggcggtctctgagactgtcctgtcgaaccctcgtggggtctccgtcagcagcgactgtatgcctggtccgcaggctcgagggagaggccggagtgggcgcgtaggttattttagagggtgggaccgactattcgacgganactcagtgggacggcattcacatctccagacgtactttcacaagaacactactgtctacttacaaaatcgaaacacgccgtaggacggggccgaacgggaaccgaccgggtcccgttacttaattagtttggtggtacgaaggttagtttaagngggtacgagttcgggacgttggggaaggaactaggactccgtaacggtcgggggacccgaaaccggggg

SEQ ID NO: 320699 - DNA, 679 bp, Homo sapiens
  misc_feature: GZ8MTXP02JAEXG.19.67.G01.1.454.CMB.2.raw
tcagtactctcgtgcacgaccggtgctcgatttagagtatacatattgggtttggggggagaggagcccagcactgggattccgaggtgtttccattcggtgctcagcactgaacacagaggactcaccatggagttttggctgaccttgggttttccttgctgctaatttcaggaggtgtccagtgtgaggtgcaagtggtggagacgtggcggaggtcttggtccagccgtgggcggtctcgtggagtacgtgtccgtggtcgaacccgttcgtcggggtcctccgtcagcagcgactgtatcgccgtgggtccgcgacgctaccgaagggaacggcggccggaggtcgggcgacgtaggtttagttttagaggggtggaccgactagttacgaacggagacctcgagtgggacggccattccgaacctatcctaccgagtacgttacctttcgaaccgaagaaaccgtactaacttacgttaccttacgttaactaaaagtaccgtaaacgacggtaccgtagggaacgggggacccgaaacggaccggtaacccggtcgttacgtttagttaagttgtaggttaggtacggttaaaggtttagtacgggcggttaacgtgggtaccgtgggtaacggaacaggtacgtacgacggtacggggaccgtaaccgggg

SEQ ID NO: 320700 - DNA, 631 bp, Homo sapiens
  misc_feature: GZ8MTXP02JZJYB.19.67.G01.1.454.CMB.2.raw
  modified_base (384)..(384): a, c, t, g, unknown or other
  misc_feature (384)..(384): n is a, c, g, or t
  modified_base (392)..(392): a, c, t, g, unknown or other
  misc_feature (392)..(392): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttcctgctgcaatttcaggaggtgtccagtgtgaggtgcaatggtggagacgtgggcggaggcttggtccagccgtggggcggtctctgagctgtcctgtcgaccctcgtgggtctccgtcagcagcgactgtatcggccgtggtccgcaggctccggagggaagacgggcggtaggtggggtcgcgtaggttatttttaggagggtagggaccgactattcgtaacggngactccgngtggggacgggccgtattccacgactcctaccgagtagttacctttctacgtaacgaacacacgttcgttcttaccttacaaagttacgaaacacgtccgtagggacggggaccggacggaccgtacgggcccggttactacgtttagttagtggttaggtaaggttagttaagtgggacgtagtcggcgtaggggtaagacgaggtacgtcgaacggtcggggaccgtaacccggggg

SEQ ID NO: 320701 - DNA, 232 bp, Homo sapiens
  misc_feature: GZ8MTXP02FTX4N.19.67.G01.1.454.CMB.2.raw
  modified_base (230)..(232): a, c, t, g, unknown or other
  misc_feature (230)..(232): n is a, c, g, or t
tcagtactctcgtgcacgaccggtgctcgatttagagtatacatattgggtttgggtgccgaagttgctggaggtcacggtcaccgtctcctcagcctccaccaagggcccatcggtcttccccctggcgccctgctccaggagcacctccgagagcacagcggccctgggctgcctggtcaaggactacttcccacgagagtactgagcgggctggcaaggcgcatagnnn

SEQ ID NO: 320702 - DNA, 597 bp, Homo sapiens
  misc_feature: GZ8MTXP02G1YZR.19.67.G01.1.454.CMB.2.raw
  modified_base (301)..(301): a, c, t, g, unknown or other
  misc_feature (301)..(301): n is a, c, g, or t
  modified_base (318)..(318): a, c, t, g, unknown or other
  misc_feature (318)..(318): n is a, c, g, or t
  modified_base (539)..(539): a, c, t, g, unknown or other
  misc_feature (539)..(539): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagccgtgggcggtctctggagactgtcctgtcgaaccctctggggtctccgtcagcagcactgtatgcctgggtccnccaggctccaggggaanaggccggagtgggtcgcgaggtatttttagaggtgggaccgacattctacggagactccagtggagggccgattcaccatctccagtagacttttcacagaaacacactgtctacttacaaaatcgaaacagccctggaagggggcccgaagggaccgaccgggccgtacctaattattggtgttggaggttaagtttaagtgggacgtaagttcgggggngttagggtaacggaacgtagtaacgtaccgaacgggtacgggggaccggtaaccgggg

SEQ ID NO: 320703 - DNA, 655 bp, Homo sapiens
  misc_feature: GZ8MTXP02HI6BO.19.67.G01.1.454.CMB.2.raw
tcagtactctcgtgcacgaccggtgctcgatttagagtatacatattgggtttggggggagaggagcccagcactgggattccgaggtgtttccattcggtgctcagcactgaacacagaggactcaccatggagttttggctgaccttgggttttccttgctgcaatttcaggaggtgtccagtgtgaggtgcaactggtggagacgtgggcggaggcttggtccagccgtgggcggtctctgagactgtcctgtcgaacccctcgtggggtctccgtcagcagcgactgtattgcctgggtccgccgaggcctccgaggggaagacggccgggagtggggtcgcgtaggttagtttttagtagggtggggaccgactagttcgtacggagacctcagtggggacgggccggtattccaccgaatcctaccagtacgtacttttcctcaagtaactaaccacttacgttccttacttaacaaacgtacgaaaccacggtaccttaggggacggggtacccggaagggaccggtaccgggacccggttacttaagtttacgtttggtggttacgagggttagtttaagcgggtagtacgtgggtcgtggggtaaggacgagtacgtcgacggttcgggggacccgaaaccggggg

SEQ ID NO: 320704 - DNA, 570 bp, Homo sapiens
  misc_feature: GZ8MTXP02IIFIO.19.67.G01.1.454.CMB.2.raw
  modified_base (323)..(323): a, c, t, g, unknown or other
  misc_feature (323)..(323): n is a, c, g, or t
  modified_base (526)..(526): a, c, t, g, unknown or other
  misc_feature (526)..(526): n is a, c, g, or t
tcagtactctcgtgcacgaccggtgctcgatttagagtatacatattgggtttggggtctgggagaggaacccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcgtctctgagactgtcctgtcgaaccctcgtggggtctccgtcagcagcgactgtatgccgtgggtccgcgaggcctccgagggaagngggccggaggtgggtcgcgtaggttattttagaggtcgggacgactagttcgacggagactccgagtggggacggccgtaattccgaacctacgtcctacgaagtacgtacttttcactaagaacaactactcgtctacttacaaatcgaaacagcctaggacggcgaggacacggctactatatgtgtagtagtagtttagnggtacgagtggacgtgggtgacgagatcgacggtgggaacccgg

SEQ ID NO: 320705 - DNA, 540 bp, Homo sapiens
  misc_feature: GZ8MTXP02GA227.19.67.G01.1.454.CMB.2.raw
  modified_base (297)..(297): a, c, t, g, unknown or other
  misc_feature (297)..(297): n is a, c, g, or t
  modified_base (310)..(310): a, c, t, g, unknown or other
  misc_feature (310)..(310): n is a, c, g, or t
  modified_base (336)..(336): a, c, t, g, unknown or other
  misc_feature (336)..(336): n is a, c, g, or t
  modified_base (358)..(358): a, c, t, g, unknown or other
  misc_feature (358)..(358): n is a, c, g, or t
  modified_base (363)..(363): a, c, t, g, unknown or other
  misc_feature (363)..(363): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctggggcggtctctgagactgtcctgtgaaccctctggggtctccgtcagcagcgactgtatgctggtccncaggctccagganaggcgagtgggtcgcaggtattttanaggtggacgacattctacgganactcngtggacggcatcacatctacagatctttcacaagaacacactgtctacttacaaaatgaaacagcctaggacgggaccgaaggacgacggctactattagtgtgtagagtagtttagtcgggacgtacgtcgtgtggtaaggacgacgtacgtacgtacggtacgggacggaacggg

SEQ ID NO: 320706 - DNA, 595 bp, Homo sapiens
  misc_feature: GZ8MTXP02JKIXZ.19.67.G01.1.454.CMB.2.raw
  modified_base (457)..(457): a, c, t, g, unknown or other
  misc_feature (457)..(457): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtggcggaggcttggtccagccgtgggcggtctctgagactgtcctgtcgaaccctcgtggggtctccgtcagcagcgactgtattgcctggtccgcagctccgaggaagaggccggagtgggcgcgtaggttatttttagaggtggaccgactattcgtacggagactcagtggacgggccgtattacgaccatcctacccagaacgtacttttctacaacgaaacacacttcgtctacttacaaagtanaaacagaccgtggacgggaccgaaggaccgaccgggtccgtacgttaacttagttgtgttacggagttaagttagtgggtacgagtcggtcttggggaagaacgaggtacgtccgacgtcgggggaccctaaacgggg

SEQ ID NO: 320707 - DNA, 681 bp, Homo sapiens
  misc_feature: GZ8MTXP02GL5WS.19.67.G01.1.454.CMB.2.raw
  modified_base (319)..(319): a, c, t, g, unknown or other
  misc_feature (319)..(319): n is a, c, g, or t
  modified_base (433)..(433): a, c, t, g, unknown or other
  misc_feature (433)..(433): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagtttggctgacctgggtttccttgctgcaatttcaggaggtgtccagtgtgaggtgcaacgtggtggagactgggcggaggcttgggccagccgtggggcgtctcgtgagtctgtcctgtgaaccctctggggtctccgtcagcagcgactgtatgcctggccgccaggctccagggaagnggcccgggaggtgggtcgcgaggtatttttagagggtgggacgactagttctacggagctccgagtgggagggccgtagttccaacctagtcctaccagtaagtaccttttacncgtaacgaaactacctacttcgtaccttactttaccaaaacgtcgtaaaccgacgtcccgtaggaacgggggacccggacggggaaccgtaccggggtacccgttacgtttaacgtttaagtttcgggttaggttaggttaacggttagggttttaacgttagggggtaccggttaaggtttcgggggtaacggtttcgggggagggtaaccggtaaggtacgtaccggtaaaccggttaccgggggg

SEQ ID NO: 320708 - DNA, 650 bp, Homo sapiens
  misc_feature: GZ8MTXP02JOOZR.19.67.G01.1.454.CMB.2.raw
  modified_base (589)..(589): a, c, t, g, unknown or other
  misc_feature (589)..(589): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttcctgctgcaatttcaggtaggtgtccagtgtgaggtgcaacgtgggtggagacgtgggcggaggtcttgggccaggccgtggggcggtctcgtgagctgtcctgtcgaacccctgtcggggtctccgtcagcagcgactgtatcgccgtcggtccgccaggctccgaagggagacggccggaggtgggtcgcgtaggtttatttttaggacgggttgggaacccgtactacgtttaccgtaacgggacgtaactcgtaggtgggggaacgggggtaccctagttccaaccatccctaccgagtaacgttactttacgacgtaagaaacaccgtaactgttactacttaacaaaattcgaaactcgtaccgtagggaccgggacgaggacctacgggtccgttactagtttgtgtaggtacgaggttgttaggnggtacgtagtcggtacgtggtaagacgtacgtacggtacgacgggtacgggaccgtaacgg

SEQ ID NO: 320709 - DNA, 550 bp, Homo sapiens
  misc_feature: GZ8MTXP02FRVBS.19.67.G01.1.454.CMB.2.raw
  modified_base (249)..(249): a, c, t, g, unknown or other
  misc_feature (249)..(249): n is a, c, g, or t
  modified_base (372)..(372): a, c, t, g, unknown or other
  misc_feature (372)..(372): n is a, c, g, or t
  modified_base (397)..(397): a, c, t, g, unknown or other
  misc_feature (397)..(397): n is a, c, g, or t
  modified_base (407)..(407): a, c, t, g, unknown or other
  misc_feature (407)..(407): n is a, c, g, or t
tcagtactctcgtgcacgaccggtgctcgatttagagtatacatattgggtttgggggtagctcaggaagcagagcctggagcatctccactatggcctgggctccactacttctcaccctcctcgctcactgcacaggttcttgggccaactttatgctgactcagcccactctgtgtcggagtctccggggaagacggtaaccatcttttgcacccacaacagtggcaacattgccagcaattttgngcagtggtaccagcagcgcccgggcacgttcccccacattgtgatctatgaggataatcaaagccgtctggggtccctgatcggttctcgtcggcctccatcgacagcctcctccaactctcncctccctcaccatctctgactgaanactgagacgnggctagacttactacgtgtctaagttccttagtcgaagttcgacccgtgggtactagtcggttggtacgttcggggacgggacgggaccaaaggctacgaccgttccgtaaggtcaacgcccgaggccttccgccccgttcgg

SEQ ID NO: 320710 - DNA, 550 bp, Homo sapiens
  misc_feature: GZ8MTXP02I5RVQ.19.67.G01.1.454.CMB.2.raw
  modified_base (443)..(443): a, c, t, g, unknown or other
  misc_feature (443)..(443): n is a, c, g, or t
  modified_base (457)..(457): a, c, t, g, unknown or other
  misc_feature (457)..(457): n is a, c, g, or t
  modified_base (475)..(475): a, c, t, g, unknown or other
  misc_feature (475)..(475): n is a, c, g, or t
tcagtactctcgtgcacgaccggtgctcgatttagagtatacatattgggtttgggggtagctcaggaagcagagcctggagcatctccactatggcctgggctccactacttctcaccctcctcgctcactgcacaggttcttgggccaactttatgctgactcagccccactctgtgtcggagtctccggggaagacggtaaccatcttttgcacccacaacagtggcaacattgccagctaattttgagcagtggtaccagcagcgccggcacgttcccccacattgtgatctatgaggataatcaaaagccgtcgtcggggtccctgactcggtctctcggctccgatcgacagcctcctcaactctcgccctccctcaccctatcgtacctggactgaactactgaaggacgaggctagactatactgtcagttctancgatacgcgtcgtnagtcgtgttcgtacgggnggaacgggtaccaagtctacggaccgttaccgaagggtccacggacccgtaaggccgttaccgcccccgttacgg

SEQ ID NO: 320711 - DNA, 672 bp, Homo sapiens
  misc_feature: GZ8MTXP02I3J2X.19.67.G01.1.454.CMB.2.raw
  modified_base (303)..(303): a, c, t, g, unknown or other
  misc_feature (303)..(303): n is a, c, g, or t
  modified_base (322)..(322): a, c, t, g, unknown or other
  misc_feature (322)..(322): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccaggcctgggcggtctctgagactgtcctgtgaaccctcgtggggtctccgtcagcagcgactgtattgccgtgggtccncaggctccgaggggaaggnggccggaggtcgggtcgcgtaggttatttttagagggttggaccgactattcgtacggagacctcgagtcgggaggggtcccgtagttccaaccatcctacccgagtacgttaacctttttcacaacgaaacacctaactcgtccttactttaccaaaaagttcgaaacgtacgacccgtagggaccgggggacccgaaggggaccctaccggggtcccgttacgttagtttagttggtaggttacggaaggttagtttttaaacgggtgggtacggtaggtcgggtacggtaggggtaacggaacgtacggtacgtaccggtaccgggtcgggggacccggtaacgggg

SEQ ID NO: 320712 - DNA, 604 bp, Homo sapiens
  misc_feature: GZ8MTXP02GTL32.19.67.G01.1.454.CMB.2.raw
  modified_base (550)..(550): a, c, t, g, unknown or other
  misc_feature (550)..(550): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagccgtggggcggtctctgagctgtcctgtcgaaccctcgtgggtctccgtcagcagcgactgtatgccgtgggtccgccgaggcgtaccgaaggggaagacgggccgggaggtcggggtcgcgtaggtttatttttaggagggtggaccgactagttcgtaggactactcgagtcgggacgggcctattccgactatcctccgagtacgttactttcactaacgaacacgtctcgtactacttacaaagtgaaactcggtacctagggacgggaccgacggacgaccggtacgtcttagttagtggttgtagtagttagtttagnggtacgtgtcggcgtgggtaagacgagtcgtacgacggtcgggacgtaaccggg

SEQ ID NO: 320713 - DNA, 622 bp, Homo sapiens
  misc_feature: GZ8MTXP02FNZMP.19.67.G01.1.454.CMB.2.raw
  modified_base (284)..(284): a, c, t, g, unknown or other
  misc_feature (284)..(284): n is a, c, g, or t
  modified_base (516)..(516): a, c, t, g, unknown or other
  misc_feature (516)..(516): n is a, c, g, or t
  modified_base (564)..(564): a, c, t, g, unknown or other
  misc_feature (564)..(564): n is a, c, g, or t
  modified_base (574)..(574): a, c, t, g, unknown or other
  misc_feature (574)..(574): n is a, c, g, or t
  modified_base (587)..(587): a, c, t, g, unknown or other
  misc_feature (587)..(587): n is a, c, g, or t
  modified_base (599)..(599): a, c, t, g, unknown or other
  misc_feature (599)..(599): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttcctgctgcaatttcaggaggtgtccagtgtgaggtgcaactgggtggagactgggcggagggcttgggtccaggccgttgggggcggttctcgtgagactgtcctgtcgaccctgtggggtctcgcancagcgactgtatcgccgtggtccgcgaggctaccgaagggagcgggtccggaggtcgggtcgcgtaaggtttatttttaaggagggtagggaacctactattacgaacgggtacaccttacgaggtcggggaacggggtccgtactttaccaaccctatcccgttaccgaaaggtacgttaacctttttcacaacgtaacactacttcgttactacttacaaaatcgaaacncgtaccgtgggaacgggccgaacgaccgtcggccttagttaattgtgngttagagttnttagcgagtgtgngttggaaggaanagctacgacggcgggacggtacg

SEQ ID NO: 320714 - DNA, 564 bp, Homo sapiens
  misc_feature: GZ8MTXP02F20EN.19.67.G01.1.454.CMB.2.raw
  modified_base (516)..(516): a, c, t, g, unknown or other
  misc_feature (516)..(516): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtatgcctggtccgcaggctccgagggaagaggccggagtgggtcgcgtaggttattttagtagggtgggacccgacattcgacggagacctccagtgggagggccgattccaccgatctcccagtacgtacttttctcaagaaccacactgtctcttacaaaatgaaacacgtcctaggaacggggccgaacggaccgacgggccgttctattagttgtgtgagtagtttanggtcgagtcggctgggtgacgagactcgacgtcggggacctaacgggg

SEQ ID NO: 320715 - DNA, 917 bp, Homo sapiens
  misc_feature: GZ8MTXP02H3F1S.19.67.G01.1.454.CMB.2.raw
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttcctgctgcaatttcaggaggtgtccagtgtgaggtgcaacgtggtggagacgtggcggaggcttggtccagccgtgggcggtctcgtgagtactgtcctgtcgaccctcgtgggtctccgtcagcagcgactgtattgccgtggtccgcgaggctccgagggaaggacgggccggaggtggggtcgtcgtaggttacgtttttagaacggggttggggaacccgtacgtacgtttaccggtaacggggtaacgtaccgttcccgtagggttcgggggaacggggtaccccgtacgtttacccgaacccgtattaccccgttaccccgaaaggtaacggtttaacccttttttccgtaacccgtaaaacggtaaaaaccccgtaaacctaaccgtttaccggtttaaccctttaccctttaaccgtaaaaaaacgtttcggaaaaaccccggttaacggtacccccggtttagggggaaacccggggggtacccgggaaaaccgggggaaaccccggaaaccccgggggtttacccccggtttaaacccgtttaaacggtttttaaacgttcggggttttacgggttacgggttaaaagggtttaaaccggggttttttaaacgtagggggtaaccggttaaacggttcgggggttaccggttaagggggtttaacgggaaacccggttaaaagggggtaacctttaaccggggtaacccgggtttaaccggggggaacccccgggttaaaacccccgggggg

SEQ ID NO: 320716 - DNA, 684 bp, Homo sapiens
  misc_feature: GZ8MTXP02JBT4L.19.67.G01.1.454.CMB.2.raw
  modified_base (191)..(191): a, c, t, g, unknown or other
  misc_feature (191)..(191): n is a, c, g, or t
  modified_base (324)..(324): a, c, t, g, unknown or other
  misc_feature (324)..(324): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttcctgctgcaatttcaggaggtgtccagtgtgaggtncaacgtggtggagacgtgggcggaggcttggtccaggcctggggcggtctctgagactgtcctgtcgaaccctcgtggggtctccgtcagcagcgactgtattgccgtggtccgccgaggctccgagggaagnggcggaggtgggtcgcgtaggttatttttagtagggtgggaccgacgtattacgtacggagacttaccagtgggaggggacccgtaaattccgacctatcctaccaagtacgtacttttccgtacaagaaaccacacttacgttcttaccttacaaagttacgaaacgacgtcccgtagggaaccggggtccgaaaggggaccgtaaccggggtcccgttacttaacgtttaagtttggtacggttaggtaggttaaggttttaaggtacggtaccggtagttacgggccggtttaggggttaacgggaacgtaagtacgtccgggaacggttacgggggacccggttaaaacccggggg

SEQ ID NO: 320717 - DNA, 602 bp, Homo sapiens
  misc_feature: GZ8MTXP02FLRFM.19.67.G01.1.454.CMB.2.raw
  modified_base (302)..(302): a, c, t, g, unknown or other
  misc_feature (302)..(302): n is a, c, g, or t
  modified_base (330)..(330): a, c, t, g, unknown or other
  misc_feature (330)..(330): n is a, c, g, or t
  modified_base (365)..(365): a, c, t, g, unknown or other
  misc_feature (365)..(365): n is a, c, g, or t
  modified_base (535)..(535): a, c, t, g, unknown or other
  misc_feature (535)..(535): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttcctgctgcaatttcaggaggtgtccagtgtgaggtgcaacgtggtggagacgtgggcggaggcttggtccaggccgtgggcggtctctgaggctgtcctgtcgaccctcgtggggtctccgtcagcagcgactgtatgcctggccncaggctcgaggagaggccggagtgggcngaggttatttagaggtggaccatagtcgtacgganacctcgagtgggaggccgtattccactatctcccagtacgttaccttttcacgaacgtaaaccactactgttcctacttacaaaatcgaaacagccgtagggacgggtacgacgggacaccgggtccgttattattagtttggtaggtcgtaaggttagttttaacgggngggtacgtaggtcgggacgttaggggaacgacgacgtacgtacgtacggggacggggaccgaacggg

SEQ ID NO: 320718 - DNA, 635 bp, Homo sapiens
  misc_feature: GZ8MTXP02FHJVL.19.67.G01.1.454.CMB.2.raw
  modified_base (308)..(308): a, c, t, g, unknown or other
  misc_feature (308)..(308): n is a, c, g, or t
  modified_base (327)..(327): a, c, t, g, unknown or other
  misc_feature (327)..(327): n is a, c, g, or t
  modified_base (547)..(547): a, c, t, g, unknown or other
  misc_feature (547)..(547): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtgggtggagacgtgggcggaggcttggtccagccgtggggcggtctcgtgagactgtcctgtcgaccctgtggggtctccgtcagcagcgactgtattgccgtgggtccncaggcctccgaggggaagngggccggaggtcgggcgcgtaaggttattttagagggtggaccactattacacggaagacctcgagtcggggacggccgtaattccacctatcctacccgagtacgttaccttttcacgtaacgaaacaccacttcgttccttaccttacaaaacgtcgaaactcgcccgtagggacggggaccgacggtaccgacggggtccttacttagttagttggnggtagtagtagttttagcgggtacgtagtcggtcgttagggaagtaacgagtacgtaccggtacggacgggggtacccaaaccggggg

SEQ ID NO: 320719 - DNA, 719 bp, Homo sapiens
  misc_feature: GZ8MTXP02IWJC3.19.67.G01.1.454.CMB.2.raw
  modified_base (89)..(89): a, c, t, g, unknown or other
  misc_feature (89)..(89): n is a, c, g, or t
  modified_base (217)..(217): a, c, t, g, unknown or other
  misc_feature (217)..(217): n is a, c, g, or t
  modified_base (318)..(318): a, c, t, g, unknown or other
  misc_feature (318)..(318): n is a, c, g, or t
  modified_base (429)..(429): a, c, t, g, unknown or other
  misc_feature (429)..(429): n is a, c, g, or t
tcagtactctcgtgcacgaccggtgctcgatttagagtatacatattggggtttggggggtagctcaggaagcagagcctggagcatcnccactatggcctgggctccactacttctcaccctcctcgctcactgcacaggttcttgggcctaactttatgctgactcacgccccactctgtcgtcggacgtcggtacggggaacgacggtaacctntctttgaccaccacaacagtgaacactagtccacgtcgattttagttggtcacgtaggtacgtacgacgacgcggccgggtcccgacgtaccccgtacccnctagttcgtagtctactagtaggacgtaaataacgtaacgaaccggctaacggggttccccttaggggtcctcggttactcgttcggaccttcgactccgcacttccaccncctaccttcctacctccctcctctccctcttccgtacctagtactacgacggtacgaggaacgtacggacggacgtacgacgttactacgttacgtcgttacggaattacgtacggtacttaggtccgtacgggttcgtacggttcggttcggggtaacgtttcgggggtaccgggttaacggggtacccggtacggggaccgttaccgaacccgggttcccgtaacggggtcccgtaacgggtccccggaacgggttacccgcccgggttaccccgtaccggttccccg

SEQ ID NO: 320720 - DNA, 667 bp, Homo sapiens
  misc_feature: GZ8MTXP02IBXE5.19.67.G01.1.454.CMB.2.raw
  modified_base (198)..(198): a, c, t, g, unknown or other
  misc_feature (198)..(198): n is a, c, g, or t
  modified_base (291)..(291): a, c, t, g, unknown or other
  misc_feature (291)..(291): n is a, c, g, or t
  modified_base (337)..(337): a, c, t, g, unknown or other
  misc_feature (337)..(337): n is a, c, g, or t
  modified_base (354)..(354): a, c, t, g, unknown or other
  misc_feature (354)..(354): n is a, c, g, or t
  modified_base (464)..(464): a, c, t, g, unknown or other
  misc_feature (464)..(464): n is a, c, g, or t
  modified_base (497)..(497): a, c, t, g, unknown or other
  misc_feature (497)..(497): n is a, c, g, or t
tcagtactctcgtgcacgaccggtgctcgatttagagtatacatattgggtttgggggtctgggagaggagcccagcactgggattccgaggtgtttccattcggtgctcagcactgaacacagaggactcaccatggagttttggctgaccttgggttttcctgctgcaatttcaggaggtgtccagtggtgaggtncaacgtgggtggagacgtggggcggaggtcttgggtccaggccgtggggcggtctctggagtctgtcctgtcgaacctgtggggtctccggtnagctagcgactgtatcgccgtggtccgcaggcctacgaggggaagngggcgggaggtcgggcncgtaggttatttttagaggggtgggaactacatttacgacggggaatcctcgtaaagtcggggaacggggcctataccaacacgttcccacgaaggtacttccttttacncaaagaacctactacttcgtactacctttaaanaaactacgaacgacgtcgtagggaccgggaccgaacggacccgtacggtccgttacgttaagttacgttaggtagtaggtacgttaaacggtttacggtacggtacgtaaggtcgggtaacggttgggtaacggtaacgtaggtaacgttaccggaacggggtccggggg

SEQ ID NO: 320721 - DNA, 693 bp, Homo sapiens
  misc_feature: GZ8MTXP02FM9FQ.19.67.G01.1.454.CMB.2.raw
  modified_base (374)..(374): a, c, t, g, unknown or other
  misc_feature (374)..(374): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggtttcttgctgcaatttcaggaggtgtccagtgtgaggtgcaactggtggagactggcggaggcttggtccagcctgggcgtctctgagactgtcctgtgaaccctcgtggggtctccgtcagcagcgactgtatgcctggtccgcaggctccgagggaagaggccggagtgggtcgcgtaggttattttagtagggtgggaccgacattctacggagactcgngtgggagggccgtaattccaccgattctccgagtaacgtacttttcgacaacgtaaacactacttcgtaccttaccttactaaaagttcgaaaacgacgtaccgttacgggaacgggggacccggaaacgggaacccgaaccgggcccccggtttaacttaacgtttaagtttgggtacggtttacgggaaaaggttagggtttttaacgtggggtaccggtaaacggttgggggtccgttagggggttaaggggaaacctaagggggtacttaaccgggtaaccggtttacggggggaaccccggtaaaacccggggg

SEQ ID NO: 320722 - DNA, 631 bp, Homo sapiens
  misc_feature: GZ8MTXP02FZCOQ.19.67.G01.1.454.CMB.2.raw
  modified_base (252)..(252): a, c, t, g, unknown or other
  misc_feature (252)..(252): n is a, c, g, or t
  modified_base (278)..(278): a, c, t, g, unknown or other
  misc_feature (278)..(278): n is a, c, g, or t
  modified_base (288)..(288): a, c, t, g, unknown or other
  misc_feature (288)..(288): n is a, c, g, or t
  modified_base (291)..(291): a, c, t, g, unknown or other
  misc_feature (291)..(291): n is a, c, g, or t
  modified_base (305)..(305): a, c, t, g, unknown or other
  misc_feature (305)..(305): n is a, c, g, or t
  modified_base (490)..(490): a, c, t, g, unknown or other
  misc_feature (490)..(490): n is a, c, g, or t
  modified_base (498)..(498): a, c, t, g, unknown or other
  misc_feature (498)..(498): n is a, c, g, or t
tcagtactctcgtgcacgaccggtgctcgatttagagtatacatattgggtttggggggtagctcaggaagcagagcctggagcatctccactatggcctgggctccactacttctcaccctcctcgctcactgcacaggttcttgggccaactttatgctgactcacgcccactctgtgtcggagtcgtcggggaagacggtaaccatctttgcacccacaacagtggacaacattgccagctaattttgngcagtcggtaccagcagcgccgggcncgtccccacntgnatctatgagataanacgaaacgaccgtgtcgggtccctgtacttcggtctcgtcggccctactacgtaccgacgaccgtccttccctaccaaacccttcctccgtccccttacccctcctaaccctaattcccgttcgaacggtaccgttaggaaacgtacgagggacggaacgtcggctacgtacttactacttacgngtacgttnttaaagtcggaagttccggccggtacgggttgtaggttcggttcgggtcggttacggggacggtaacggaacgacgtccgtacggtaccgtacggtaacgtacgaaccggacgtaccgccgtcccgcccgtcg

SEQ ID NO: 320723 - DNA, 601 bp, Homo sapiens
  misc_feature: GZ8MTXP02ITFK4.19.67.G01.1.454.CMB.2.raw
  modified_base (243)..(243): a, c, t, g, unknown or other
  misc_feature (243)..(243): n is a, c, g, or t
  modified_base (303)..(303): a, c, t, g, unknown or other
  misc_feature (303)..(303): n is a, c, g, or t
  modified_base (319)..(319): a, c, t, g, unknown or other
  misc_feature (319)..(319): n is a, c, g, or t
  modified_base (335)..(335): a, c, t, g, unknown or other
  misc_feature (335)..(335): n is a, c, g, or t
  modified_base (372)..(372): a, c, t, g, unknown or other
  misc_feature (372)..(372): n is a, c, g, or t
  modified_base (379)..(379): a, c, t, g, unknown or other
  misc_feature (379)..(379): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtgggcggaggcttggtccagccgtggggcggtctcngagactgtcctgtcgaaccctgtggggtctccgtcagcagcgactgtatgcctgggtccncaggctccgagggagnggccggagtgggtcgntaggttattttagagggtggaccactattcgacgganaccttcngtgggacgggccgattccaacctatcctccgagtagttacttttcgctaaagacacctgttacgtctactacaaattacgaaacaacgtcctaggacggggccgacggacgacggtccgtacttagttagttgtgttaggagttaggtttacgtagggcgtagtcggtcgtggggttaacgaacgaggtactcggtacggtcgggggaccgtaaacccgggg

SEQ ID NO: 320724 - DNA, 614 bp, Homo sapiens
  misc_feature: GZ8MTXP02GN85A.19.67.G01.1.454.CMB.2.raw
  modified_base (365)..(365): a, c, t, g, unknown or other
  misc_feature (365)..(365): n is a, c, g, or t
  modified_base (576)..(576): a, c, t, g, unknown or other
  misc_feature (576)..(576): n is a, c, g, or t
  modified_base (584)..(584): a, c, t, g, unknown or other
  misc_feature (584)..(584): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtgggcgggaggcgttggtccaggccgtgggcggtctctgagctgtctgtcgaccctcgtgggtctccgtcagcagcgactgtattgccgtcggtccgcacggctccgaaggggaggacggccgggagtcgggtcgacgtaggttatttttagngggtaggacgactagttcgtaacggacgtactccgagtgggacggccgtattacgacctagtctacccgagtacgtactttctacacgtaacactacgtcgttacctacttacaaaagttacaaacgacgccgtagggaccgggacccggaggacccgacggtcccgtagttagtttagtcggttgagtaggttaagtttagcgggtacgngttacggngtgggacgtgacgactcggacggtacgggg

SEQ ID NO: 320725 - DNA, 611 bp, Homo sapiens
  misc_feature: GZ8MTXP02HHOJ1.19.67.G01.1.454.CMB.2.raw
  modified_base (552)..(552): a, c, t, g, unknown or other
  misc_feature (552)..(552): n is a, c, g, or t
  modified_base (568)..(568): a, c, t, g, unknown or other
  misc_feature (568)..(568): n is a, c, g, or t
  modified_base (572)..(572): a, c, t, g, unknown or other
  misc_feature (572)..(572): n is a, c, g, or t
  modified_base (577)..(577): a, c, t, g, unknown or other
  misc_feature (577)..(577): n is a, c, g, or t
  modified_base (582)..(582): a, c, t, g, unknown or other
  misc_feature (582)..(582): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtggcggaggcttggtccagccgtgggcggtctctgacgactgtcctgtcgaaccctcgtggggtctccgtcagcagcgactgtacttgccgtgggtcccgccgaggcctaccgaaggggaagacgggccggaggtggggtcgcgtagggttactttttagaggggttaggaccgatagttccgtaacgggagtacctccaggtgggaacggggtccgtattccgaaccgtaaatcccgtaccaagtacggttacctttctacgaagaaccctacgtactcgttaccttactaccaaatcgaaacaggtcctaggacgggccgagtaccgacgcgtactattagtngtagagtagtttaggngcgngtcgngtagngacgacgtacgacgcggtcgggacgacgg

SEQ ID NO: 320726 - DNA, 745 bp, Homo sapiens
  misc_feature: GZ8MTXP02JPUGX.19.67.G01.1.454.CMB.2.raw
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagccgtgggcggtctctgagactgtcctgtgaaccctcgtggggtctccgtcagcagcgactgtattcgcctgggtccgccgaggctccgagggaagaggctggaggtgggtcgcgtaggttatttttagtaggtcgggacgacagtttctacggagacctccgagtcggggacggggccgtaattccgaacccacgttacctacccgaaaggtacgtaaccttttttaccgtaccgtaaacgaaaccctactaaccgtttagttacccttactttaaccaaaagtttacggaaaacctacggtacccgttaggggaaccgggggacccggaaacggggaacccgtaacccggggtaccccggtttaccttaaacgttttaagttcgggtttacggttaggtaagggtttaaacggttttaagttcgggggtacggttaaggttccggggacgttgggggttaaacgggaaccgtaagggtacgtttaccggaaccgggtttacggggggtaacccccggg

SEQ ID NO: 320727 - DNA, 574 bp, Homo sapiens
  misc_feature: GZ8MTXP02IYQ9E.19.67.G01.1.454.CMB.2.raw
  modified_base (323)..(323): a, c, t, g, unknown or other
  misc_feature (323)..(323): n is a, c, g, or t
  modified_base (380)..(380): a, c, t, g, unknown or other
  misc_feature (380)..(380): n is a, c, g, or t
  modified_base (522)..(522): a, c, t, g, unknown or other
  misc_feature (522)..(522): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagccgtgggcggtctctgagactgtcctgtcgaaccctgtggggtctccgtcagcagcgactgtattgccgtggtccgccaggctccgaaggggaacgnggccggagtgggtcgactaggttatttttagagggtggaccgactattcgaacgganacctcagtgggacgggcctattccactatcctaccgagtacgtactttcacaagaacacactgtctactacaaatcgaaacagtcctaggacgggaccgacggaccgtacggccgtattattagtgtgtagagttagttagnggacgtagtcggcgtggtcggaacagtacgtacgacggtcgggaccgtacgg

SEQ ID NO: 320728 - DNA, 661 bp, Homo sapiens
  misc_feature: GZ8MTXP02F1CAP.19.67.G01.1.454.CMB.2.raw
  modified_base (276)..(276): a, c, t, g, unknown or other
  misc_feature (276)..(276): n is a, c, g, or t
  modified_base (608)..(608): a, c, t, g, unknown or other
  misc_feature (608)..(608): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttcctgctgcaatttcaggaggtgtccagtgtgaggtgcaacgtggtggagactgggcggaggcttggtccaggccgtggggcggtctctgagctgtcctgtcgaaccctgtgggtctccgtnagcagcgactgtattcgccgtgggtccgccgaggctaccgaggggaagacgggccggaggtggggtcgcgtaggtttattttagaggggtggaccgactagttcgaacggactaccgtcgaggtgggacggggtacccgtatttccaacgtactcctacccgaagtacgttaccttttacacgaaacgtaaccactaacttcgttaccttaccttacaaaagttacgaaacgtacgacgtaggaccggggaccgaacggtaccgaaccgggtccgttagttaacgttagttggtagttaggtaagttaggtttagtcgggtagtagtcgggngtttaggggaacgacgaggtacgtacgaacggtcgggggaccgtaaaccgggg

SEQ ID NO: 320729 - DNA, 546 bp, Homo sapiens
  misc_feature: GZ8MTXP02FRC61.19.67.G01.1.454.CMB.2.raw
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttcctgctgcaatttcaggagtgtccagtgtgaggtgcaactgggtgagactgggcggaggcttggtccaggccgtggggcgtctctgagactgtcctgtgaaccctctggggtctccgtcagcagcgactgtatgccgtggtccgccaggctccgagggagaggccgggagtggggtcgcgtaggtatttttagtacggtgggacgacagttctacggagacctcagtggaggccgattcacatctaccagacgtactttctacacgaacacactgtctacttacaaatgaacagcctagacgggcgaggacgacggccgtatacttatgtgtgagtagtttagtggcgtagtggcgtgggtagacgagtactacgacgtaccggggg

SEQ ID NO: 320730 - DNA, 698 bp, Homo sapiens
  misc_feature: GZ8MTXP02JNX1T.19.67.G01.1.454.CMB.2.raw
  modified_base (340)..(340): a, c, t, g, unknown or other
  misc_feature (340)..(340): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtgggcggaggcttggtccagcctgggcgtctctgagtctgtcctgtcgaaccctcgtgggtctcgtcagcagcgactgtatcgcctgggtccgccaggctccgagggaaggcggccggaggtggtcgngtaggttattttagtagggtgggacgtactagtttacgacggtacgacgtcccgagtcggggaacgggcccgtaagtttccaacctacttccgtacccgagtaacgttcttttaccacgtaacgaaacaaccgtaacttcgtaccttacttaaccgtaaagttacgaaccaacggtaccgtacgggaacggggcccggaaaccgggaccgtaccgggttaccccgttaacgtttacgtttaacgtttcggttagtagggttaaacgttaaaggttttaccgtcggggtaacgtaggttcgggtaagtttaccggggtacggtaacgaggtaaaccgttcccggtaaaggtcccggggg

SEQ ID NO: 320731 - DNA, 750 bp, Homo sapiens
  misc_feature: GZ8MTXP02HMD0J.19.67.G01.1.454.CMB.2.raw
  modified_base (462)..(462): a, c, t, g, unknown or other
  misc_feature (462)..(462): n is a, c, g, or t
  modified_base (491)..(491): a, c, t, g, unknown or other
  misc_feature (491)..(491): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggtagttttggctgaccttgggttttccttgctgcaatttcgaggaggtgtccagtgtgaggtgcaacgtggtggagacgtgggacggaggtcttgggtccaggtcccgtggggtccggttctcgtggaacgtactcgttcccgtggtaccgtaaccccgttcggttcgggggtcccttcccggtacacggtcaggccgtacgtgttattcggcccgttcgggtccccgccgacgggtcctacccggaaggggaacgacggggccggtaggtcggggtccgagtaggtttattttaggagggtggaccgactagttacacggataccgtcnggtacgggacggcctacttaccaaccgtntaccctaccgtaacgtaacgttacttttccacaacgtaaaccacgtaacttcgttacctacttaacaaaattacgaaacgtacgtaccgtacggggacgggaccgaaacggaccgtaccgggtacccttacgttaagtttacgttaggtagttacgggtaaagttagttttaaacgggcgggtacgtcggttcggtaggttacgggaacggtacgtaaggtacgtacggtaccggggtaccggggaaccgtaaccgggg

SEQ ID NO: 320732 - DNA, 580 bp, Homo sapiens
  misc_feature: GZ8MTXP02F8EYQ.19.67.G01.1.454.CMB.2.raw
  modified_base (367)..(367): a, c, t, g, unknown or other
  misc_feature (367)..(367): n is a, c, g, or t
  modified_base (379)..(379): a, c, t, g, unknown or other
  misc_feature (379)..(379): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagtttggctgacctgggttttcctgctgcaatttcaggaggtgtccagtgtgaggtgcaacgtgggtggagacgtgggcggaggcttgggtccagccgtggggcggtctctgagactgtcctgtcgaccctcgtggggtctccgtcagcagcgactgtatgcctgggtccgcaggctccgaggggagaggccgggaggtgggtcgcgaggttattttagaggtgggacanattcgtacgganctccagtgggacggcgtatcacatctccagagtcttttcgacagaacactactgtccttacttaccaaaatacgaaacacgtaccgtaggaaccgggccggaacggaccgaaccggtccgtactagttaagttggtgtaggtagtagtttacgtggtacgagttggcgtgggtaggacaggtaactcgacggtaccggggg

SEQ ID NO: 320733 - DNA, 622 bp, Homo sapiens
  misc_feature: GZ8MTXP02I3JX9.19.67.G01.1.454.CMB.2.raw
  modified_base (305)..(305): a, c, t, g, unknown or other
  misc_feature (305)..(305): n is a, c, g, or t
  modified_base (326)..(326): a, c, t, g, unknown or other
  misc_feature (326)..(326): n is a, c, g, or t
  modified_base (395)..(395): a, c, t, g, unknown or other
  misc_feature (395)..(395): n is a, c, g, or t
  modified_base (479)..(479): a, c, t, g, unknown or other
  misc_feature (479)..(479): n is a, c, g, or t
  modified_base (563)..(563): a, c, t, g, unknown or other
  misc_feature (563)..(563): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttcctgctgcaattcaggaggtgtccagtgtgaggtgcaactgggtggagactgggcggaggcttggtccagcccgtggggcggtctcgtgagcctgtcctgtcgaaccctgtggggtctccgtcagcagcgactgtatgccgtgggtccncaggcctccgaaggggaacgnggccgggaggtcggggtcgcgtaggtttatttttaggagggtggaaccgtatagttcgaacggataccncagtgggaacgggcctagttccaacctatcctaccgagtacgttaccttttacaccaaagaaccactacgttagtcctacttanaaaatcgaaacagtccgagggacggggaccgaagggacaccgggtcgttacttagttacgttgtagtaggtagtaggtttacgnggtacgtaggtgtcgtagggtcggatagtacgtacgacggtcggggacctaaaccgggg

SEQ ID NO: 320734 - DNA, 652 bp, Homo sapiens
  misc_feature: GZ8MTXP02FUJEC.19.67.G01.1.454.CMB.2.raw
  modified_base (429)..(429): a, c, t, g, unknown or other
  misc_feature (429)..(429): n is a, c, g, or t
  modified_base (570)..(570): a, c, t, g, unknown or other
  misc_feature (570)..(570): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttcctgctgcaatttcaggaggtgtccagtgtgaggtgcaactggtgagactggcggaggcttggtccagcctgggcggtctctgagactgtcctgtgaaccctctggggtctccgtcagcagcgactgtattgcctgggtccgccaggctaccgaggggaagaggccggaggtggggtcgcgaggtttatttagtagggtggggaccgactattctacggagacctccatcggggaagggccgattccaccaatcctccagagtacctttttcncaacgaaacaaccactagttctacctttacaaaaacttcgaaaacacgccctagggaacgggggaccgaacgggaaccgtaacccggggtcccgttctaaagttaatttggtaggtacggtaaaggtagtttttaaacggnggggtacgtaacggttcgggacgtagggggtaacggaaacgtaaggtactacgtaccggtaccgggggacccggaaccgggg

SEQ ID NO: 320735 - DNA, 547 bp, Homo sapiens
  misc_feature: GZ8MTXP02IBL75.19.67.G01.1.454.CMB.2.raw
  modified_base (434)..(434): a, c, t, g, unknown or other
  misc_feature (434)..(434): n is a, c, g, or t
  modified_base (487)..(487): a, c, t, g, unknown or other
  misc_feature (487)..(487): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagccgtgggcggtctctgagactgtcctgtgaccctctgggtctccgtcagcagcgactgtatgcctggtccgcaggctccgagggagaggccgggaggtgggtcgcagggttatttttagagggtggggacgacattctacggagctccagtgggaggggcccgattccaccacgtctcccagacgtacttttctacagaacacnctgtctcttacaaatagaacagctaggacggccgaggcgacggccgtctattnttgtgtgagtagtttaatggcgtagtgaacgttggaggtacaggactcgacgtacggggg

SEQ ID NO: 320736 - DNA, 543 bp, Homo sapiens
  misc_feature: GZ8MTXP02I9VLF.19.67.G01.1.454.CMB.2.raw
  modified_base (258)..(258): a, c, t, g, unknown or other
  misc_feature (258)..(258): n is a, c, g, or t
  modified_base (308)..(308): a, c, t, g, unknown or other
  misc_feature (308)..(308): n is a, c, g, or t
  modified_base (323)..(323): a, c, t, g, unknown or other
  misc_feature (323)..(323): n is a, c, g, or t
  modified_base (351)..(351): a, c, t, g, unknown or other
  misc_feature (351)..(351): n is a, c, g, or t
  modified_base (479)..(479): a, c, t, g, unknown or other
  misc_feature (479)..(479): n is a, c, g, or t
  modified_base (486)..(486): a, c, t, g, unknown or other
  misc_feature (486)..(486): n is a, c, g, or t
  modified_base (499)..(499): a, c, t, g, unknown or other
  misc_feature (499)..(499): n is a, c, g, or t
  modified_base (510)..(510): a, c, t, g, unknown or other
  misc_feature (510)..(510): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagctgtcctgtgaccctntgggtctcgtcagcagcgactgtatgcagtgggccacaggctcgaggagnggccggagtgggtcncgtaggttatttttagaggtcggacganattccgtacggagactccgaagtgggaacggggcctattccaacctacttcctaccaaggtacgttaccttttcaccaagaaccactactgtactcttacaaatgaactgctggaacggccgaggacncgggctnttatactgtagtnagtagttacgnggcgatggcgtggtgacagatcacgtgggaccg

SEQ ID NO: 320737 - DNA, 567 bp, Homo sapiens
  misc_feature: GZ8MTXP02FNSP2.19.67.G01.1.454.CMB.2.raw
  modified_base (325)..(325): a, c, t, g, unknown or other
  misc_feature (325)..(325): n is a, c, g, or t
  modified_base (358)..(358): a, c, t, g, unknown or other
  misc_feature (358)..(358): n is a, c, g, or t
  modified_base (525)..(525): a, c, t, g, unknown or other
  misc_feature (525)..(525): n is a, c, g, or t
  modified_base (537)..(537): a, c, t, g, unknown or other
  misc_feature (537)..(537): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagactgggcggaggcttgggtccaggcctgggcggtctctgagactgtcctgtcgaaccctcgtggggtctccgtcagcagcgactgtattgcgtggtccgcgagctccgagggaagnggccggaggtcgggtcgcgaggttagtttttanaggttgggacgtacattcgtacggagctccgagtgggaggccagttccacaatcctccaagtacgtacttttcacagaaactacatcgtctacttacaaatcgaacagacctaggacgggccgaacggacgacggtccgtactattagtgtgtcgtagttagttacnggacgagtcggngttggaggactagacttcgaacggtcgggg

SEQ ID NO: 320738 - DNA, 741 bp, Homo sapiens
  misc_feature: GZ8MTXP02FW9P9.19.67.G01.1.454.CMB.2.raw
  modified_base (281)..(281): a, c, t, g, unknown or other
  misc_feature (281)..(281): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactgggtggagacgtgggcggaggcttggtccagccgtgggcggtctcgtgagactgtcctgtcgaaccctcgtgggtcctccgtnagcagcgactgtatcgccgtgggtccgccgaggccgtaccgaaggggaacggacgggccgggaggtcgggtcgacgtaggtttatttttaggaggggtggacccgtactagttacgtacggagtacctccgtaggtcggggaacggggtccgtacgttacccaaccgtacttcctaccgaagttacgttaccctttttactaaccgaaagtaaacctacctaacttcgttaccttacctttaacgaaaaacgttcgaaacgtaccggtaccgttagggaaccgggggacccgaaacgggtacccgtaacccgggggtacctttaacgttaacgtttaagttcggggtagtttaacgggtaagtttagggtttaaagttcggggtacgttaggttcgggtcgttaggggtaacggaacgtaacgtacgaccggtaaccggtcgggggtaacccgaacgggg

SEQ ID NO: 320739 - DNA, 553 bp, Homo sapiens
  misc_feature: GZ8MTXP02JRYLA.19.67.G01.1.454.CMB.2.raw
  modified_base (307)..(307): a, c, t, g, unknown or other
  misc_feature (307)..(307): n is a, c, g, or t
  modified_base (438)..(438): a, c, t, g, unknown or other
  misc_feature (438)..(438): n is a, c, g, or t
tcagtactctcgtgcacgaccggtgctcgatttagagtatacatattgggtttgggggtagctcaggaagcagagcctggagcatctccactatggcctgggctccactacttctcaccctcctcgctcactgcacaggttcttgggccaactttatgctgactcagccccactctgtgtcggagtctccggggaagacggtaaccatctttgcacccacaacagtggcaacattgccagctaattttgtgcagtggtaccagcagcgcccgggcacgttcccccacatgtgatctatgaggataancaaagaccgtcgtggggtccctgatcggttctcgtcggcctccatcgacacgctcctccaaactctcgccctccctcacccatctctgactgaagctgaggacgaggtcagactactatgtcagttcttangattacgccgacggtctagtggtcggttcgttcggggacgggacgggtaaccacggtccgtcgacccggtccgtaaggccacggacccgtaaggccctccggacccccgtttcgg

SEQ ID NO: 320740 - DNA, 649 bp, Homo sapiens
  misc_feature: GZ8MTXP02FXBKY.19.67.G01.1.454.CMB.2.raw
  modified_base (309)..(309): a, c, t, g, unknown or other
  misc_feature (309)..(309): n is a, c, g, or t
  modified_base (394)..(394): a, c, t, g, unknown or other
  misc_feature (394)..(394): n is a, c, g, or t
  modified_base (427)..(427): a, c, t, g, unknown or other
  misc_feature (427)..(427): n is a, c, g, or t
  modified_base (569)..(569): a, c, t, g, unknown or other
  misc_feature (569)..(569): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttcctgctgcaatttcaggaggtgtccagtgtgaggtgcaagtgggtggagacgtgggcggaggtcttgggtccaggccgtggggcgtctcgtgagactgtcctgtcgacccgtcgtgggtctccgtcagcagcgactgtatgccgtgggtcccncgaggctccgaaggggaagcgggccgggaggtcggggtcgcgtaggtttagttttagaggggtgggaccgactagttcgacgganacctcgagtgggacgggcctacttccgaacctntcctacagtacgttacttttcacaacgaactacctactacgttctacttaacaaatacgaaactacggccgtagggacggggtacccgacggaccgacggtccgttacttagttagttggtagtaggtaagttaggtttagngggtactagggttgggcggttggggtaaggaacgtaaggtacgtaccggacgggtacgggggacccggtaaacccggggg

SEQ ID NO: 320741 - DNA, 619 bp, Homo sapiens
  misc_feature: GZ8MTXP02I7TW1.19.67.G01.1.454.CMB.2.raw
  modified_base (257)..(257): a, c, t, g, unknown or other
  misc_feature (257)..(257): n is a, c, g, or t
  modified_base (430)..(430): a, c, t, g, unknown or other
  misc_feature (430)..(430): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttcctgctgcaatttcaggagtgtccagtgtgaggtgcaactggtggagactggcggagcttggtccagcctgggcgtctctgagactgtcctgtcgaaccctntgggtctcgtcagcagcgactgtacttgcctggtcccgccaggctccgaaggggaacgaggccggagtcggggtcgcgtaggttatttttagagggtggaccgactagttctacgggatacctccagtgggagggccgtaacttccacgtactctaccgagtagtacttttcncgtaagaacaccactgttacctacttaccaaaattcgaaacacggtaccttgggaacggggacccgaacggaccgaacgggtcccgtacgttattaagttgtggtcgtaagttaggtttacgtagggtcgtaagtgggaccgtggtaacgggaacgacgtagtcgaacggtcggggacctaaaccgggg

SEQ ID NO: 320742 - DNA, 657 bp, Homo sapiens
  misc_feature: GZ8MTXP02H4KRI.19.67.G01.1.454.CMB.2.raw
  modified_base (248)..(248): a, c, t, g, unknown or other
  misc_feature (248)..(248): n is a, c, g, or t
  modified_base (259)..(259): a, c, t, g, unknown or other
  misc_feature (259)..(259): n is a, c, g, or t
  modified_base (306)..(306): a, c, t, g, unknown or other
  misc_feature (306)..(306): n is a, c, g, or t
tcagtactctcgtgcacgaccggtgctcgatttagagtatacatattggggtttgggggagctacaacaggcaggcaggggcagcaagatggtgttgcagacccaggtcttcatttctctgttgctctggatctctggttcctggcggggacatcgtgatcgacccagtacccagactcactggctgtgtctcgtgggcgagaccggccaacaatcaactgcacggtccagaccagaactattttccnccacctacaanaaacaaacttctagcctagacaacagacacagacacgcctactagtnctactagtttacgtcggtcttcgtacggcgtacgtaacgttccggggcctggaccccgtggttcccggggcacggggtccgggttcgtagggctagtactttccgactctaccactatcacgctacgcccgtgaccgtaggtcgtaggaacgtagtcggtacggtacttaagttttacttacgtaggtacctaagtaccttaaattttacgttttacttacgtccggtttacgggcggttacccggttacgggacccgtaaaacgggggtacgtaacgggggtaaacgaaacgttcgaaacggtaacgtaacggttcggtacggtacgtcggacctaccgtacgtttctcg

SEQ ID NO: 320743 - DNA, 574 bp, Homo sapiens
  misc_feature: GZ8MTXP02H062C.19.67.G01.1.454.CMB.2.raw
  modified_base (231)..(231): a, c, t, g, unknown or other
  misc_feature (231)..(231): n is a, c, g, or t
  modified_base (254)..(254): a, c, t, g, unknown or other
  misc_feature (254)..(254): n is a, c, g, or t
  modified_base (389)..(389): a, c, t, g, unknown or other
  misc_feature (389)..(389): n is a, c, g, or t
  modified_base (441)..(441): a, c, t, g, unknown or other
  misc_feature (441)..(441): n is a, c, g, or t
  modified_base (451)..(451): a, c, t, g, unknown or other
  misc_feature (451)..(451): n is a, c, g, or t
  modified_base (459)..(459): a, c, t, g, unknown or other
  misc_feature (459)..(459): n is a, c, g, or t
  modified_base (467)..(467): a, c, t, g, unknown or other
  misc_feature (467)..(467): n is a, c, g, or t
  modified_base (472)..(472): a, c, t, g, unknown or other
  misc_feature (472)..(472): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggtttcctgctgcattcaggaggtgtccagtgtgaggtgcaactggtggagactggcggaggcttggtccagcctgggcgtntctgagctgtcctgtcgaccctntggggtctccgtcagcagcgactgtatcgcctgggcccgccaggtctaccgaggggaagagggcccaaggcggtggggtcgacgtagggtttattttttaagaggggttcgggaccgactagttctaacgggganacctccgaatcggggaggggccattcacctatcctaccagaagtcttttacnctaagaaacncaccgttntactctanaatanacgacgcgagacggacgacgacgacgcgtcgtagtagttgtgtgtagtagttagtacgcgacgtgtcgtggtagacgtacgacgtacgtacggtacggacgg

SEQ ID NO: 320744 - DNA, 694 bp, Homo sapiens
  misc_feature: GZ8MTXP02I5VFL.19.67.G01.1.454.CMB.2.raw
  modified_base (264)..(264): a, c, t, g, unknown or other
  misc_feature (264)..(264): n is a, c, g, or t
  modified_base (313)..(313): a, c, t, g, unknown or other
  misc_feature (313)..(313): n is a, c, g, or t
  modified_base (317)..(317): a, c, t, g, unknown or other
  misc_feature (317)..(317): n is a, c, g, or t
  modified_base (334)..(334): a, c, t, g, unknown or other
  misc_feature (334)..(334): n is a, c, g, or t
  modified_base (408)..(408): a, c, t, g, unknown or other
  misc_feature (408)..(408): n is a, c, g, or t
tcagtactctcgtgcacgaccggtgctcgatttagagtatacatattgggtttggggggtagctcaggaagcagagcctggagcatctccactatggcctgggctccactacttctcaccctcctcgctcactgcacaggttcttgggccaactttatgctgactcacgccccactctgtggtcggagtcgtaccggggaagacggtaaccattctttgccacccaacaacaggtggacaacattcgccagacttaagttttgngctaggtcggtacccagcacggccggcccgggcaccgttcccccaactnttgngatcagtagagaataanacaaaaggtccgtcgtcggggtccctgtacgtcgtctcgtcgctccatcgacactctccctactacctcctccnccctcccaccacctctctactggactacgaagtacgtcggaggaccgtagtactacgtaaccttaccttacgtcggttacctaggtttaccttaagtacgaacgttaccggccggtaacgggtcctttaggggtcggtttaccgggttcgggttaccgggggacggggtaaaccggggaaaccgtaaccggtccggtaacccggtacccggtttaaccgggaaccggtaaccgacccggtaacccccggaacggtccccgttaccccggcccccggtttaacccgg

SEQ ID NO: 320745 - DNA, 618 bp, Homo sapiens
  misc_feature: GZ8MTXP02FXWKC.19.67.G01.1.454.CMB.2.raw
  modified_base (301)..(301): a, c, t, g, unknown or other
  misc_feature (301)..(301): n is a, c, g, or t
  modified_base (435)..(435): a, c, t, g, unknown or other
  misc_feature (435)..(435): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttcctgctgcaatttcaggaggtgtccagtgtgaggtgcaactggtggagactggcggaggcttggtccagcctggggcggtctctgagactgtcctgtcgaaccctcgtggggtctccgtcagcagcgactgtatcgcctgggtccncaggctccagggaagaggccggaggtggggtcgcgtaggttatttttagacggttgggaccgacatttcgacgggagacttccagtgggagggccgaattccgaaccagtcctaccagtacgtacctttttacncaagtaaccacgtaaccttgtcctacttacaaacgtgaaaccagtccctggaacgggccgaaggaccgacggcccgtagttattattggtagtgtaggtagtttaacggcggtacgtacgtacggcgtagggtaacggagtacgacgtaccggtaccggtacgggggacccgtaaaccggggg

SEQ ID NO: 320746 - DNA, 594 bp, Homo sapiens
  misc_feature: GZ8MTXP02GXO6E.19.67.G01.1.454.CMB.2.raw
  modified_base (209)..(209): a, c, t, g, unknown or other
  misc_feature (209)..(209): n is a, c, g, or t
  modified_base (241)..(241): a, c, t, g, unknown or other
  misc_feature (241)..(241): n is a, c, g, or t
  modified_base (280)..(280): a, c, t, g, unknown or other
  misc_feature (280)..(280): n is a, c, g, or t
  modified_base (321)..(321): a, c, t, g, unknown or other
  misc_feature (321)..(321): n is a, c, g, or t
  modified_base (428)..(428): a, c, t, g, unknown or other
  misc_feature (428)..(428): n is a, c, g, or t
  modified_base (437)..(437): a, c, t, g, unknown or other
  misc_feature (437)..(437): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctggcggggacatcgtgatgacccagtacccagactcactggctgtgtctcgtgggcgagaccggccanaatcaactgcaggtccagccagaactatttcnccacctacaaagaaacaaaacttctagcctagaaccaanagacacaggacacgcctactaagttcgctctaatttaccgngggtcctttcgtacgcgacgtaaagttccggggtccctaggaccccgagttccggggacacggcggggtactggggactagtactttcacctcctacaaccatccanccacgtccngcgacgctagaaacgtatgtacggacttaagtttattactgtacagtataatttacttttctactccgttcgtacgggtacgttcggaacggaaacgggaccgtaggggaaccaaatccgaagtaacgaactggtcggactcgactactgtaccttg

SEQ ID NO: 320747 - DNA, 703 bp, Homo sapiens
  misc_feature: GZ8MTXP02JR7KC.19.67.G01.1.454.CMB.2.raw
  modified_base (651)..(651): a, c, t, g, unknown or other
  misc_feature (651)..(651): n is a, c, g, or t
tcagtactctcgtgcacgaccggtgctcgatttagagtatacatattggggtttgggggggagaggagcccagcactgggattccgaggtgtttccattcggtgctcagcactgaacacagaggactcaccatggagttttggctgacctgggttttccttgctgcaatttcaggagtgtccagtgtgaggtgcaaacgtggtggagactgggcggaggcttgggcccaggccgtggggcgtctcgtgagtactgtacctggtacgaaccctcgtgggtctccgtcgagcagcgactgtattcgcgtcgggtccgccaggcctaccggagggaacggaggccgggaggtcggggtcgacgtaggtttaatttttagaggggttggggaacccgtacgagtttacgaacggggtagtaccgttccaggtacggggaacggggtcccgttaattccgaacccgtacttacccgtacccgtaacggtaacggttaccctttttacgaccgttaaacgaaacctaaccgtaacgttaccggtaccttactttaacaaaaacgttcggaaaaccgacggtcccgtagggaccggggaccgaacgggaccgtaccggggtaccttacttagtttataggtgtagtagtagtttacgnggtacgcgtggtcgtggaaggactaggactcgacggtcgggaccgaaccggg

SEQ ID NO: 320748 - DNA, 588 bp, Homo sapiens
  misc_feature: GZ8MTXP02GOUDK.19.67.G01.1.454.CMB.2.raw
  modified_base (303)..(303): a, c, t, g, unknown or other
  misc_feature (303)..(303): n is a, c, g, or t
  modified_base (336)..(336): a, c, t, g, unknown or other
  misc_feature (336)..(336): n is a, c, g, or t
  modified_base (362)..(362): a, c, t, g, unknown or other
  misc_feature (362)..(362): n is a, c, g, or t
  modified_base (374)..(374): a, c, t, g, unknown or other
  misc_feature (374)..(374): n is a, c, g, or t
  modified_base (528)..(528): a, c, t, g, unknown or other
  misc_feature (528)..(528): n is a, c, g, or t
tcagtactctcgtgcacgaccggtgctcgatttagagtatacatattggggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctggggcggtctctgagactgtcctgtcgaaccctgtggggtctccgtcagcagcgactgtatgccgtgggccncaggctccgaggggaagaggccggagtgggtcncgtaggttattttagaggtggaccanattcgtacgganactcagtgggaggccgattcgacctatcctacagtacgtactttcactaaagaacacacttcgtctactacaaaatcgaaacagtccgtaggacgggccgaaggaccgacgggtcccgttatagtttagtggtagtacgtaggtagtttacggnggtacgtagtcggtcgtaggtaacgaacgagtacgtacgacggtacgggaccgtaacggg

SEQ ID NO: 320749 - DNA, 625 bp, Homo sapiens
  misc_feature: GZ8MTXP02H8EIA.19.67.G01.1.454.CMB.2.raw
  modified_base (426)..(426): a, c, t, g, unknown or other
  misc_feature (426)..(426): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttcctgctgcaatttcaggaggtgtccagtgtgaggtgcaatggtgagacgtggcggaggcttggtccaggccgtgggcggtctcgtgagactgtcctgtcgaacccgtcgtgggtctccgtcagcagcgactgtatgcctgggtccgccaggctccgaaggggaagacgggcggagtgggtcgcgtaggtattttagagggtggacctacgattcgtagagacttcagtggacggcattcacatctcagagtactttcacagaacacactntacctcttaacaaattacgaaacacgtaccgtaggaacggggaccgaacgggaaccgaccggacccggttacttaagttagttaggtaggttaggaacggtttaggttaaacgttgggaccggtaagtcgggtcgtaggggtaaggtaacgaaggtacgttacgaaccgggttacgggggacccgtaaaacccgggggg

SEQ ID NO: 320750 - DNA, 553 bp, Homo sapiens
  misc_feature: GZ8MTXP02FLIDZ.19.67.G01.1.454.CMB.2.raw
  modified_base (524)..(524): a, c, t, g, unknown or other
  misc_feature (524)..(524): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctgggcgtctctgagactgtcctgtgaaccctctggggtctccgtcagcagcgactgtatgcctggtccgcaggctccgagggaagaggcccggagtgggtcgcgaggtatttttagagggtgggacgacattcgtacggagactccagtgggagggccgattcaccgtatctacccagagtactttctacagaacactactgtcttacttacaaattcgaactacgacctggaacgggccgaggaccgacggccgtactattagttgtgtgagtagttatcggcgagtcggngtggtaggacgagtacgcgaacgtcgggg

SEQ ID NO: 320751 - DNA, 619 bp, Homo sapiens
  misc_feature: GZ8MTXP02F4XOA.19.67.G01.1.454.CMB.2.raw
  modified_base (254)..(254): a, c, t, g, unknown or other
  misc_feature (254)..(254): n is a, c, g, or t
  modified_base (288)..(288): a, c, t, g, unknown or other
  misc_feature (288)..(288): n is a, c, g, or t
  modified_base (291)..(291): a, c, t, g, unknown or other
  misc_feature (291)..(291): n is a, c, g, or t
  modified_base (296)..(296): a, c, t, g, unknown or other
  misc_feature (296)..(296): n is a, c, g, or t
  modified_base (303)..(303): a, c, t, g, unknown or other
  misc_feature (303)..(303): n is a, c, g, or t
tcagtactctcgtgcacgaccggtgctcgatttagagtatacatattgggtttggggggtagctcaggaagcagagcctggagcatctccactatggcctgggctccactacttctcaccctcctcgctcactgcacaggttcttgggccaactttatgctgactcagccccactctgtgtcggagtcgtccggggaagaccggtaaccattctttgcaccacaacgagtggcaacattgccagctaattttgngcagtggtaccagcagcgccggcacgtccccacntgnatcangagatanacaaacgccgtgtcgggtccctagacgttcggttctcgtggcctccgatcgacacgtcctcctaccactctccgccctaccctcacctactctcgtcgacgtagaagacgtaggacggacgacgcgtacgacctaacgttactacgtacgtagttaccgttagtagtacgtacgtccggtacgtacgtagttcggttcgggttccggttacgggtaccggggacgggaaccgtaacggtaccgtaccggtacccggtaccgtaaccggtacgaccggacccggaccggtccgtaccctcccccgggggggttcccg

SEQ ID NO: 320752 - DNA, 578 bp, Homo sapiens
  misc_feature: GZ8MTXP02FQTSN.19.67.G01.1.454.CMB.2.raw
  modified_base (239)..(239): a, c, t, g, unknown or other
  misc_feature (239)..(239): n is a, c, g, or t
  modified_base (299)..(299): a, c, t, g, unknown or other
  misc_feature (299)..(299): n is a, c, g, or t
  modified_base (316)..(316): a, c, t, g, unknown or other
  misc_feature (316)..(316): n is a, c, g, or t
  modified_base (322)..(322): a, c, t, g, unknown or other
  misc_feature (322)..(322): n is a, c, g, or t
  modified_base (330)..(330): a, c, t, g, unknown or other
  misc_feature (330)..(330): n is a, c, g, or t
  modified_base (366)..(366): a, c, t, g, unknown or other
  misc_feature (366)..(366): n is a, c, g, or t
  modified_base (425)..(425): a, c, t, g, unknown or other
  misc_feature (425)..(425): n is a, c, g, or t
  modified_base (456)..(456): a, c, t, g, unknown or other
  misc_feature (456)..(456): n is a, c, g, or t
  modified_base (532)..(532): a, c, t, g, unknown or other
  misc_feature (532)..(532): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagccgtggggcgtntctgagactgtcctgtcgacctcgtggggtctcgcagcagcgactgtatgcctgggtccncaggctacgagggaagnggcggngtgggtcngtaggtattttagaggtggaccactattcgacgganactcagtgggacgggccaagttccactactctaccagtacgttactttcacacgaaacnctactcgtcctacttacaaaattggaaaccnggtacgagggacgggacgaacggacgacggtcttagttattgtgtgtacgtagttagttaggtggacgtagtcggngttagggaagacgagtactacggacggtacggggaccgtaaacggg

SEQ ID NO: 320753 - DNA, 622 bp, Homo sapiens
  misc_feature: GZ8MTXP02FWVHJ.19.67.G01.1.454.CMB.2.raw
  modified_base (241)..(241): a, c, t, g, unknown or other
  misc_feature (241)..(241): n is a, c, g, or t
  modified_base (308)..(308): a, c, t, g, unknown or other
  misc_feature (308)..(308): n is a, c, g, or t
  modified_base (311)..(311): a, c, t, g, unknown or other
  misc_feature (311)..(311): n is a, c, g, or t
  modified_base (319)..(319): a, c, t, g, unknown or other
  misc_feature (319)..(319): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctggcggggacatcgtgatgacccagtacccagactcactggctgtgtctcgtgggcgagacggccacaatcaactgcaggtccagccagaactatttccnccacctacaaagaaactaaaacttctacgcctagtaaccaacagacgaccagacagcctactagtcnctntattacgnggtctcgtacgcgtacgtaacgttccggggtccctggaccccgtacggttcccggggacacggggtcgggttcgtaggggacctagttactttccaccttcctacacctatacagccacgtcctggcaggctaaggaagtgtcgggtgtacttagtttactacgtgtacagttaacttaattttactttttctaacgttcccgttacgggtaggtaccggttcgaaccggtaaacggggaccgtaggggtacgaaactcggaacgaccggtaagtggtcgacgtcgacctactcgttcgttcg

SEQ ID NO: 320754 - DNA, 680 bp, Homo sapiens
  misc_feature: GZ8MTXP02JV12D.19.67.G01.1.454.CMB.2.raw
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtgggcggaggcttggtccaggcccgtggggcggttctcgtgagtactgtcctgtcgaccctgtggggtctccgtcagcagcgactgtattcgccgtcgggtccgccgaggtcctccgaggggaaggacgggccgggaggtcggggtccgcgtagggtttagtttttaagaggggttacggggaacccgtacgtagtttacgtaacggggacgtaccgtccgtagtggggaacggggcccgtattaccgaacctatcccgtcccaagtaacgtaccttttacgacaaacgtaaaccactacttacgttaccttacttaacgaaaatcgaaaccgacgtcccgtagggaccggggaccgaacggaccggtaaccggcccggttattaacgttagttggtaggtgaggttagtttaggtaggcgtagtgggcttgggaacgtacgagactcggacggtcggggaccgtaaaccgg

SEQ ID NO: 320755 - DNA, 572 bp, Homo sapiens
  misc_feature: GZ8MTXP02HPHWQ.19.67.G01.1.454.CMB.2.raw
  modified_base (517)..(517): a, c, t, g, unknown or other
  misc_feature (517)..(517): n is a, c, g, or t
  modified_base (526)..(526): a, c, t, g, unknown or other
  misc_feature (526)..(526): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagccgtgggcggtctctgagctgtcctgtgaccctgtggggtctccgtcagcagcgactgtattgcctgggtccgcaggctccgagggaagcgggccggaggtgggtcgctaggttatttttagaggtgggaccgacattcgtaaggagaccttcgagtgggagggcctagttccaccgatcctaccagtagtacttttcacagtaacaactctcgtctacttacaaattcgaaactagaccgtggacggggccgaggaccacgggtcgtctattagtgtgtgtagtggttanggcgtacgnggtcgtggtcggatagactcgaaccggtcggggaccgtaaccgggg

SEQ ID NO: 320756 - DNA, 635 bp, Homo sapiens
  misc_feature: GZ8MTXP02JRFCE.19.67.G01.1.454.CMB.2.raw
  modified_base (290)..(290): a, c, t, g, unknown or other
  misc_feature (290)..(290): n is a, c, g, or t
  modified_base (342)..(342): a, c, t, g, unknown or other
  misc_feature (342)..(342): n is a, c, g, or t
  modified_base (362)..(362): a, c, t, g, unknown or other
  misc_feature (362)..(362): n is a, c, g, or t
  modified_base (369)..(369): a, c, t, g, unknown or other
  misc_feature (369)..(369): n is a, c, g, or t
  modified_base (444)..(444): a, c, t, g, unknown or other
  misc_feature (444)..(444): n is a, c, g, or t
tcagtactctcgtgcacgaccggtgctcgatttagagtatacatattgggtttgggggtagctcaggaagcagagcctggagcatctccactatggcctgggctccactacttctcaccctcctcgctcactgcacaggttcttgggccaactttatgctgactcagccccactctgtgtcggagtctccggggaagacggtaaccatctttgcacccacaacagtggcaacattgaccaacaattttgtgcagtggtaccagcagcgcccggcagttcccccacattgngatctaatgaggataatcaaaagaccgtctcgggggtccctgatcggttctntggcctcgatcgacagctcnccaactntcgcctcctcaccatctctggactgacgactgaggacgaggcctaggacttaacgtactgtacctagtctttagngtagttacgccggaccggtcgaagttcgggttgttccccggttttagggggaccggggtaaaccgggggaacccaaaagggtcccgtttacgggaaaccccggttccgtttaacgggtaaccgaaacggacccccggtttaaaacgggggccctttaccccgggccccccccgtttacggggtttaccccc

SEQ ID NO: 320757 - DNA, 715 bp, Homo sapiens
  misc_feature: GZ8MTXP02F7RRX.19.67.G01.1.454.CMB.2.raw
  modified_base (281)..(281): a, c, t, g, unknown or other
  misc_feature (281)..(281): n is a, c, g, or t
tcagtactctcgtgcacgaccggtgctcgatttagagtatacatattgggtttgggggggagaggagcccagcactgggattccgaggtgtttccattcggtgctcagaactgaacacagaggactcaccatggagttttggctgacctgggttttccttgctgcaatttcaggaggtgtccagtgtggaggtgcaactggtggagacgtgggcggaggcttggtccaggccgtgggcggtctctgagactgtcctgtcgaccctcgtggggtctccgtcncgcagcgtacgtgtacttcggccgtcggggtcccgcccgaggccgtacccggaaggggaaacggacggggcccggggtagggtcggggtaccggacggttaaggggttttaaattttttaaggaggggttacggggaacgtaaccctacgtttaccgtaacggggaacgtaccttacccgaaggttgggggacggggtcccgtattcccgacctactccgtaccgagtacgttacctttttcacaaacgaaccactaccgttgttccttcttaacaaactaggaaaccaggccctaggggacgggacccggagaacccgaccgggtccgtacttagttagtttggtagtaggtaagttaggtttagtccgggtgtagtcggtcggtgggttacgaacgtagacttcggacggtcggggaccgacgggtaacccg

SEQ ID NO: 320758 - DNA, 587 bp, Homo sapiens
  misc_feature: GZ8MTXP02IM1VA.19.67.G01.1.454.CMB.2.raw
  modified_base (290)..(290): a, c, t, g, unknown or other
  misc_feature (290)..(290): n is a, c, g, or t
  modified_base (446)..(446): a, c, t, g, unknown or other
  misc_feature (446)..(446): n is a, c, g, or t
tcagtactctcgtgcacgaccggtgctcgatttagagtatacatattgggtttgggggtagctcaggaagcagagcctggagcatctccactatggcctgggctccactacttctcaccctcctcgctcactgcacaggttcttgggccaactttatgctgactcagccccactctgtgtcggagtctccggggaagacggtaaccatctttgcacccacaacagtggcaacattgccagctaattttgtgcagtggtaccagcagcgccgggcacgttcccccacatgngatctagtgaggataatacaaaagccgtcgtcggggtccctgatcggttctcgtcggcctccatcgacagcctcctccaacgtctcgccctcctacaccatcctctggactagaagactggaggacgaggctgactactactcgtctagttcttangaagtcggccgtcggtactagttcggtcggttacgttcggggacgggaacggggtaccaaaggtccgttaacggaccccggttcgtaaggggtccaacgggtaccccgaacggggtccctaccggtcccccccgtttacgg

SEQ ID NO: 320759 - DNA, 682 bp, Homo sapiens
  misc_feature: GZ8MTXP02HVI9S.19.67.G01.1.454.CMB.2.raw
  modified_base (316)..(316): a, c, t, g, unknown or other
  misc_feature (316)..(316): n is a, c, g, or t
  modified_base (407)..(407): a, c, t, g, unknown or other
  misc_feature (407)..(407): n is a, c, g, or t
  modified_base (456)..(456): a, c, t, g, unknown or other
  misc_feature (456)..(456): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtgggtggagacgtgggcggaggtcttgggtccaggtccgtggggccggtctcgtgagtactgtcctgtacgtaccctgtgggtctccgtcagcagcgactgtattgccgtgggtcccncgaggctaccgagggaaggaggccggtaggtcgggtcgcgtaggttatttttagagggtcggaccgtacgtacttcgaacggataccgtcngtgggacggtccgtacttccacagttcccacgaagtacgttacttttcncgaaacgtaacgacctacgttcgttacctacttaaacaaaattcgaaaacgtaccggtacgtacggggacgggggtaaccccgaacggggaacccgtaccggggtacctacgtttaacgtttagtcgtaggtagtacgttaggtttacgacgggtagtacgttaggggtccgttaggggaacgtaacgaggtacgtacggacggtacgggggacctaaaccggggg

SEQ ID NO: 320760 - DNA, 731 bp, Homo sapiens
  misc_feature: GZ8MTXP02HKPXF.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgctaatttcaggaggtgtccagtgtgaggtgcaacgtggtggagacgtgggcggaggtcttggtccagccgtgggcgtctcgtgagtactgtcctgtcgaccctgtgggtcctaccgtcagcagcgtactgtattcgccgtcgggtcccgccgaggcctaccggaaggggaacggacgggcccgggaggttggggtacgcgtaaggttttagtttttaggaggggtagggtacccgactagttcgtaacggagtacctaccgtaggtcggggacggtacccgtatttacccgaacctagttcccaccgtagtaaccgtttactttaccgactaaacgaaacctaccgactttaccgttccttacttaaactaaacgtacgaaacgacgttaccggacggggacgggaacccgtaacgggaacccgaccggtaccggttaatttacgtttaagttggtagttacggtaagtttagtttacgtagggtctaacggttcggtacgggttggtaacgggtacaggtttacgacggtacccgggtacgggggtaacccgtaaaccccggggg

SEQ ID NO: 320761 - DNA, 647 bp, Homo sapiens
  misc_feature: GZ8MTXP02FU3UK.19.67.G01.1.454.CMB.2.raw
  modified_base (194)..(194): a, c, t, g, unknown or other
  misc_feature (194)..(194): n is a, c, g, or t
  modified_base (244)..(244): a, c, t, g, unknown or other
  misc_feature (244)..(244): n is a, c, g, or t
  modified_base (308)..(308): a, c, t, g, unknown or other
  misc_feature (308)..(308): n is a, c, g, or t
  modified_base (448)..(448): a, c, t, g, unknown or other
  misc_feature (448)..(448): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctggcggggacatcgtgatcgacccagtacccagactcactggctgtgtctcgngggcgagacggccacaatcaactgcacggtccagccaagaactatttccnccacctacaaagaaactaaactctacgcctgaccaacagacgaccaggacagcctacctaagtnctactatttacgtgggcttacgtacgcgtacgtaacgttccggggtccctcggaccccgtacggttcccggggactacggggtcggggttcgtaggggacctagtactttccactcctacaacctagtcacgccacgccncgcgacggaccgaagtcgtggtacgtacttagttttactacgtacggtctaggtacttaattttacgttttcttaccgttccgttacggttacgggtaccgtttccgggaacgtaacggggtacccgtaaggggtaccgaaacgtcggtaacgaacgtaacgttggccggtctacggacctactacgttctcgtttacc

SEQ ID NO: 320762 - DNA, 704 bp, Homo sapiens
  misc_feature: GZ8MTXP02I84TZ.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttcctgctgcaatttcaggaggtgtccagtgtgaggtgcaacgtggtggagacgtgggcggaggtcgttggtccagccgtggggcgtctctgagtactgtcctgtacgaacccgtcgtgggtcctccgtcagcagcgactgtacgtcgccgtcggtccgccaggcctcgaagggacgcggcgggagtgggtcgtcgtaggtttattttaggaggggtaggacgtacctagttacgtaacggagtaccctacggtaggtcggggaacggggtacccgtattacccgaaccgtactttaccgaccgaaaggttaaccgttacccttttactaacgaacgtaaacctactacgttacgttctaccgttactaaacttacgaaactacggtacctacggggacgggaccgaaacggtaccgaccgggtaccttacggttatttaagggttgttaggttacgtaaggttagttttaaggcgggacgttaggtcgggttagtgggtaaccggatacggttacgacggttaccggtcggggaaccggttaaccgggg

SEQ ID NO: 320763 - DNA, 693 bp, Homo sapiens
  misc_feature: GZ8MTXP02ID3J2.19.67.G01.1.454.CMB.2.raw
  modified_base (285)..(285): a, c, t, g, unknown or other
  misc_feature (285)..(285): n is a, c, g, or t
  modified_base (488)..(488): a, c, t, g, unknown or other
  misc_feature (488)..(488): n is a, c, g, or t
  modified_base (542)..(542): a, c, t, g, unknown or other
  misc_feature (542)..(542): n is a, c, g, or t
  modified_base (604)..(604): a, c, t, g, unknown or other
  misc_feature (604)..(604): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtgggcggaggcttggtcccaggcccgtgggggccgttctctgagtctgtcctgtacgaccctgtggggtctccgtnagcagcgacttgtattcgccgtcggggtaccccgccgagggtccctaccggaaggggaacggcggggtccccgggtagggtcggggtcgtacgttaagggttttaaattttttaggaggggttacgggacccgtaacgttatttacggaaccgggtagaccccttccgagggttcggggacggggtccctattcccgaacctnttaccctccgaagtacgttactttcacgaacgtacacctagttcgtctacttanaaagtcgaaacgcgtaccgtaggacgggacccgacggtaccgacggtccgttatagttttanggtgtagtagttacgttacggtggacgttagcggtggttacgggaagaccgtagtactaccgacgggttacggggaaccggtacccggg

SEQ ID NO: 320764 - DNA, 720 bp, Homo sapiens
  misc_feature: GZ8MTXP02IRK6P.19.67.G01.1.454.CMB.2.raw
  modified_base (278)..(278): a, c, t, g, unknown or other
  misc_feature (278)..(278): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtgggcggaggcttggtccaggccgtgggcggtctctgagactgtcctgtcgaccctgtgggtctccgtnagcagcgactgtattcggcccgtcggggcccgccgagggcctaccggaaggggaacggacggggccgggaaggttcgggggtaccgtacgttaagggttttagtttttacggaggggttacggggaacccgtactacgtttaccgtaacggggtaacgtacccttaccgaggggttcgggggaacgggggtacccttacttacccgaaacccgtacttacccgtacccgtaaggtacgtttaccctttttacaacgtaaacgtaaacctacctacgttcgttaccttacttaacaaaagttacgaaacacggtccgtagggacggggcccgaaggaccgaccggtccgttatagttgtgtgtaggtagttagttacgtggacgtagtggtcgtagggtgaacgtacggtactacggtacggtacgggggaccgtaaccgggg

SEQ ID NO: 320765 - DNA, 660 bp, Homo sapiens
  misc_feature: GZ8MTXP02HFS4M.19.67.G01.1.454.CMB.2.raw
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtgggcggaggcttggtccaggccgtggggcggtctctgagactgtcctgtcgaccctcgtggggtctccgtcagcagcgactgtatgcctgggtccgcaggctccgaaggggaaggacgggccggaggtcgggtacgcgtaggttatttttagaggggtgggacccgactagtttcgtacgggaggtactccgagttcggggacgggaccgtattccgaacctacgttcctaccgagtacgtaccttttcgtacaagtaaacacctaacttcgtcctacttacaaaacttacgaaacacgtccgtagggaacgggccgaacgggaccgaccggggccttacgtagtttagttcggtagttacggtagttaggtttaacgtgggtacgtagttcgggtcgtaggggtcgaacgtagtacgtcgtaacgggttcggggaccgttaaaccggggg

SEQ ID NO: 320766 - DNA, 581 bp, Homo sapiens
  misc_feature: GZ8MTXP02FL5RV.19.67.G01.1.454.CMB.2.raw
  modified_base (320)..(320): a, c, t, g, unknown or other
  misc_feature (320)..(320): n is a, c, g, or t
  modified_base (383)..(383): a, c, t, g, unknown or other
  misc_feature (383)..(383): n is a, c, g, or t
  modified_base (459)..(459): a, c, t, g, unknown or other
  misc_feature (459)..(459): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtcgaaccctcgtggggtctccgtcagcagcgactgtattgcctgggtccgcaggctccgaggggaagngggccggaggtggggtcgcgtaggttatttttagtagggtgggaccgactattcgtacggganactccagtgggacgggccgattccacatctccagacgtactttcacaagaacacactgtctcttacaaatgaaacngcctaggacgggccgaggacacggccgtctattattgtgtagagttagtttagtcggacgtagtcggcgttggggtaacggacgaaggtactcgtaacggtcgggggaccctaaaccggggg

SEQ ID NO: 320767 - DNA, 583 bp, Homo sapiens
  misc_feature: GZ8MTXP02GE0ZE.19.67.G01.1.454.CMB.2.raw
  modified_base (390)..(390): a, c, t, g, unknown or other
  misc_feature (390)..(390): n is a, c, g, or t
  modified_base (439)..(439): a, c, t, g, unknown or other
  misc_feature (439)..(439): n is a, c, g, or t
  modified_base (469)..(469): a, c, t, g, unknown or other
  misc_feature (469)..(469): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccaggcctggggcggtctcgtgagacttgtcctgtcgaaccctcgtgggtctccgtcagcagcgactgtatcgccgtgggtccgccagggcctccgaggggaagagggccggaggtggggtcgcgtagggttatttttagagggttggaaccgacagttcgtacgganacctcagtgggacgggccgattccgaccatctaccagtacgtctttacncagaacacactgtcctctacaaatgaaacncgctaggacgggccgaaggaccgacgccgttatacgttagtgtgtagtagtagtttatgggacgtagtcggtcgagggtaaggactaggactcgacgtcggggacctaacgggg

SEQ ID NO: 320768 - DNA, 583 bp, Homo sapiens
  misc_feature: GZ8MTXP02G95AO.19.67.G01.1.454.CMB.2.raw
  modified_base (324)..(324): a, c, t, g, unknown or other
  misc_feature (324)..(324): n is a, c, g, or t
  modified_base (491)..(491): a, c, t, g, unknown or other
  misc_feature (491)..(491): n is a, c, g, or t
  modified_base (564)..(564): a, c, t, g, unknown or other
  misc_feature (564)..(564): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccaggccgtgggcggtctctgagactgtcctgtcgaaccctgtggggtctccgtcagcagcgactgtattcgcctgggtccgccaggctccgaggggaagnggccggagtcgggtcgcgtaggttatttttagagggtggaccactattcacggatactcagtgggacggccgtattccgaacatcctaccagacgtacttttcacaagaacacacttgtctacttacaaaatgaaacagccgtaggacggggaccgaggacgacggnttacgtacttagttattggtagtaggtagtacggtttagcggtacgactggggtactgggtagaacgaggtanacgacggtacggggaaccg

SEQ ID NO: 320769 - DNA, 669 bp, Homo sapiens
  misc_feature: GZ8MTXP02F7QER.19.67.G01.1.454.CMB.2.raw
  modified_base (281)..(281): a, c, t, g, unknown or other
  misc_feature (281)..(281): n is a, c, g, or t
  modified_base (408)..(408): a, c, t, g, unknown or other
  misc_feature (408)..(408): n is a, c, g, or t
  modified_base (416)..(416): a, c, t, g, unknown or other
  misc_feature (416)..(416): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttcctgctgcaattcaggagtgtccagtgtgaggtgcaacgtgggtggagacgtgggcggaggcttggtccaggtccgtggggcggtctcgtgagtactgtctgtcgaacctcgtggggtctccgtnagcagcgtactgtatcggcctcggggtccgccgaggcctaccgaaggggaacgacgggccggtaggtcggggtcgcgttaagggtttactttttaggaggggtcggaaccgtactagttcgacgganaccttcgnggtgggacggggcctattccgaactatcctcgaagtacgttacctttcacaaacgtacactactcgtcttaacgtacaaaacgttcgaaactacgtccgtagggacggggccgaacggacgtaccgggaccttacgttaagttagttggtacgttaggtacggttaagtttacggtcggggaagtacggttacgggcgttagggtaacggaccgtaaggacgtacgacggtacgggggacctaaacccggggg

SEQ ID NO: 320770 - DNA, 631 bp, Homo sapiens
  misc_feature: GZ8MTXP02HMT0R.19.67.G01.1.454.CMB.2.raw
  modified_base (302)..(302): a, c, t, g, unknown or other
  misc_feature (302)..(302): n is a, c, g, or t
  modified_base (318)..(318): a, c, t, g, unknown or other
  misc_feature (318)..(318): n is a, c, g, or t
  modified_base (377)..(377): a, c, t, g, unknown or other
  misc_feature (377)..(377): n is a, c, g, or t
  modified_base (411)..(411): a, c, t, g, unknown or other
  misc_feature (411)..(411): n is a, c, g, or t
  modified_base (451)..(451): a, c, t, g, unknown or other
  misc_feature (451)..(451): n is a, c, g, or t
  modified_base (475)..(475): a, c, t, g, unknown or other
  misc_feature (475)..(475): n is a, c, g, or t
  modified_base (565)..(565): a, c, t, g, unknown or other
  misc_feature (565)..(565): n is a, c, g, or t
tcagtactctcgtgcacgaccggtgctcgatttagagtatacatattggggtttgggggggagaggagcccagcactgggattccgaggtgtttccattcggtgctcagcactgaacacagaggactcaccatggagttttggctgacctgggttttcctgctgcaatttcaggaggtgtccagtgtgaggtgcaacgtgggtggagacgtgggcggaggcttggtccagccgtgggcggtctctgagactgtcctgtcgaccctgtgggtctccgtcagcagcactgtatcgcgtggtccncaggctcgagggacgnggccggagtcgggtcgcgtaggttattttagagggtggaccgtactagttacgaacggngtaccacgaggtgggacgggcctattccgaaccncttacctccgaaggtacttacctttcgactaagtaaaccnctaacgttcgtccttaccttaaanaaagtacgaaccgcgtacgacgggacggggaccgaacggacccgacggtccttattagtttagtcggtaggtacgtaggttagttacggngggtacgtggtcggtcggtagggaagacgacgtacgtacggacgggtccggggtaaccgtaacggg

SEQ ID NO: 320771 - DNA, 586 bp, Homo sapiens
  misc_feature: GZ8MTXP02FM5CT.19.67.G01.1.454.CMB.2.raw
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagccgtgggcggtctctgagactgtcctgtcgaaccctctggggtctccgtcagcagcgactgtattgcctgggtccgccaggctccagggaaggaggccggaggtggggtcgcgtaggttactttttagtagggtgggaccgactagttctacgggagacctccagtgggacgggccgattccaccgatcctccaagacgtacttttctacacgtaacactacttgtccttacttacaaaatgaaactagcctggagggccgaacggacacggccgtactagttattgtagtggtagtagtttagtggtactagtgggcttgggtaaggacaggactacgacgtgggggacctaaccgggg

SEQ ID NO: 320772 - DNA, 611 bp, Homo sapiens
  misc_feature: GZ8MTXP02I4D3F.19.67.G01.1.454.CMB.2.raw
  modified_base (300)..(300): a, c, t, g, unknown or other
  misc_feature (300)..(300): n is a, c, g, or t
  modified_base (333)..(333): a, c, t, g, unknown or other
  misc_feature (333)..(333): n is a, c, g, or t
  modified_base (474)..(474): a, c, t, g, unknown or other
  misc_feature (474)..(474): n is a, c, g, or t
  modified_base (514)..(514): a, c, t, g, unknown or other
  misc_feature (514)..(514): n is a, c, g, or t
tcagtactctcgtgcacgaccggtgctcgatttagagtatacatattggggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctgggcggtctctgagactgtcctgtcgaaccctgtggggtctcgtcagcagcgactgtatgcctggtccncaggctccgaggggaagaggccgggagtgggcncgtaggttatttttagaggggtggaccacgtattcgtaacggggataccgttccaggtcggggaggggtaccctattccgaccctatcctaccgagtacgtactttcacagaacacactcgtctactacaaagtcgaaacncgtcgtaggacgggggaccaaggtaccgacggtaccgttntatttagtgtagttaggagttagttacgtagggacgtagtcggtcggtaggtaacggacgaggtacgtacggtacgggtacggggaccggtaaccgg

SEQ ID NO: 320773 - DNA, 731 bp, Homo sapiens
  misc_feature: GZ8MTXP02I7CIW.19.67.G01.1.454.CMB.2.raw
tcagtactctcgtgcacgaccggtgctcgatttagagtatacatattgggtttggggggagaggagcccagcactgggattccgaggtgtttccattcggtgctcagcactgaacacagaggactcaccatggagttttggctgaccttgggttttccttgctgcaatttcaggaggtgtcagtgtgaggtgcaactggtggagacgtgggcggaggtcttggtccagccgtggggcggtctcgtgagtactgtcctgtcgaaccctgtgggtctccgcagcagcgactgtattcgccgtgggtccgcaggctccgaaggggaagcggccggaggtgggtcgcgtaggttattttagagggtggaccgtactagttcgtaacggagacctacgaggttcggggaacggggtcccgtaattacccgaaccctagttaccccttacccgaaggtaaccgtttaccgtttttccctaacgtaaacgaaacctaccctaacttcgttacccttaccttaactaaaaagttacgaaaaccgtacgtacccgtagggaaccgggggacccgaaacgggacccgtaccgggtacccgttacgttaagttttaacgttggtaggttacggtaaggttaggttttaaccgggtgggtacggtacggtcgggtacggttacggggtaacggaacgtaacggtacgtaccggtacgggtaccgggggaaccggtaaccgggg

SEQ ID NO: 320774 - DNA, 556 bp, Homo sapiens
  misc_feature: GZ8MTXP02FQWHX.19.67.G01.1.454.CMB.2.raw
  modified_base (198)..(198): a, c, t, g, unknown or other
  misc_feature (198)..(198): n is a, c, g, or t
  modified_base (360)..(360): a, c, t, g, unknown or other
  misc_feature (360)..(360): n is a, c, g, or t
  modified_base (398)..(398): a, c, t, g, unknown or other
  misc_feature (398)..(398): n is a, c, g, or t
tcagtactctcgtgcacgaccggtgctcgatttagagtatacatattgggtttggggggtagctcaggaagcagagcctggagcatctccactatggtctgggctccactacttctcaccctcctcgctcactgcacaggttcttgggccaactttatgctgactcagccccactctgtgtcggagtctccggggaanacggtaaccatcttttgcacccacaacagtggcaacattgccagcaattttgtgcagtggtaccagcagcgcccgggcacgttcccccacattcgtgatctatgaggataatcaaaagccgtgtggggtccctgatcggtctctgctcgatcgacagctccnccaactctcgccctcctcacctatctctggactagaanactgagacgaggctgacctactactcgtacagttcttatgatacggccgtcgtcagtgtcggtcgttcggcgggacggtaccaaacggtctacggacccgttaccgtaaacggggtccacggtaccccgaacggcctaccggtccccccgtttaccgg

SEQ ID NO: 320775 - DNA, 626 bp, Homo sapiens
  misc_feature: GZ8MTXP02F00HN.19.67.G01.1.454.CMB.2.raw
  modified_base (249)..(249): a, c, t, g, unknown or other
  misc_feature (249)..(249): n is a, c, g, or t
  modified_base (265)..(265): a, c, t, g, unknown or other
  misc_feature (265)..(265): n is a, c, g, or t
  modified_base (315)..(315): a, c, t, g, unknown or other
  misc_feature (315)..(315): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgaccttgggttttccttgctgcaatttcaggaggtgtccagtgtgaggtgcaactggtggagacgtgggcggaggcttggtccagccgtgggcgtctctganctgtcctgtgaccctntgggtctcgtcagcagcgatgtatgcgtcggtccgcaggctcgagggagnggccggagtgggtcgcgtagttattttagagggtggacgatagttcgtacggagctcgagtagggacggggtaccgtattacgacctactcctccgaagtacgttaccttttccgtactaacggaaacctaaccacttacgtcttaacttaacaaacgttacgaaacgtacgacccgttagggaaccgggaccggacgggaaccgtaccgggccgttaccttaagtttcgttacggttgtaggacggttagtttaagtcggacgtagttgggtaacgtgggtaggacgtagacgttcgacggtaccggggg

SEQ ID NO: 320776 - DNA, 604 bp, Homo sapiens
  misc_feature: GZ8MTXP02GC0L1.19.67.G01.1.454.CMB.2.raw
  modified_base (425)..(425): a, c, t, g, unknown or other
  misc_feature (425)..(425): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttcctgctgcaatttcaggaggtgtccagtgtgaggtgcaactggtggagactgggcggaggcttggtccaggcctgggcggtctctgagactgtcctgtcgaaccctcgtggggtctccgtcagcagcgactgtatgccgtggtccgcaggctccgaggggaagagggccggaggtgggcgcgtaggttattttagaggtgggaccgtacattcgacggagacctcgagtgggagggccgtagttccaccatcctccagtacgtactttcnctaagaaaccactacgtcgttcctacttacaaaagttcgaaactacggccttagggacggggcccgaacggacgaccggtccggtacttagttagttggtgtaggtagtagttttagcgggtacgagtcgggtcgttgggtggaacaggtactcgacggtcgggggacccgtaacgggg

SEQ ID NO: 320777 - DNA, 693 bp, Homo sapiens
  misc_feature: GZ8MTXP02IKH2G.19.67.G01.1.454.CMB.2.raw
  modified_base (283)..(283): a, c, t, g, unknown or other
  misc_feature (283)..(283): n is a, c, g, or t
  modified_base (336)..(336): a, c, t, g, unknown or other
  misc_feature (336)..(336): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgaccttgggttttccttgctgctaatttcaggagtgtccagtgtgaggtgcaacgtggtggagacgtgggcggaggtcttggtccaggccgtggggcgtctctgagactgtcctgtcgaaccctgtgggtctcgtnagcagcgactgtactgccgtcgggtccgccgaggcctaccgaaggggaacggngggcccgggaggttggggccgtcgtaaggggtttaatttttacggtaaggggttacggggaacgtactagtttaccggtaacggacgtaccgtccgaagtacgggggaccgggccgtaactttccaaaccctactaccgtacccgtagtaacgttacttttacgtacgtaacgtaaacacctaacgtctaccttacgttacctaaaattcgaaacgtcggaccgttagggaccgggaccggacgggaccgtaccggaccgttacgttaattacgttagtaggtagacggttaagtttaagtcggtacgtagtacgggtcgttaggacggtacgaagtacgttacgacggtacggggg

SEQ ID NO: 320778 - DNA, 694 bp, Homo sapiens
  misc_feature: GZ8MTXP02IG6VO.19.67.G01.1.454.CMB.2.raw
  modified_base (306)..(306): a, c, t, g, unknown or other
  misc_feature (306)..(306): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttcctgctgcaatttcaggaggtgtccagtgtgaggtgcaagtggtggagacgtgggcggaggcttggtccagccgtgggcggtctcgtgagactgtcctgtcgaaccctcgtgggtctccgtcagcagcgactgtattcgccgtgggtccnccgagggcctaccgaggggaaggacgggccgggaggtcggggtcgtacgtagggttatttttaggaggggttagggaacccgtactagttcgtacgggagacctcgagtcgggacgggtccgtacgtttaccaccgtaacttcccgtactaacgacgttaccttttcctacgaacgtaaacctaccttactacgttccttacttaacaaactttacggaaacctacggtacccttagggaaccggggaccggagggaacccgacgggtacccgttacttaagtttagtggtaggtcgtaagttagtttagtgggacgttaaggtcggtagtggggtaaggaacgtaaggtactaacggtacggtccgggggtaaccgtaacccggggg

SEQ ID NO: 320779 - DNA, 669 bp, Homo sapiens
  misc_feature: GZ8MTXP02G7Y8I.19.67.G01.1.454.CMB.2.raw
  modified_base (221)..(221): a, c, t, g, unknown or other
  misc_feature (221)..(221): n is a, c, g, or t
  modified_base (225)..(225): a, c, t, g, unknown or other
  misc_feature (225)..(225): n is a, c, g, or t
  modified_base (251)..(251): a, c, t, g, unknown or other
  misc_feature (251)..(251): n is a, c, g, or t
  modified_base (308)..(308): a, c, t, g, unknown or other
  misc_feature (308)..(308): n is a, c, g, or t
  modified_base (419)..(419): a, c, t, g, unknown or other
  misc_feature (419)..(419): n is a, c, g, or t
tcagtactctcgtgcacgaccggtgctcgatttagagtatacatattgggtttggggggtagctcaggaagcagagcctggagcatctccactatggcctgggctccactacttctcaccctcctcgctcactgcacaggttcttgggcctaactttatgctgactcacgcccatctgtgtcggagtcgtcggggaagacggtaactattctttgcaccanaacngtgacaacattgccagctaattttgnctagtggaccagcgagccgcccgggactaccggttcccccactagttgtagacgttntagtaggaaggtaattaaacacgaaaacggtccgtcggttacggggtccctggagtttccgtctctcgggcctacagtaccgactcgacctcctaccgtaaactcgtcccnccctacctaccacctctcgtacgtacgtacgtacgaagtacgaggacggacgtacgtcgtactactacgttacgtacgttactacgttactagtacgacgtacggtccggtacgttacgtacggttcggtacgggttacggtacgggggtacgggaaccggtaaacgtacggtacccgtaccggtacccgttacggtaacggtaccgaaccggaccgtaaccgggtcccgtaccccggttacccgtaccg

SEQ ID NO: 320780 - DNA, 589 bp, Homo sapiens
  misc_feature: GZ8MTXP02I6IPO.19.67.G01.1.454.CMB.2.raw
  modified_base (254)..(254): a, c, t, g, unknown or other
  misc_feature (254)..(254): n is a, c, g, or t
  modified_base (351)..(351): a, c, t, g, unknown or other
  misc_feature (351)..(351): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctgggcggtctctgagactgtcctgngaacccctcgtggggtctccgtcagcagcgactgtatgcctgggtccgcaggctccgaggggaacgaggccggagtgggtcgcgaggttatttttanagggtggacgacagttctacggagacctccgagtgggaggggccgattccaaccatcctaccaggactacttttcacaagaaacacactgtactcttacaaatagaacagcctaggagggacccgaaggacgaacggtcccgtatattagtgttagtggagtaaggtttagtggcgtaagtgggcgttgggtaaggactaaaggtactacgacggttcgggggacccctaaacggggg

SEQ ID NO: 320781 - DNA, 574 bp, Homo sapiens
  misc_feature: GZ8MTXP02FM2RF.19.67.G01.1.454.CMB.2.raw
  modified_base (258)..(258): a, c, t, g, unknown or other
  misc_feature (258)..(258): n is a, c, g, or t
  modified_base (513)..(513): a, c, t, g, unknown or other
  misc_feature (513)..(513): n is a, c, g, or t
  modified_base (529)..(529): a, c, t, g, unknown or other
  misc_feature (529)..(529): n is a, c, g, or t
  modified_base (540)..(540): a, c, t, g, unknown or other
  misc_feature (540)..(540): n is a, c, g, or t
tcagtactctcgtgcacgaccggtgctcgatttagagtatacatattggggtttgggggggagaggagcccagcactgggattccgaggtgtttccattcggtgctcagcactgaacacagaggactcaccatggagttttggctgacctgggttttccttgctgcaatttcaggagtgtccagtgtgagtgcaactggtgagactggcggaggcttggtccagcctgggcggtctctgagactgtcctgtgaccctntggggtctccgtcagcagcgactgtattgcctgggtccgccaggctccgaggggaagagggcccggaggtggggtcgcgtagggttatttttagtagggtggggaacccgacattctacggagacctccatgggaagggcccgattccaccatcctacccagacgtacttttctcaagaaccacactgtctacttacaaaatgaaaccagaccctggaacggggccgaaggaccgacggccgtctaattatttgngtagaagtagtttagnggacagtcggntggaagacagactcgacgtcggggaccaacgggg

SEQ ID NO: 320782 - DNA, 629 bp, Homo sapiens
  misc_feature: GZ8MTXP02F5HIX.19.67.G01.1.454.CMB.2.raw
  modified_base (591)..(591): a, c, t, g, unknown or other
  misc_feature (591)..(591): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgaccttgggttttcctgctgcaatttcaggaggtgtccagtgtgaggtgcaacgtggtggagacgtgggcgggaggcttgggtccaggccgtggggcgtctcgtgagactgtcctgtcgaaccctcgtggggtctccgtcagcagcgactgtatcgccgtgggtcccgccgaggcctaccgaaggggaagacgggcccgggtaggtggggtccgacgtaggtttatttttaggaggggtgggaccactattacgaccggagcctccaggtgggacgggtcctacttcgacctatctaccaggtactacttttcacacgtaacactactcgtcttactacaaatcgaaactagccgtaggacgggcccgaaggaccgacgggtccctagttaagtttagttggtagttagtaaggttaggtttactaggggtacgtaggttcggnggttagggaggacgtaagtacgtcgacggtaccggggg

SEQ ID NO: 320783 - DNA, 566 bp, Homo sapiens
  misc_feature: GZ8MTXP02G5YJT.19.67.G01.1.454.CMB.2.raw
  modified_base (307)..(307): a, c, t, g, unknown or other
  misc_feature (307)..(307): n is a, c, g, or t
  modified_base (325)..(325): a, c, t, g, unknown or other
  misc_feature (325)..(325): n is a, c, g, or t
  modified_base (426)..(426): a, c, t, g, unknown or other
  misc_feature (426)..(426): n is a, c, g, or t
  modified_base (512)..(512): a, c, t, g, unknown or other
  misc_feature (512)..(512): n is a, c, g, or t
  modified_base (519)..(519): a, c, t, g, unknown or other
  misc_feature (519)..(519): n is a, c, g, or t
  modified_base (526)..(526): a, c, t, g, unknown or other
  misc_feature (526)..(526): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttcctgctgcaatttcaggaggtgtccagtgtgaggtgcaacgtggtggagactgggcggaggcttgggtccaggccgtggggcggtctcgtgagactgtcctgtcgaaccctcgtggggtctccgtcagcagcgactgtatgcctgggtccnccaggctccgagggaagnggccggagtgggtcgcgtaggttattttagaggtgggaccgactattcgtacggagacttccagtggacgggccgattccgacatcctcagagtactttcncagaacactactcgtctcttacaaatgaaacagcctaggacgggacgaggacgacggccgtatactagttgagtagagtagttagnggtacgngtacggngtaggtaagacagtactcgacggtcgggacgtaaccgggg

SEQ ID NO: 320784 - DNA, 698 bp, Homo sapiens
  misc_feature: GZ8MTXP02GM9BH.19.67.G01.1.454.CMB.2.raw
  modified_base (654)..(654): a, c, t, g, unknown or other
  misc_feature (654)..(654): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgctaatttcaggaggtgtccagtgtgaggtgcaacgtggtggagacgtgggcggaggcttggtccagccgtggggcggtctcgtgagctgtcctgtcgtaccctgtggggtctccgtcagcagcgactgtatcgccgtggggtcccgcgacggcctaccggaaggggaacggtacgggcccgggtagggtcggggtcgacgttaaggttttagtttttaaggaggggttcgggaaccgtactagttacgtaacggaacgtaccttccgaggtcggggaacggggtcccgtaattcccgaactacttccctaccgaagtacggttacctttttacacgtaagaaaccaccgtaacttcgtacttaccttaacgtaaaactacggtaaaacacggttccgagggaccgggggaaccgaacgggaccgaccgggtacccgttagttagttacttgggtacgtaggtagttaggtttacgtggtacgtacgtcggngtggtaacgacgaagtacgtcgacggtcgggaccgtaaccgggg

SEQ ID NO: 320785 - DNA, 580 bp, Homo sapiens
  misc_feature: GZ8MTXP02GKUD8.19.67.G01.1.454.CMB.2.raw
  modified_base (536)..(536): a, c, t, g, unknown or other
  misc_feature (536)..(536): n is a, c, g, or t
  modified_base (548)..(548): a, c, t, g, unknown or other
  misc_feature (548)..(548): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctcggttttccttgctgcaatttcaggaggtgtccaggtgtgaggtgcaacgtggtggagactgggcggaggcttggtccagccgtgggcgtctctgagctgtcctgtgaccctcgtggggtctccgtcagcagcgactgtatgcctggccgcaggctccgagggagcggccgggaggtcgggtcgcgaggttatttttagagggtgggacgactacgttcgtacggagacctccgaagtcggggagggccgagtttccaccctatcctccgagtacgtacttttcacacgactacactcgtacttcttacaaattgaacacgaccgtaggacggggccgtagggaccgaccggcccgttactattagtggtgtagtagtagttanacgggctgtggngtgggtacggacaggtacgacgtacgcggggg

SEQ ID NO: 320786 - DNA, 602 bp, Homo sapiens
  misc_feature: GZ8MTXP02GH79R.19.67.G01.1.454.CMB.2.raw
  modified_base (251)..(251): a, c, t, g, unknown or other
  misc_feature (251)..(251): n is a, c, g, or t
  modified_base (293)..(293): a, c, t, g, unknown or other
  misc_feature (293)..(293): n is a, c, g, or t
tcagtactctcgtgcacgaccggtgctcgatttagagtatacatattgggtttggggggtagctcaggaagcagagcctggagcatctccactatggcctgggctccactacttctcaccctcctcgctcactgcacaggttcttgggccaactttatgctgactcagccccactctgtgtcggagtctccggggaagacggtaaccatcttttgcacccacaacagtgcaacattgccagctaattttgngcagtggtaccagcagcgcccgggcacgttcccccacattgngatctatgaggataatacgaaagaccgtcgtcggggtccctgacttcggttcctggtccgtccactcgtacgacgcctcctcccactactcgtccctccctctaccactctcgtcgtacgtacgtaagacgtaggacgggaacgaacggcgtacgtactaaccttacgtcgtcgtagttcttacgttagagttacgccggtcggtacgtagttggtggttcggtcgggtacggggaccgggaaacgaacgcgtccgaccggttccgtaacgtcgacgaccggaccgacgtcccgtccccgtcgtacccg

SEQ ID NO: 320787 - DNA, 648 bp, Homo sapiens
  misc_feature: GZ8MTXP02JTCGC.19.67.G01.1.454.CMB.2.raw
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtgggcggaggcttggtccagccgtgggcggtctcgtgagtactgtcctgtcgaccctcgtcgggtctccgtcagcagcgactgtatcgccgtcgggtccgccgaggcctccggaaggggaacggacgggccggaggtcgggtcgacgtaggtttatttttagacggggtggaacgactagttcgtaacggagcctccgagtgggacggccgtacttcgacctacgtctaccagtacgttaccttttcactaacgaaccactactcgtacttaccttaacaaagtacggtaacacgtaccgtaggacgggaccggaggaccgacggtcccgttattaacgttgttaggtggtagtaggttaaggtttacgtgggtacgtaggttcggcggttacggggtaggacgtaaggtcgttaaccgggacggttacccggggg

SEQ ID NO: 320788 - DNA, 649 bp, Homo sapiens
  misc_feature: GZ8MTXP02GWXAT.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctggtttcctgctgcaatttcaggaggtgtccagtgtgaggtgcaacgtgggtggagacgtgggcggaggtcgttggtccaggccgtgggcggtctcgtgagactgtcctgtcgaccctcgtgggtctccgtcagcagcgactgtatgccgtggtccgccgacggcctaccgaaggggaacggaggccgggaggtcggggtcgcgtaggtttagttttagaggggttggacccgatagttacgacggaggtacctcagtcgacgtacgggaccgtattccgaactctacctccgagtacgttccgttttaccacaacgaacctactacgtcttaccttacttaactaaaacgtacgaaacgtacgtaccgtacgggaacggggacccggtaacggaccgaccggtaccgttactagtttacgtggttacgttagtagttacgtttagtggacgtagtcggtcgtggtacgtacgagtactacggtacggtcgggaaacccgg

SEQ ID NO: 320789 - DNA, 711 bp, Homo sapiens
  misc_feature: GZ8MTXP02H3JKQ.19.67.G01.1.454.CMB.2.raw
  modified_base (310)..(310): a, c, t, g, unknown or other
  misc_feature (310)..(310): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgctaatttcaggaggtgtccagtgtgaggtgcaacgtggtggagacgtgggcggaggtcttggtccaggccgtgggcggtctcgtgagtactgtcctgtcgaccctgtcgggtctcgtcagcagcactgtagtcgccgtcgggccnccgaggctaccggaagggacggacggcggtaggtgggtcgacgttaggtttatttttaggaggggttaggaccctactacgtttcgaacggtacaccgtaccgtggtacggggaacgggtccctattcccaaccgtattacccgtaccgtaaggtacgttaccttttacaaccgtaagtaaacctacgtacttcgttaccttacgttaactaaacgttacgaaacgtacggtaccgtagggaaccgggggtaccgaaacggtacccggaacgggttacccgttagttaacgtttagtgttacggtacggtaaggttaggtttggacgggtacgttaggtcggtacggttgggaacgtaacgtaggtacgtaccggacggggtcgggtaaccggaacccggg

SEQ ID NO: 320790 - DNA, 677 bp, Homo sapiens
  misc_feature: GZ8MTXP02GPEIS.19.67.G01.1.454.CMB.2.raw
  modified_base (642)..(642): a, c, t, g, unknown or other
  misc_feature (642)..(642): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgaccttgggttttccttgctgcaatttcaggagtgtccagtgtgaggtgcaacgtggtggagacgtggcggaggcttggtccaggccgtgggcggtctcgtgagtactgtcctgtacgaccctcgtgggtctccgtcagcagcgactgtattcgccgtgggtccgccgacggtcctaccgaaggggaacggcggggaccgggtaggtcggggtcgacgtagggttaagtttttaggagggtcggggaaccgtacgtagtttacgtacgggagtaccgttaccgaggtcggggaacggggccgtacgttcccgaacccgtattccgtaccctaggtacgttaccgtttttccgaacaaacgtaaccaacctacttacgtacttacttaaccaaaattcgaaacgcgtaccgtaggacgggaccgaacggacgaaccgggtccgttacgttatttagttggtgtacgtagtagtttacgcggtaacgtcgtggtcgtaggnggtacagtacgtacgacggtcgggacgtaaccggg

SEQ ID NO: 320791 - DNA, 589 bp, Homo sapiens
  misc_feature: GZ8MTXP02I1UUW.19.67.G01.1.454.CMB.2.raw
  modified_base (413)..(413): a, c, t, g, unknown or other
  misc_feature (413)..(413): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtcgaccctcgtggggtctccgtcagcagcgactgtatgcctgggtccgccaggctccgagggaagaggccggagtgggtcgcgaggttatttttagaggtgggaccgacattcacggagacctccagtgggagggccattcacgatctccagagtactttcncagaacacacttgtctcttacaaatgaaaccacgtccgtggacggggacccgacgggaccaccgggaccgttactagtttacgttgttgtagtaggttagtttagtggtcgtagtcgggtcgttggggtaacggtacgaggtactacgtacggtcgggggaccgtaaacccggggg

SEQ ID NO: 320792 - DNA, 661 bp, Homo sapiens
  misc_feature: GZ8MTXP02HMDVQ.19.67.G01.1.454.CMB.2.raw
  modified_base (208)..(208): a, c, t, g, unknown or other
  misc_feature (208)..(208): n is a, c, g, or t
  modified_base (236)..(236): a, c, t, g, unknown or other
  misc_feature (236)..(236): n is a, c, g, or t
  modified_base (284)..(284): a, c, t, g, unknown or other
  misc_feature (284)..(284): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctggcggggacatcgtgatcgacccagtacccagactcactggctgtgtctcgtgggcgagacgccanaatcaactgcaggtccagccagaacctntttccaccacctacaagaaacaaaacttctagcctagaaccaacaganaccaggacacgtcctaccgtaaagttcgactactaatttacgcgggtactttccgtaacgcgtacgtaacgttccggggtccctgaccccggacgttccggggcacggtcggtcgtgggactagtacttccaccgtcctacaccataccgagtaccagccgtacgacgtacgggctaagggaaagagttgggacgtactttaaggttttactaacgttgtacctaagtaccttaaatttttactttccttaacgtcccgtttacccggtaggggtacccttacgggtaccggaaacggggtaccggttaaacgggtcggtaaaaatcccgaaaaggtacccaaaggttcgtacggctacactaccgatttacgtccg

SEQ ID NO: 320793 - DNA, 561 bp, Homo sapiens
  misc_feature: GZ8MTXP02H1GWQ.19.67.G01.1.454.CMB.2.raw
  modified_base (240)..(240): a, c, t, g, unknown or other
  misc_feature (240)..(240): n is a, c, g, or t
  modified_base (263)..(263): a, c, t, g, unknown or other
  misc_feature (263)..(263): n is a, c, g, or t
  modified_base (332)..(332): a, c, t, g, unknown or other
  misc_feature (332)..(332): n is a, c, g, or t
  modified_base (423)..(423): a, c, t, g, unknown or other
  misc_feature (423)..(423): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctcgtggcgagacggccacaaatcaactgcaggtccagccaagaacattttcnccactaccaagaacaaaaacttntagcctaggtaccaacagagaccagacagcctcctaaagttgctcaatttacgtggctttctacgccgngaaacttccggggcccctagaccccgagttccggggcaggcggtctgggcagatttcactctcacatcagcagccctgcagctagaagtangtgactagtttatactgtacagtactaattattttcttatccttcgtagacgttcggaccgtaacgggacctagggtaacggaattaccgaagtaacgaaagttccggtggaccgttcgacaccgaactttcgtcccg

SEQ ID NO: 320794 - DNA, 556 bp, Homo sapiens
  misc_feature: GZ8MTXP02JUUMO.19.67.G01.1.454.CMB.2.raw
  modified_base (303)..(303): a, c, t, g, unknown or other
  misc_feature (303)..(303): n is a, c, g, or t
  modified_base (320)..(320): a, c, t, g, unknown or other
  misc_feature (320)..(320): n is a, c, g, or t
  modified_base (461)..(461): a, c, t, g, unknown or other
  misc_feature (461)..(461): n is a, c, g, or t
  modified_base (465)..(465): a, c, t, g, unknown or other
  misc_feature (465)..(465): n is a, c, g, or t
  modified_base (507)..(507): a, c, t, g, unknown or other
  misc_feature (507)..(507): n is a, c, g, or t
tcagtactctcgtgcacgaccggtgctcgatttagagtatacatattgggtttgggggggagaggagcccagcactgggattccgaggtgtttccattcggtgctcagcgactgaacacagaggactcaccatggagttttggctgacctgggttttcctgctgcaatttcaggaggtgtccagtgtgaggtgcaactggtggagactgggcggaggcttggtccagccgtgggcgtctctgagactgtcctgtcgaaccctgtggggtctccgtcagcagcgactgtattcgcctgggtccncaggctccgagggaagnggccggaggtcgggtcgcgtaggttatttttagagggtgggaccgtactagttcgtacgggagactcagtgggagggccgtattcgactatctccgagtagtacttttcacaagaacacactgtctcttacaaatgaaacngcgnggacggacgagacgacgctatattgtgtgtagagtagttagnggcgtagtcggcgtgggaacgagagacgtcgacggtcgggaccgacggg

SEQ ID NO: 320795 - DNA, 676 bp, Homo sapiens
  misc_feature: GZ8MTXP02FKLCP.19.67.G01.1.454.CMB.2.raw
  modified_base (323)..(323): a, c, t, g, unknown or other
  misc_feature (323)..(323): n is a, c, g, or t
tcagtactctcgtgcacgaccggtgctcgatttagagtatacatattgggtttggggggagaggagcccagcactgggattccgaggtgtttccattcggtgctcagcactgaacacagagaactcaccatggagttttggctgacctgggttttccttgctgcaatttcaggaggtgtccagtgtgaggtgcaacgtggtggagacgtgggcggaggcttggtccaggccgtggggcggtctcgtgagactgtccctgtcgaaccctgtggggtctccgtcagcagcgactgtattgccgtggtccgcaggctcgagggagnggcggagtgggcgcgtaggttattttagaggtggaccgactattcacggagacctcagtgggacggtccgattaccgaccatccgtaccaggtacgttaccttttcactaacgaaaccaactactacgttccttacttaacctaaaagttacgaaactacggacccgttagggaaccggggacccggaaacgggacccgaaccgggtccccggttacttaagtttagtttaggtaggttacgggtaaggttaggtttttaacggacgggtacggtaagtcgggacgtttaggggtaacgggtaaaccagggtaaccgtcgtacgggtaccgggggacccgtaaaacccggggg

SEQ ID NO: 320796 - DNA, 632 bp, Homo sapiens
  misc_feature: GZ8MTXP02HYZDC.19.67.G01.1.454.CMB.2.raw
  modified_base (194)..(194): a, c, t, g, unknown or other
  misc_feature (194)..(194): n is a, c, g, or t
  modified_base (244)..(244): a, c, t, g, unknown or other
  misc_feature (244)..(244): n is a, c, g, or t
  modified_base (279)..(279): a, c, t, g, unknown or other
  misc_feature (279)..(279): n is a, c, g, or t
  modified_base (395)..(395): a, c, t, g, unknown or other
  misc_feature (395)..(395): n is a, c, g, or t
  modified_base (471)..(471): a, c, t, g, unknown or other
  misc_feature (471)..(471): n is a, c, g, or t
  modified_base (552)..(552): a, c, t, g, unknown or other
  misc_feature (552)..(552): n is a, c, g, or t
tcagtactctcgtgcacgaccggtgctcgatttagagtatacatattgggtttgggggggagaggagcccagcactgggattccgaggtgtttccattcggtgctcagcactgaaacacagaggactcaccatggagttttggctgacctgggttttccttgctgcaatttcaggaggtgtccagtgtgaggtncaacgtggtggagactgggcggaggcttggtccagccgtgggcggtctcngagactgtcctgtcgaccctcgtggggtctccgtnagcagcgactgtagttcgccgtgggtccgccgagggcctaccggaggggaagacgggccggaggtgggtcgcgtaggttatttttagaggtggaccatattcgtacggagactccngtgggacgggccgattccacatcctcagtacgtactttcacaagactacacttgtctacttacaaaattcgaaacngtacccgtaggacggggacccgaagggaccaccgggtcccgtattaagttagtggttagtagggtagttaaggtttacggngggtacgtaggtcggtaggttagggaacggtaacgtacggtacgtaccggtaccgggtaccgggggaacccgtaaccggg

SEQ ID NO: 320797 - DNA, 677 bp, Homo sapiens
  misc_feature: GZ8MTXP02FK5SK.19.67.G01.1.454.CMB.2.raw
  modified_base (280)..(280): a, c, t, g, unknown or other
  misc_feature (280)..(280): n is a, c, g, or t
  modified_base (590)..(590): a, c, t, g, unknown or other
  misc_feature (590)..(590): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttcctgctgcaatttcaggaggtgtccagtgtgaggtgcaactggtggagacgtggcgggaggcttggtccagccgtggggcggtctcgtgagactgtcctgtcgacccgtcgtggggtctccgtnagcagcgactgtattgccgtggtccgcaggcctccgagggaagacggccgaggtgggtcgcgtaggttattttagacgggtggaccatagtacgtacggagactcgagtgggacggcgtacgttccaacgactacctccgaagtacgttacttttacgacaacgaaactaccacttagtccttacgttaacaaattagaaaacacggtaccgtacgggaaacggggtaccggaaacggaaccgtaccggggtacccgttacgtttaagttaagtttcgggtaggttacggtaaacggttaggtttaacgngggggtaacgttaggtcgggtcgtaggggtcggtaaacgacggtaacgtcgtaaccggggtacgggggttacccgaaaacccggggg

SEQ ID NO: 320798 - DNA, 715 bp, Homo sapiens
  misc_feature: GZ8MTXP02FQRSI.19.67.G01.1.454.CMB.2.raw
  modified_base (652)..(652): a, c, t, g, unknown or other
  misc_feature (652)..(652): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggagtgtccagtgtgaggtgcaacgtgggtggagacgtgggcggagcttggtccaggccgtgggcgtctcgtgagactgtcctgtcgtaaccctgtcgggtctccgtcagcagcgactgtatcgccgtcggtccgaccgaggcctaccggaaggggaacggacgggaccgggaggtcggggtccacggttaagggtttaatttttaggtaggggttacggggaacccgtaaccgtagtttccgaaacgggacgtacccgtacccgtagggtcggggaacggggtacccgtactttacccgaaaccctcgttaccctaacccgtaaaggttaaccgtttccctttttaacgacgaaacgtaaaccaccttaacgttcttaccttactaacgtaaaagttcgaaacgtacgccgtagggaacggggccgaacggacgaccggttcgtacttaagttgttagtggagtaagttagtttacggnggtcgttaagcgggtctaggggaagactaagcgtaccgacggtaccggggaccgtaacccggg

SEQ ID NO: 320799 - DNA, 565 bp, Homo sapiens
  misc_feature: GZ8MTXP02HUYQC.19.67.G01.1.454.CMB.2.raw
  modified_base (250)..(250): a, c, t, g, unknown or other
  misc_feature (250)..(250): n is a, c, g, or t
  modified_base (292)..(292): a, c, t, g, unknown or other
  misc_feature (292)..(292): n is a, c, g, or t
  modified_base (329)..(329): a, c, t, g, unknown or other
  misc_feature (329)..(329): n is a, c, g, or t
  modified_base (425)..(425): a, c, t, g, unknown or other
  misc_feature (425)..(425): n is a, c, g, or t
tcagtactctcgtgcacgaccggtgctcgatttagagtatacatattgggtttgggggtagctcaggaagcagagcctggagcatctccactatggcctgggctccactacttctcaccctcctcgctcactgcacaggttcttgggccaactttatgctgactcagccccactctgtgtcggagtctccggggaagacggtaaccatcttttgcaccacaacagtggcaatattgccagctaattttgngcagtggtaccagcagcgccccgggcacgtccccaccattgngatctatgaggataatcaaaagccgtctggggtcccngatcggtctctggctccatcgacagctcctcaactctcgccctccctcacccatctactggctgaagactggagacgaggcagactactactgtcngttacttagtagacgtacggcccgtcgggtactagttcgtgggttccgtttacggggcgggaacgggtaccgaaagtccgacggtacccgtaccgtaacgggttcgacgacccgtaacgggtcctccggtcccccgtcgg

SEQ ID NO: 320800 - DNA, 702 bp, Homo sapiens
  misc_feature: GZ8MTXP02GJT7P.19.67.G01.1.454.CMB.2.raw
  modified_base (439)..(439): a, c, t, g, unknown or other
  misc_feature (439)..(439): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggagtgtccagtgtgaggtgcaactggtggagacgtggcggaggcttggtccagccgtgggcgtctctgagactgtcctgtcgacctcgtgggtctcgtcagcagcgactgtattgccgtgggtccgccgaggcctaccgaaggggaagagggccggaggtgggtcgcgtaggttattttagagggtcggacgactagttcgaacggagactcgagtcgggacggggtccgtattaccacctatccctaccagtacgttacttttacncgaaacgtaaacacctacgttacgttcttacttaactaaaacgttacgaaaccgacggtaccgtagggaacggggacccggaacggaaccgtaccgggtcccgttaacgtttagttaagtttggtagttacgggtaaggtttaaagggttttacggttacggggtcggtaaacggtttcggggtcggtttacggggtaagggtaacgaacggttacggttacccggacggggtttaccgggggacccgttaaaaccccggggg

SEQ ID NO: 320801 - DNA, 666 bp, Homo sapiens
  misc_feature: GZ8MTXP02GV791.19.67.G01.1.454.CMB.2.raw
  modified_base (299)..(299): a, c, t, g, unknown or other
  misc_feature (299)..(299): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagccgtgggcggttctctgagactgtcctgtgaaccctctggggtctccgtcagcagcgactgtatgcctggtccnccaggcctccgagggaagaggccggagtgggtcgcaggtatttttagagggtggaccgactattcgtacggagacctccagtcgggagggccgattccgaccatcctacccagtacgtacctttttcgcaacgaacacctactcgttctacttactaaaattacggaaacacgtacctacgggacgggggaccccgagggaacccgaccgggtcccgttaccgttaagttaagtttggtaggttaggaggtttaacggtttaacgttgggtaccggtaacggtttggtaaccggtttggggtaagggaacccgaaggggtaacctttacggaaccggtttacgggggacccgtaaaaccccgggggg

SEQ ID NO: 320802 - DNA, 637 bp, Homo sapiens
  misc_feature: GZ8MTXP02FUXGD.19.67.G01.1.454.CMB.2.raw
tcagtactctcgtgcacgaccggtgctcgatttagagtatacatattgggtttggggggagaggagcccagcactgggattccgaggtgtttccattcggtgctcagcactgaacacagaggactcaccatggtagtttggctgaccgttgggttttccttgctgctaatttcgaggaggtgtccagtgtgaggtgcaacgtgggtggagacgtgggcggaggtcttggtccaggtccgtgggcgtctcgtgagctgtctgtacgacctcgtgggtctccgtcagcagcgactgtatcgccgtggtccgccgaggctaccgaaggggaagacgggccggaggtcggggtcgacgtaggttattttagtagggtggaccgtactattcgtacggacgtactaccgtagtgggacgggcgtactcaccgatccgtaccagtacgttacctttactacgaacgtaaaccacctaacgttcgttccttacttacaaaacgttacgaaactacgtccgtaggaacggggacgaacggacgaccggtccgtacgtattagttgtgtagtagtagttagtcggtagtagtcggtcgtgggtaagacgaagtacgtacgtaacggtcggggaccgtaaacccggg

SEQ ID NO: 320803 - DNA, 647 bp, Homo sapiens
  misc_feature: GZ8MTXP02JA6RN.19.67.G01.1.454.CMB.2.raw
  modified_base (276)..(276): a, c, t, g, unknown or other
  misc_feature (276)..(276): n is a, c, g, or t
  modified_base (300)..(300): a, c, t, g, unknown or other
  misc_feature (300)..(300): n is a, c, g, or t
  modified_base (472)..(472): a, c, t, g, unknown or other
  misc_feature (472)..(472): n is a, c, g, or t
  modified_base (584)..(584): a, c, t, g, unknown or other
  misc_feature (584)..(584): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtcgcaactgggtggagactgggcggaggcttggtccagcctggggcgtctctgagactgtcctgtcgaaccctgtgggtctcgtcngcagcgactgtatcgcctgggccncaggctaccgaggggagcgggccgaggtcgggtcactagggtttattttagaggggtcggaccactagttcgtaacggggataccttcgagttcggggaacggggccctaattccaacctatcctaccgagtacgtacttttcacaagtaacacctacgtgttcctacttanaaaacgttcggaaaacctcggtaccgtaggaacgggggacccaaaggggacccgacgggtacccgttacttagtttaagtttggagttaggaaacggttagttttaacgggnggtacgtagtacggtcgtagggtaacgacgtagtacgtccgacgggtacgggaccgtaacggg

SEQ ID NO: 320804 - DNA, 642 bp, Homo sapiens
  misc_feature: GZ8MTXP02GEFOW.19.67.G01.1.454.CMB.2.raw
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtgggcgggaggcttgggtccagccgtgggcggtctctgagactgtcctgtgaaccctcgtgggtctccgtcagcagcgactgtatgccgtgggtccgccgaggctccgaggggaagagggccgggaggtgggtcgcgtaggttatttttagaggggtgggacgtactagttcgtaacggagtacctccgaagtggggacggggccgtagttccaccgtactcgtacccagtaacgtacttttcactacgaacactaccgttgtccttacttaccgtaaattacgaaccacgtccgtaggacggggaccggacggaccgaccggccgttactacgttaagtttcggtgttaggacggttaggtttagtacgggtacgtacgtagggtcggtaggggtaggaccgtaggtacgtccgaacgggttaccggggg

SEQ ID NO: 320805 - DNA, 714 bp, Homo sapiens
  misc_feature: GZ8MTXP02JUYZS.19.67.G01.1.454.CMB.2.raw
tcagtactctcgtgcacgaccggtgctcgatttagagtatacatattggggtttgggggggagaggagcccagcactgggattccgaggtgtttccattcggtgctcagcactgaacacagaggactcaccatggagttttggctgacctgggttttcctgctgcaatttcaggaggtgtccagtgtgaggtgcaacgtggtggagacgtgggcggaggcttggtccaggccgtggggcggttctcgtggagactgtcctgtcgaaccctcgtggggtctccgtcagcagcgactgtatgctggtccgcaggctcgagggagaggcggagtgggcgcgtaggttattttagaggtggaccgactagttcgtacgggagactcgagtcgggaggggccgtattccaacccgtatcccgtaccgaacgtacgttacttttccgacgtaaacgaaactacctacgttcgtaccttactttaacaaaagttacgaaaccgtacggtcccgggtagggaaccgggggtacccgaacggggtaacccggtaccggggtacccggttaccgttaagtttaagtttgggttaggttacgggtaagggttaggttttaaacggtggggtaccggtaggttacggggtccgttagggggtaacgggaaaccgtaaggtaccggtccggtaaccggggttcggggggaacccgtaaacccggggg

SEQ ID NO: 320806 - DNA, 567 bp, Homo sapiens
  misc_feature: GZ8MTXP02IADPD.19.67.G01.1.454.CMB.2.raw
  modified_base (244)..(244): a, c, t, g, unknown or other
  misc_feature (244)..(244): n is a, c, g, or t
  modified_base (281)..(281): a, c, t, g, unknown or other
  misc_feature (281)..(281): n is a, c, g, or t
  modified_base (344)..(344): a, c, t, g, unknown or other
  misc_feature (344)..(344): n is a, c, g, or t
  modified_base (411)..(411): a, c, t, g, unknown or other
  misc_feature (411)..(411): n is a, c, g, or t
  modified_base (443)..(443): a, c, t, g, unknown or other
  misc_feature (443)..(443): n is a, c, g, or t
  modified_base (534)..(534): a, c, t, g, unknown or other
  misc_feature (534)..(534): n is a, c, g, or t
  modified_base (540)..(540): a, c, t, g, unknown or other
  misc_feature (540)..(540): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggagtgtccagtgtgaggtgcaacgtggtggagactgggcggaggcttggtccagccgtgggcggtctntgagtactgtcctgtcgaaccctgtggggtctccgtnagcagcgactgtatgccgtggtccgccaggctaccgagggaacggaggccgggagtgggtccngtaaggtatttttagagggtggacgtactagtctaggactctacagtgggacggcattcacaactcnccagtactactttcacaacgaactacaacttntatacctttacaaatcgaaactcggactcggaagggaccgaaggaaccgcggaccgttactatttaagtgtaggtgaactaggtttagcgngagtgngtggtacgacgagatacgtacgtcggg

SEQ ID NO: 320807 - DNA, 706 bp, Homo sapiens
  misc_feature: GZ8MTXP02IIEBL.19.67.G01.1.454.CMB.2.raw
  modified_base (240)..(240): a, c, t, g, unknown or other
  misc_feature (240)..(240): n is a, c, g, or t
  modified_base (309)..(309): a, c, t, g, unknown or other
  misc_feature (309)..(309): n is a, c, g, or t
  modified_base (312)..(312): a, c, t, g, unknown or other
  misc_feature (312)..(312): n is a, c, g, or t
  modified_base (321)..(321): a, c, t, g, unknown or other
  misc_feature (321)..(321): n is a, c, g, or t
  modified_base (380)..(380): a, c, t, g, unknown or other
  misc_feature (380)..(380): n is a, c, g, or t
  modified_base (392)..(392): a, c, t, g, unknown or other
  misc_feature (392)..(392): n is a, c, g, or t
  modified_base (400)..(400): a, c, t, g, unknown or other
  misc_feature (400)..(400): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctcgtgggcgagacggccaacaatcaactgcaggtccagccagactattttcnccacctaccaaagaaacaaaacttctagcctagtaccaacagacgaaccaggacacgcctactaagttnctntatttacgnggtcttacgtcgcgtacgtaacgttccggggtaccctgaccccgtacgttcccgggganacggtcgggtcncggggacngtactttcaccttctacaccatccagtcccagtccgtcgcgacgggtctaaggaaaagtgttcgggtggtacgtttaaagtttttaacgttaccgttggtaccctaaggtaaccttaaatttttactttttacccttaacggttcccccgtttccggggttacggtaccgggtttaccccggaaaccggggtaaaacgggtcccggtaaaggggggttaaacgaaaacgttaccggaaaacgggtaaacccggtaagtcggggtcggttaacgaccgtacctaaaccccggttactttaccggtcg

SEQ ID NO: 320808 - DNA, 752 bp, Homo sapiens
  misc_feature: GZ8MTXP02GRVDX.19.67.G01.1.454.CMB.2.raw
  modified_base (313)..(313): a, c, t, g, unknown or other
  misc_feature (313)..(313): n is a, c, g, or t
  modified_base (334)..(334): a, c, t, g, unknown or other
  misc_feature (334)..(334): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttcctgctgctaatttcaggaggtgtccagtgtgaggtgcaacgtggtggagacgtgggcggaggcttgggtccaggccgtggggcggtctcgtgagacttgtcctgtcgaaccctgtcggggtcctccgtcagcagcgtactgtatcgccgtgggccncgaggctacggaggggaacgngggccggaggtgggtcgcgttaggtttattttaggaggggtcggaaccgtactgttacgaacgggataccgtcgagggtcggggacgggtacccgtattcccgaacctacgttcccgtaaccgtacggtaactttaccgttttaccgaccaaacggtaaaccctacctaacgttccgttaccttaccgttaactaaaagttccgaaaccgtacggtacccggtaggggacgggggtacccggaaacggggacccgtaccggggttcccgttaatttaagtttaggttgggttacggttaacggtagggtttaaaggtttcggtacgggaccgttagggttccgggtacggttaggggtaacggtaacgtacggtacgttaccggaccgggggtacggggtacccggtaaacccggggg

SEQ ID NO: 320809 - DNA, 663 bp, Homo sapiens
  misc_feature: GZ8MTXP02IW6O1.19.67.G01.1.454.CMB.2.raw
  modified_base (195)..(195): a, c, t, g, unknown or other
  misc_feature (195)..(195): n is a, c, g, or t
  modified_base (241)..(241): a, c, t, g, unknown or other
  misc_feature (241)..(241): n is a, c, g, or t
  modified_base (275)..(275): a, c, t, g, unknown or other
  misc_feature (275)..(275): n is a, c, g, or t
  modified_base (301)..(301): a, c, t, g, unknown or other
  misc_feature (301)..(301): n is a, c, g, or t
  modified_base (483)..(483): a, c, t, g, unknown or other
  misc_feature (483)..(483): n is a, c, g, or t
  modified_base (494)..(494): a, c, t, g, unknown or other
  misc_feature (494)..(494): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgctaatttcaggaggtgtccagtgtgaggtncaagtggtggagacgtgggcggaggcttggtccagccgtgggcgtntactgagctgtcctgtcgaccctgtgggtctcgnagcagcgatgtatcgccgtggtcccncgaggcctcggaaggggaagacgggccggaggtcggggtcgtacgtaggtttatttttagagggtaggggaaccatagttacgacgggacgtaccgtcgaggtcggggaacgggtccgtattacccacgaattccctaccgaagtacgtacttttcagaacgaacactactcgttctactanaaatcgaaacncgtacgaggacgggaccggaacggaccgtaaccgggcccgtttaagttagttaacgtttggtagtaaggtaaggtttacgttacggtggaacgttcgtgggtccgttaagggtaaccggacgaaggttaccgtaagtaccgggtacgggggtaacccgtaaaccggggg

SEQ ID NO: 320810 - DNA, 668 bp, Homo sapiens
  misc_feature: GZ8MTXP02H3J19.19.67.G01.1.454.CMB.2.raw
tcagtactctcgtgcacgaccggtgctcgatttagagtatacatattgggtttggggggagaggagcccagcactgggattccgaggtgtttccattcggtgctcagcactgaacacagaggactcaccatggagttttggctgaccttgggttttccttgctgcaatttcaggaggtgtccagtgtgaggtgcaactggtggagacgtgggcggaggcttggtccagccgtgggcgtctcgtgagactgtcctgtcgaccctcgtgggtctccgtcagcagcgactgtattgccgtgggtccgccgacggctccgaaggggaacggaggccgggagtgggtcgcgtaggtatttttagaggtggaccgatattcgtacggagactccagtgggaggccgtattccgaccatcctaccagagtacgttttcacgaacgaactacctactcgtccttacgttacaaaagttacgaaaccgagtaccctagggacggggacccgaacgggtaaccggaccgggtcccgttacgttaagtttagttaggttagtaggtaaggttaggttttagtacgggggtaccgtaaggttcggggtacgttcgggggttaacggaaccgtaaggtacgtaccggtacggttccgggggaacccggtaaaccccggggg

SEQ ID NO: 320811 - DNA, 616 bp, Homo sapiens
  misc_feature: GZ8MTXP02HPKLP.19.67.G01.1.454.CMB.2.raw
  modified_base (375)..(375): a, c, t, g, unknown or other
  misc_feature (375)..(375): n is a, c, g, or t
  modified_base (438)..(438): a, c, t, g, unknown or other
  misc_feature (438)..(438): n is a, c, g, or t
  modified_base (570)..(570): a, c, t, g, unknown or other
  misc_feature (570)..(570): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtggcggaggcttggtccagccgtgggcggtctctgagactgtctgtcgaccctgtgggtctccgtcagcagcgactgtatgcctgggtccgccaggctccgagggacgagggccggaggtgggtcgcgtaggttatttttagagggtggaccgacgatttcacgganacctccaggtgggacggggtccaagtttccaacctatccgtacccgagtacgttacttttacncgaagtaaaccactaactcgttcttacttaccaaaagttcgaaacacggaccgttgggacggggaccgacgggaccgacgggtcccgttataagtttagttagtgtaggtagttagtttacgtgggcttagngtacgtggtaaggacgagtctacgaccggtaggggactaaccgggg

SEQ ID NO: 320812 - DNA, 579 bp, Homo sapiens
  misc_feature: GZ8MTXP02HCGO9.19.67.G01.1.454.CMB.2.raw
  modified_base (371)..(371): a, c, t, g, unknown or other
  misc_feature (371)..(371): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccaggcctgggcggtctctgagactgtcctgtgaaccctcgtggggtctccgtcagcagcgactgtattgcctgggtccgccaggctccgaggggaagaggccggagtgggtcgctaggtatttttagaggtggaccgacattcacgganactccagtgggacgggccgtattaccatccgtaccagtagttaccttttcacaagaacacactgtctctacaaatgaacagcctggacgggccgtaaggaccgacggccttcgtaattagttgtgtggtagtagtttagcgggacgtagtcggacgtgggtaggaacgaaggtactcgacggtcggggacccgtaaggggtaaccccg

SEQ ID NO: 320813 - DNA, 588 bp, Homo sapiens
  misc_feature: GZ8MTXP02GDR5A.19.67.G01.1.454.CMB.2.raw
  modified_base (240)..(240): a, c, t, g, unknown or other
  misc_feature (240)..(240): n is a, c, g, or t
  modified_base (312)..(312): a, c, t, g, unknown or other
  misc_feature (312)..(312): n is a, c, g, or t
  modified_base (439)..(439): a, c, t, g, unknown or other
  misc_feature (439)..(439): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctggcggggacatcgtgatgacccagtacccagactcactggctgtgtctcgtgggcgagacggccacaatcaactgcaggtccagccagaactatttcnccacctcaagaacaaaactctagcctggtaccaacagagaccaggacagcctacctaagttgctcatttacngggctttctacgcgacgaagttccggggtccctggacccccgtagttcccggggcaggccggggtctggggactagtatttccacgttcctacaacccatcaagcagccctgccaggcctagaacgntagtggactagtttatactgtacagtcaaattattttctatcccgtacgtggtaccgttcggaccgtaaggggaccgtaggggtaacgggaaaacttcgaaacggaacgtaacgtggtacggtcgtacggacctaccgtacttcgttcg

SEQ ID NO: 320814 - DNA, 598 bp, Homo sapiens
  misc_feature: GZ8MTXP02FM1MR.19.67.G01.1.454.CMB.2.raw
  modified_base (278)..(278): a, c, t, g, unknown or other
  misc_feature (278)..(278): n is a, c, g, or t
  modified_base (303)..(303): a, c, t, g, unknown or other
  misc_feature (303)..(303): n is a, c, g, or t
  modified_base (320)..(320): a, c, t, g, unknown or other
  misc_feature (320)..(320): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttcctgctgcaatttcaggaggtgtccagtgtgaggtgcaactgggtggagactgggcggaggcttggccaggcctggggcggtctctgagactgtcctgtcgaaccctcgtggggtctccgtnagcagcgactgtatgcctgggtccnctaggctcgagggaagnggcggagtgggcgcgtaggttattttagaggggtggaccgtatattcgtacggagacctccgagtgggacggggccgaatttccaacctagtccctaccgagacgttacttttcacaagaaacactactcgtctactacaaaattcgaaacacgccgtgggaacgggccgaaggaccgaccggtccgtacttattagttggtagtagtaggtagtttagagggtctagtggcgtgggaaggtacagtactccgaacggtcgggggacctaaaccgggg

SEQ ID NO: 320815 - DNA, 1047 bp, Homo sapiens
  misc_feature: GZ8MTXP02JXE70.19.67.G01.1.454.CMB.2.raw
tcagtactctcgtgcacgaccggtgctcgatttagagtatacatattggggtttgggggggagaggagcccagcactgggattccgaggtgtttccattcggtgctcagcactgaacacagaggactcaccatggtagttttggctgaccttgggttttccttgctgctaatttcgaggaggtgtccagtgtggaggtgacaacgtggtggagacgtgggcgggaggtcgttggtccgaggtcccgtgggggccggttctcgtggagtactcgtccgtgtaccgtaaccccgttcggttcggggtccctccggtacaggtcagcgtattgtagttcggccgtcggggtcccgccgacggtccgtaccggaaggggaacggcggggtccggggtaaggtcggggtcgtacggttaagggtttttaagttttttaacgggtagggggttaggggtaacccccgtaaacgttaacgtttttaccccggtaaacggggtaaccggtaaccctttacccgggaaggggtttccggggggaaaccgggggttacccccggttaaacgtttacccccgaaaccccgttacgtttacccccgttaacccccgtaagggttaaaccgttttaacccccgttttttaacctaaccgtaaaaccgtaaacccttaaccccgtaaacgtttttacccggtttacccttttacccttaaaaacgttaaaacgttaaacccggtaaaaccgtaacccgggttaccccgggttaaacgggggaaaccccggggggtaacccccggtaaaccggggtaaaccccggttaaacccccgggttttacccgtttttaaacccgtttttaaggtttttaaccgttttacgggtttagggtttaaacgggttaagggtttttaaaccgggttttacggggtaccggggttaacggtttacgggttacggggttccgggttagggggttaacgggaaacccgtaaggtaaccggtacccgggtacccgggggtttaaccggggggaaaccccggttaaaccccgggggg

SEQ ID NO: 320816 - DNA, 623 bp, Homo sapiens
  misc_feature: GZ8MTXP02GXWFH.19.67.G01.1.454.CMB.2.raw
  modified_base (333)..(333): a, c, t, g, unknown or other
  misc_feature (333)..(333): n is a, c, g, or t
  modified_base (542)..(542): a, c, t, g, unknown or other
  misc_feature (542)..(542): n is a, c, g, or t
  modified_base (571)..(571): a, c, t, g, unknown or other
  misc_feature (571)..(571): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttcctgctgcaatttcaggaggtgtccagtgtgaggtgcaactggtggagacgtgggcggaggcttggtccagccgtgggcgtctctgagactgtcctgtcgaaccctcgtgggtctccgtcagcagcgactgttacttgccgtgggtcccgccgaggtccgtaccgaaggggaacggngggcccgggaggtcggggtcgcgtagggtttaatttttaggaggggtggaaccgtactatttcgtaacggagacctcgaggtgggacgggccgtattccgaacctatccctacgaagtaacgttactttcgacaacgaaactactactgtacctactaactaaaatgaaacacgtccgtagggacgggaccgacgacgaccggtccgtnttaagttagtgtagtagagttagtttagnggacgtagtcggcgtaggtgacgtagactcgacggtcgggacgtaaccgggg

SEQ ID NO: 320817 - DNA, 644 bp, Homo sapiens
  misc_feature: GZ8MTXP02FOOSR.19.67.G01.1.454.CMB.2.raw
  modified_base (502)..(502): a, c, t, g, unknown or other
  misc_feature (502)..(502): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgcaagtggtggagacgtgggcggaggtcttcgggtccaggtccgtgggggcgtctcgtaggagtactcggtcctggtcgtaaccctggtggggtcctccgtcagcgagcgtacttgtattcggccgtggtccccgcaggcctaccggagggaacgcgggccggaggtcgggtcgcgtaaggtttatttaggtaggggtacggaccgtactagttacgtacggacgtacctcgagtgggacgggtcctacgttccaacgtatccctacgaggtacttactttcactaacgaacacgtatcgttctactanaaacgtcgaaacgtcgccgtacgggaacgggccgaacgggtaccacggggtcccttattagttagtgtagtggtaaggttagttagcggtacgtagtcggtgtgggtaacgagtaagcgtacgacggtcgggacgtaaccgg

SEQ ID NO: 320818 - DNA, 608 bp, Homo sapiens
  misc_feature: GZ8MTXP02FQ0C7.19.67.G01.1.454.CMB.2.raw
  modified_base (389)..(389): a, c, t, g, unknown or other
  misc_feature (389)..(389): n is a, c, g, or t
  modified_base (491)..(491): a, c, t, g, unknown or other
  misc_feature (491)..(491): n is a, c, g, or t
  modified_base (566)..(566): a, c, t, g, unknown or other
  misc_feature (566)..(566): n is a, c, g, or t
  modified_base (574)..(574): a, c, t, g, unknown or other
  misc_feature (574)..(574): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttcctgctgcaatttcaggaggtgtccagtgtgaggtgcaactggtggagactgggcggaggcttggtccaggccgtgggcggtctctgagactgtcctgtcgaccctgtgggtctccgtcagcagcgactgtatgcctgggtccgccgaggcctaccgaggggaacgaggcccgggtaggtggggtcgacgtaggttatttttaggagggtgggacgatattcgtacgganctccgagtgggacggtccgtattccgaacctactctacccgagtacgttacttttcacgaacgtaaaccactacttgtccttacgttaacaaagtcgaaacncgaccgtggacgggtccgaggaccgtacggccgttacttagttagttggtgtagtaaggttagttagtcggacgngttcgggngtagggtacgacgtagtacgtcgtacgggtcggg

SEQ ID NO: 320819 - DNA, 789 bp, Homo sapiens
  misc_feature: GZ8MTXP02FLYIM.19.67.G01.1.454.CMB.2.raw
tcagtactctcgtgcacgaccggtgctcgatttagagtatacatattggggtttggggggagaggagcccagcactgggattccgaggtgtttccattcggtgctcagcactgaacacagaggactcaccatggagttttggctgacctgggttttcctgctgcaatttcaggaggtgtccagtgtgaggtgcaacgtgggtggagacgtgggcggaggcttggtccaggccgtggggcgtctctgagctgtcctgtcgaccctgtcgggtctccgcagcagcgactgtatcggccgtgggtcccgccgaggcctccggaaggggaacggacggggccggggtaggtggggtccgtacggttaagggtttaagtttttaaggtaggggttacggggaacccgtaacgtacgtttacgtaacggggacgtaaccgtaccgtagggtcgggggaacggggtaccgtaacgttacccaaccgtacttccctacccgtaggtaaccgtttaccttttaccgacgaaacgtaaaccaaccctacgttacgttaccttaaccgttaactaaaaacgtacggaaaacctacggtacccgttaagggggaaccgggggtacccggaaaccgggaacccggtaacccggggtcccggttaactttaacggtttaacgtttgggtagttagggtaaggttacggttttaggtaccgggtacggtagttcggggcggtttaggggaacggaacgtaaggtacgtacggtaacggggccgggggtaaccgtaaacccgggg

SEQ ID NO: 320820 - DNA, 674 bp, Homo sapiens
  misc_feature: GZ8MTXP02FFF5O.19.67.G01.1.454.CMB.2.raw
  modified_base (261)..(261): a, c, t, g, unknown or other
  misc_feature (261)..(261): n is a, c, g, or t
  modified_base (301)..(301): a, c, t, g, unknown or other
  misc_feature (301)..(301): n is a, c, g, or t
  modified_base (336)..(336): a, c, t, g, unknown or other
  misc_feature (336)..(336): n is a, c, g, or t
  modified_base (374)..(374): a, c, t, g, unknown or other
  misc_feature (374)..(374): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtgagactggcggagcttggtccagccgtgggcggtctctgagactgtcctgtcgaaccctntggggtctccgtcagcagcgactgtattcgcctgggtccncaggcctccgagggagacggccggagtcggggtcncgtaggttatttagaggtgggaccactatcgtacgganaccttcagtggggacgggtccgtattccaccgtacttacctacccgaaggtacgtaccctttttaccgacaaacggtaaacccacctaccgttacggttcttacccgttttaacaaaacgttcgaaaacctcggtaccccgtagggaccgggggaccgaacgggtaccgaccgggtaccgttacttagttacgttgtaggtagtaggttagtttagacgggtacgtaagtcgggtacgttgggtaaggggaactaacgggtacttccggaacgggttcgggggacccgtaaacccggggg

SEQ ID NO: 320821 - DNA, 559 bp, Homo sapiens
  misc_feature: GZ8MTXP02JJMVM.19.67.G01.1.454.CMB.2.raw
  modified_base (299)..(299): a, c, t, g, unknown or other
  misc_feature (299)..(299): n is a, c, g, or t
  modified_base (326)..(326): a, c, t, g, unknown or other
  misc_feature (326)..(326): n is a, c, g, or t
tcagtactctcgtgcacgaccggtgctcgatttagagtatacatattgggtttgagggggagaggagcccagcactgggattccgaggtgtttccattcggtgctcagcactgaacacagaggactcaccatggagttttggctgacctgggttttcctgctgcaatttcaggagtgtccagtgtgagtgcaatggtgagactggcggagcttggtccagccgtggggcggtctcgtgagacttggtcctgtcgaccctcgtggggtctccgtcagccagcgactgtatgcctggtccncagctcgaggagaggccgagtgggtcncgtagttattttagaggtcggtacactagttactagggacgactccgagtggggacggggtacccagttaccaccgtatctacccaggactacttttcacagaacacacttcgtactcttacaaagttcgaactacgcgtgacggcccgaggaccacggtcgtactattagtgtcgtagagtacggtttagcgggtcacgtgtgtaaggcgacgacgacgtcgacgtcggacg

SEQ ID NO: 320822 - DNA, 601 bp, Homo sapiens
  misc_feature: GZ8MTXP02FS9HB.19.67.G01.1.454.CMB.2.raw
  modified_base (306)..(306): a, c, t, g, unknown or other
  misc_feature (306)..(306): n is a, c, g, or t
  modified_base (325)..(325): a, c, t, g, unknown or other
  misc_feature (325)..(325): n is a, c, g, or t
  modified_base (367)..(367): a, c, t, g, unknown or other
  misc_feature (367)..(367): n is a, c, g, or t
  modified_base (377)..(377): a, c, t, g, unknown or other
  misc_feature (377)..(377): n is a, c, g, or t
  modified_base (382)..(382): a, c, t, g, unknown or other
  misc_feature (382)..(382): n is a, c, g, or t
  modified_base (397)..(397): a, c, t, g, unknown or other
  misc_feature (397)..(397): n is a, c, g, or t
  modified_base (426)..(426): a, c, t, g, unknown or other
  misc_feature (426)..(426): n is a, c, g, or t
  modified_base (549)..(549): a, c, t, g, unknown or other
  misc_feature (549)..(549): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgctaatttcaggaggtgtccagtgtgaggtgcaacgtgggtggagacgtgggcggaggcttggtccaggccgtgggcgtctctgagctgtcctgtcgaccgtcgtggggtctccgtcagcagcgactgtattgccgtggtccncgaggctccgagggaacgnggccggagtcgggcgcgtaggtttatttagagggtggaccanactcgacggnactcngtgggcggcatcacntctaccagtactactttcactagaccacnctgtcctactacaaagtcgaacacgccgtgggaaccggggtaccgaacgggaccgaccgggtaccgttacgttagtttagttggtaggtaggtagttagtttacggtgggtactagggtcggngttaggtgggaacgtacggacgttcgacggtacggggaccgtaaacccgggg

SEQ ID NO: 320823 - DNA, 604 bp, Homo sapiens
  misc_feature: GZ8MTXP02H2U1Z.19.67.G01.1.454.CMB.2.raw
  modified_base (275)..(275): a, c, t, g, unknown or other
  misc_feature (275)..(275): n is a, c, g, or t
  modified_base (301)..(301): a, c, t, g, unknown or other
  misc_feature (301)..(301): n is a, c, g, or t
  modified_base (376)..(376): a, c, t, g, unknown or other
  misc_feature (376)..(376): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagccgtgggcgtctctgagtactgtcctgtcgaaccctgtgggtctccgtnagcagcgactgtatgccgtgggtccncaggctccgaaggggagaggccggaggtgggtcgcgtaggtttatttttagagggtggaccactattcgtacggngtacctcagtgggacgggccgattccacgtatcctaccagacgtactttcgactaagaaacacacttgtcctacttacaaaatgaaaccaggtacccgtggaacgggccggaaggaccgacgggccgttcgtaattagttggttagtggtaagtaggtttacgtggacgtagtgggtacttaggggaaggactaaggactaccgtagggtcggggaacctaacggggg

SEQ ID NO: 320824 - DNA, 633 bp, Homo sapiens
  misc_feature: GZ8MTXP02F1D63.19.67.G01.1.454.CMB.2.raw
  modified_base (304)..(304): a, c, t, g, unknown or other
  misc_feature (304)..(304): n is a, c, g, or t
  modified_base (320)..(320): a, c, t, g, unknown or other
  misc_feature (320)..(320): n is a, c, g, or t
  modified_base (361)..(361): a, c, t, g, unknown or other
  misc_feature (361)..(361): n is a, c, g, or t
  modified_base (426)..(426): a, c, t, g, unknown or other
  misc_feature (426)..(426): n is a, c, g, or t
  modified_base (567)..(567): a, c, t, g, unknown or other
  misc_feature (567)..(567): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttcctgctgcaatttcaggaggtgtccagtgtgaggtgcaactgggtggagactgggcggaggcttggccagcctggggcggtctctgagactggtcctagtcgaaccctcgtggggtctccgtcagcagcgactgtatgcctgggtccncagctccgagggaagnggccggagtgggtcgcgaggttattttagaggtgggaccanattctacggagactccagtcgggagggccgtattcaacctatcctaccgagtacgtacttttacncaagaaacacctaaacgtcgtaccttacttacaaaattcggaaaacacgtcctaggaacggggccgaaggaccgacgggtccgtactaagttagttggtagttagtaggtaagttttaacgtgggtaccgtaagttcgggngtagggggttaaggaaaccgtacgggtaaacttcggaacggttccgggggacgtaaaacccggggg

SEQ ID NO: 320825 - DNA, 618 bp, Homo sapiens
  misc_feature: GZ8MTXP02FT7ND.19.67.G01.1.454.CMB.2.raw
  modified_base (298)..(298): a, c, t, g, unknown or other
  misc_feature (298)..(298): n is a, c, g, or t
  modified_base (383)..(383): a, c, t, g, unknown or other
  misc_feature (383)..(383): n is a, c, g, or t
  modified_base (552)..(552): a, c, t, g, unknown or other
  misc_feature (552)..(552): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttcctgctgcaattcaggaggtgtccagtgtgaggtgcaactgggtggagactgggcggaggcttggtccagcctgggcgtctctgagctgtcctgtcacccgtgtgggtctccgtcagcagcgactgtatcggccgtgggccncgaggcctccggaaggggaacggacggccgggaggtggggtcgcgtaggttattttagaggggtcggacacgtattcgtaagganacctcgagtgggaggccgtattccgacatcctaccgagacgtactttcacgaagaacactacttcgtcttactctaaaagtcgaaacacggtccgagggtaacggggaccgaagggaccgacggtcccgttacgttatttagttggtgtaggtacggtaggtttacggngggtacgagttcggcggttagggaacggtagaacgacgtacgacggtacggggaccgtaaccgggg

SEQ ID NO: 320826 - DNA, 624 bp, Homo sapiens
  misc_feature: GZ8MTXP02IFQ1G.19.67.G01.1.454.CMB.2.raw
  modified_base (276)..(276): a, c, t, g, unknown or other
  misc_feature (276)..(276): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactgggtggagactgggcggaggcttggccaggcctgggcggtctctgagactgtcctgtcgaccctgtggggtctccgtnagcagcgactgtatgccgtgggtccgccaggcctccgaaggggaagacgggccggaggtgggtcgcgtaggttatttttagagggtgggaccgactattcgtacggagtaccgtcaggtcggaggggcccgtattccgacagtcctaccgagacgttacctttctacgaagaaaccactactcgttctacttacaaatacggaaacacggtccgtagggacggggaccggaacggaccgaccgggtcccgttacgttagttagttggtggtagtaagtagtttaagtgggacgtagtcggtgtagggtgacgagtaacgttcgaacggttcgggaccgtaacccgggg

SEQ ID NO: 320827 - DNA, 622 bp, Homo sapiens
  misc_feature: GZ8MTXP02FITQA.19.67.G01.1.454.CMB.2.raw
  modified_base (233)..(233): a, c, t, g, unknown or other
  misc_feature (233)..(233): n is a, c, g, or t
  modified_base (247)..(247): a, c, t, g, unknown or other
  misc_feature (247)..(247): n is a, c, g, or t
  modified_base (293)..(293): a, c, t, g, unknown or other
  misc_feature (293)..(293): n is a, c, g, or t
  modified_base (300)..(300): a, c, t, g, unknown or other
  misc_feature (300)..(300): n is a, c, g, or t
  modified_base (513)..(513): a, c, t, g, unknown or other
  misc_feature (513)..(513): n is a, c, g, or t
tcagtactctcgtgcacgaccggtgctcgatttagagtatacatattgggtttggggggtagctcaggaagcagagcctggagcatctccactatggcctgggctccactacttctcaccctcctcgctcactgcacaggttcttgggccaactttatgctgactcacgccccactctgtgtcggagtcctccggggaagacggtaaccatctttgcaccacacagtgcaacnttgcagcaatttgngcagtgtacagcagccgccggcaccgtcccccactatgtgatctangagatanacgaaagccgtcgtcgggtccctagtagtcggttctcgtccggtctccatcgacacgcctccgtacccaacttcctccgtccctccctaccaaccctacttcctcgtacggaccttagaaacgacgtacggggaacggacggacgggtcctaggaaccttacctaattcggtactacttactttaaagcgtaaagttcggaccggtcgtaccngttcggtcgttcggttcggggaccggaacggtaaccaggtccgtacgtaacccggttcgtaacggtaccaaccggacccggaacgtccgtacccggtcccccgtaccgg

SEQ ID NO: 320828 - DNA, 723 bp, Homo sapiens
  misc_feature: GZ8MTXP02GUWDT.19.67.G01.1.454.CMB.2.raw
  modified_base (310)..(310): a, c, t, g, unknown or other
  misc_feature (310)..(310): n is a, c, g, or t
  modified_base (331)..(331): a, c, t, g, unknown or other
  misc_feature (331)..(331): n is a, c, g, or t
  modified_base (350)..(350): a, c, t, g, unknown or other
  misc_feature (350)..(350): n is a, c, g, or t
tcagtactctcgtgcacgaccggtgctcgatttagagtatacatattggggtttgggggggagaggagcccagcactgggattccgaggtgtttccattcggtgctcagcactgaacacagaggactcaccatggtagttttggctgaccttgggttttccttgctgctaatttcaggaggtgtccagtgtgaggtgcaacgtgggtggagacgtgggcggaggcttggtccaggccgtggggcgtctcgtgagactgtcctgtcgacccgtgtggggtctccgtcagcagcactgtactgccgtggccnccgaggctccgaaggggaagngggaccggagtcggggtcncgtaggttatttttagaggggtggaacccgactagttacgtaacgggactaccttccgaggtcggggacgggggtaccctattcccgaacctaattcccgtacccgaaggttaaccgtttacctttttaccacgaaacggtaaaccacctaacttcggttacctacccttaacaaaaggttcaaaacgtcggtaccgtacgggaaccgggggacccgaacgggaaaccgtacccgggggtaccttacttaagtttacgtggttagttaggaagtttaggttttagaccggggtacgtaagttaccgggtcgttacgggggtgaaaccggaggtacgtaccgtaacggggtcgggggacccgtaaacccggggg

SEQ ID NO: 320829 - DNA, 585 bp, Homo sapiens
  misc_feature: GZ8MTXP02GTOVK.19.67.G01.1.454.CMB.2.raw
  modified_base (267)..(267): a, c, t, g, unknown or other
  misc_feature (267)..(267): n is a, c, g, or t
  modified_base (280)..(280): a, c, t, g, unknown or other
  misc_feature (280)..(280): n is a, c, g, or t
  modified_base (303)..(303): a, c, t, g, unknown or other
  misc_feature (303)..(303): n is a, c, g, or t
  modified_base (321)..(321): a, c, t, g, unknown or other
  misc_feature (321)..(321): n is a, c, g, or t
  modified_base (335)..(335): a, c, t, g, unknown or other
  misc_feature (335)..(335): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctgggcgtcgtctggagacgtgtcctgtgaaccctntggggtctcccgnagcagcgatgtatcgcgtggccncgagtcacgaagggaagnggcggaggtgggcngagttagtttagtacggtaggacgactatacgtacgacgctacagaggacggacgactacacactctacacgactacttactacaacaacaactactactactacttaactaaataagaacgacgtacgtacggacgggacggaacggaaccgaccggtaccgttacgtagttaagttacgtagtagtagtagttacgtacggtacgtagtaggtcgtacggtacggtacgagtacgtacgacggtacgg

SEQ ID NO: 320830 - DNA, 716 bp, Homo sapiens
  misc_feature: GZ8MTXP02FG5PG.19.67.G01.1.454.CMB.2.raw
  modified_base (530)..(530): a, c, t, g, unknown or other
  misc_feature (530)..(530): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtgagactgggcggaggcttggtccagccgtggggcggtctctgagactgtcctgtcgaaccctcgtggggtctccgtcagcagcgactgtattcgccgtgggtccgccgaggcctaccgaaggggaaggacggccgggtaggtggggtcgcgtagggtttatttttagtagggtgggaccgactagttcgtacggagacctccgagtcggggaacggggccgtacttccaacctacgttccctacccgtaaggtaacgttaacctttttccacgtaaacgaaacctacgtaaccttcgttccttactttaccaaaaagttcggaaaaccncggacccgtaggggacgggggtaccggaacgggaaccgtaaccgggtcccgttaacgttatttaggttggtaggttacggtaaggttacgttttaacgcggggtacgtacggttcgggtcggttaggggtaacggaaacgtacggtacgtaccggtacggggtacgggggacccggtaaaccgggg

SEQ ID NO: 320831 - DNA, 717 bp, Homo sapiens
  misc_feature: GZ8MTXP02IHAWQ.19.67.G01.1.454.CMB.2.raw
  modified_base (207)..(207): a, c, t, g, unknown or other
  misc_feature (207)..(207): n is a, c, g, or t
  modified_base (210)..(210): a, c, t, g, unknown or other
  misc_feature (210)..(210): n is a, c, g, or t
  modified_base (331)..(331): a, c, t, g, unknown or other
  misc_feature (331)..(331): n is a, c, g, or t
  modified_base (343)..(343): a, c, t, g, unknown or other
  misc_feature (343)..(343): n is a, c, g, or t
  modified_base (399)..(399): a, c, t, g, unknown or other
  misc_feature (399)..(399): n is a, c, g, or t
  modified_base (450)..(450): a, c, t, g, unknown or other
  misc_feature (450)..(450): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctgcgggacatcgtgatcgacccagtacccagactcactggctgtgtctcgtgggcgagacggccanaanccaactgacaggtaccagaccagtaactcttttccacccaaccgtaccaaaagtaaaactaaaactttctaacgccgttacgaaaccaacgagaacgaccgagaccacgtcctactagtcncctatattacgnggtctttcgacgcgacgtaacggtcccggtacctggaccccgtacggtcccggggntacgggtcgggtacagggaccgtgttactttacccgacctcctacacctancaagtccaacggcctaggacccgtaggtacgttaagaacggttagttggacgtaaacgtttaagtttttacaccgttaggtaccctaagttaaccttaaattttccttttttacaaccgtttcccgtaccgggttaacggtacccggttaaccgaacgggtaaaacgggtaaccgtaaagggttaaaccgaaaactttcccgggaaaaagttccgaaaggttccggtaccggtactcccgtaaaactacccgttacgtttaccgtac

SEQ ID NO: 320832 - DNA, 574 bp, Homo sapiens
  misc_feature: GZ8MTXP02IR8Z3.19.67.G01.1.454.CMB.2.raw
  modified_base (176)..(176): a, c, t, g, unknown or other
  misc_feature (176)..(176): n is a, c, g, or t
  modified_base (262)..(262): a, c, t, g, unknown or other
  misc_feature (262)..(262): n is a, c, g, or t
  modified_base (300)..(300): a, c, t, g, unknown or other
  misc_feature (300)..(300): n is a, c, g, or t
  modified_base (375)..(375): a, c, t, g, unknown or other
  misc_feature (375)..(375): n is a, c, g, or t
  modified_base (512)..(512): a, c, t, g, unknown or other
  misc_feature (512)..(512): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttcctgctgcaatttcaggagtntccagtgtgaggtgcaactggtggagactggcggaggcttgggtccagccgtgggcggtctcgtgagactgtcctgtcgaaccctntggggtctccgtcagcagcgactgtattgcctggtccncaggcctccgaggggaagaggccggagtgggtcgcgtaggtatttttagaggtggaccgactattcgtaacgganacttaccagtggacggccgattcgaccatctcccagacgtactttcactagaacactactgtactcgtacaaatgaacagactgacgggccgacggacgacggtccgtcgtattagttgtgtgtagtagtttaacgnggacgtagtgggtccgtaggtaacgggaacgacgtacgtcgacggtacggggtaccgaacgg

SEQ ID NO: 320833 - DNA, 606 bp, Homo sapiens
  misc_feature: GZ8MTXP02GFX9L.19.67.G01.1.454.CMB.2.raw
  modified_base (306)..(306): a, c, t, g, unknown or other
  misc_feature (306)..(306): n is a, c, g, or t
  modified_base (374)..(374): a, c, t, g, unknown or other
  misc_feature (374)..(374): n is a, c, g, or t
  modified_base (463)..(463): a, c, t, g, unknown or other
  misc_feature (463)..(463): n is a, c, g, or t
  modified_base (536)..(536): a, c, t, g, unknown or other
  misc_feature (536)..(536): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtgggcggaggcttgggtccaggccgtggggcggtctcgtgagactgtcctgtcgaaccctgtggggtctccgtcagcagcgactgtatgcctggtccncagctcgagggagaggccggagtgggtcgcgtaggttatttagaggtggaccactagttcgtacgganacctcgagtgggacgggcctattccacatctaccagtacgttactttcactaagaaccactacttgtacctacttacaaaatcgaaacnggacctagggacggggaccgaacggaccgaccggtcccttagttacgttagttgtgtagtaggtagtttacgnggacgtagtcgggtacgttagggaacggtaacgagtacgtccgacggtaccgggggaccgtaacccgggg

SEQ ID NO: 320834 - DNA, 734 bp, Homo sapiens
  misc_feature: GZ8MTXP02JUFTU.19.67.G01.1.454.CMB.2.raw
tcagtactctcgtgcacgaccggtgctcgatttagagtatacatattgggtttggggtctgggagaggagcccagcactgggattccgaggtgtttccattcggtgctcagcactgaacacagaggactcaccatggagtttggctgacctgggttttcctgctgcaatttcaggagtgtccagtgtgaggtgacaacgtggtggagacgtgggcggaggtcgttggtccagccgtggggccggtctcgtgagtactgtcctgtcgaaccctcgtggggtctccgtcagcagcgactgtatcgccgtggtccgccgaggccgtccgaaggggaaggacgggccgggtaggtgggtacgacgtaaggtttagtttttaggtacggggtcggggaacgtacgtagtttacggtaaacgggacgtaccgtaccgtaaggttacggggacggggcccgtaagttacccgacctaactccgtacccgtaagtacgttaaccttttccgtacgaacgtaaactacctaacttctaccgttaccttaaactaaaagtacgaaacgtaccgtacggtacggaacggggcccgaacgggaaccggtacccgggtacccgttaccggttaatttacggtttaggtacggttaggtaacggtttaagggttttagtacgggtaccggttaggtcggtaacggtggggttacgaccgtaaggaccttacgggtacggacccggggg

SEQ ID NO: 320835 - DNA, 781 bp, Homo sapiens
  misc_feature: GZ8MTXP02HO6E2.19.67.G01.1.454.CMB.2.raw
  modified_base (290)..(290): a, c, t, g, unknown or other
  misc_feature (290)..(290): n is a, c, g, or t
  modified_base (296)..(296): a, c, t, g, unknown or other
  misc_feature (296)..(296): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcgaggaggtgtccagtgtgaggtgcaacgtggtggagacgtgggcggaggtcgttggtccaggccgtggggcggtctcgtgagtactgtcctgtcgaaccctcgtgggtcctccgtnagggancgactgtatgccgtggccgccgaggctccgaagggagacgggcggaggtcggtcgactaggtttatttaggagggtggaaccgtactagttacgacggacgtacgttccgaaggttgggaacgggtcccgtaatttcccgaaacctacgttcctacccgaaaggtaacgttaccctttttacaccgtaaacggaaacctaccgtaacgttcgttaccttacttaaaccgtaaaattcgaaaaccgtacgtacccgttagggaacccggggacccgggaacggaacccggtaacccgggtaccccggtttacttaaacggttttaacgtttacgggttacggttaacggggttaaaggttaaacggtttttaacgggacggggtaaaccggtaacggtttgggggttaaccggtcgggggttaaagggaaccgtaaacggttaacggtttacccgaacgggggtttaaccgggggaaacccccggg

SEQ ID NO: 320836 - DNA, 751 bp, Homo sapiens
  misc_feature: GZ8MTXP02F4NMD.19.67.G01.1.454.CMB.2.raw
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggagtgtccagtgtgaggtgcaacgtgggtggagacgtgggcggaggtcttggtccagccgtgggcggtctcgtgagactgtcctgtcgtaccctcgtgggtctccgtcagcagcgactgtagtcgccgtcggtccgcgaggcctaccggagggaaggcggcggaggtcgggcgacgttaggtttagttttagagggtcggaccgtactagttcgacggacacctacgaggtcgggacggccgtacttccgaactacgtccgtaccgtagtacgttaccttttaccaacgtaaacgtaaacctactacgttacgttaccttaccttaacaaaacgttaccggaaaccgtacggtacccgtacggggaaccggggacccggaaaccgggtaacccggtacccgggtacccgtttaacgtttagtttaacggtttggttacggttaacggttaacgggtttaaggtttttaacggggtagggtaacggttacggttacggggttacggttaggggtaacggtaacggtaacggtaccggttacgggtaccggggtaccgggggtaacccggtaaacccgggg

SEQ ID NO: 320837 - DNA, 543 bp, Homo sapiens
  misc_feature: GZ8MTXP02FTO59.19.67.G01.1.454.CMB.2.raw
  modified_base (272)..(272): a, c, t, g, unknown or other
  misc_feature (272)..(272): n is a, c, g, or t
  modified_base (315)..(315): a, c, t, g, unknown or other
  misc_feature (315)..(315): n is a, c, g, or t
  modified_base (366)..(366): a, c, t, g, unknown or other
  misc_feature (366)..(366): n is a, c, g, or t
  modified_base (403)..(403): a, c, t, g, unknown or other
  misc_feature (403)..(403): n is a, c, g, or t
  modified_base (409)..(409): a, c, t, g, unknown or other
  misc_feature (409)..(409): n is a, c, g, or t
  modified_base (414)..(414): a, c, t, g, unknown or other
  misc_feature (414)..(414): n is a, c, g, or t
  modified_base (429)..(429): a, c, t, g, unknown or other
  misc_feature (429)..(429): n is a, c, g, or t
  modified_base (433)..(433): a, c, t, g, unknown or other
  misc_feature (433)..(433): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttcctgctgcaatttcaggaggtgtccagtgtgaggtgcaactggtgagactggcggaggcttggccagcctgggcggtctctgagactgtcctgtgaaccctcgtggggtctccgtnagcagcgactgtattgcctgggtccgcaggctccaggggaagnggccggagtgggtcgcagggtatttttagaggtggaccgacattcaacggngactcagtgaagggcatcacatctcagagactttcanagaacnctatntactactacaaagtnaaanagcgagaggacgacgacgacgcgtactatatgtgtgtagtagttagtaggacgacgtacggtcgtaggtaaggtaacgtaagacgtacgacggtacggggacggaaccgg

SEQ ID NO: 320838 - DNA, 780 bp, Homo sapiens
  misc_feature: GZ8MTXP02HL1T3.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttcctgctgcaatttcaggaggtgtccagtgtgaggtgcaactggtggagactggcggaggcttggtccagcctgggcgtctctgagactgtcctgtcgaaccctcgtgggtctccgtcagcagcgactgtatcgcctgggtccgcgaggctccgaggggaagacggccggaggtgggtcgcgtaggttatttttagaggggtgggaaccctacgtagtttccgtaacggggacgtaaccgttcccgaggttaccggggaacgggggacccgtacgtttacccgaaccctacggttaccctacccgaaggtaaccggttacctttttacgacctaaacggtaaaaccacctaactttacggttcccttacgttacctaaaagttcgaaaaccgaacggtcccgttaaggggaccggggtacccggaaacggggtaacccgaaacccgggtcccggtttaacttaacgtttaaacgtttggttacgggttacggtaaaaggtttacggttttaaacggtaggggtccggttaacgttccgggtaccggttcggggttaagggtaaccgaaaggggtaaacttccggaaacccgggttacggggggaacccgttaaaaccccgggggg

SEQ ID NO: 320839 - DNA, 662 bp, Homo sapiens
  misc_feature: GZ8MTXP02I9M2F.19.67.G01.1.454.CMB.2.raw
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggtttcctgctgcaatttcaggaggtgtccagtgtgaggtgcaactggtggagacgtgggcggaggcttggtccagccgtgggcgtctctgagctgtcctgtcgaccctgtgggtctccgtcagcagcgactgtatgcctggtccgcaggctaccgaggggaacgagggcccgggaggtcggggtaccgacgtagggtttaatttttagaggggtgggaaccgtaccgtagttaccgaacgggacgtaccgtccgaaggtggggaccggggacccgtaacgtttccacccgtattcctacccgtaaggtacgttacttttactaccgaacggtaaaccacctaacgttgtaccttacttacctaaaagtacgaaactacgaccgtagggaacggggcccgaagggaccgaccggtccgttacttaagttagtttcggtagtgaggttagtttagagggtacgtagtgggtccgtaggggtcgaacgagacgtacgtacggtaccggggg

SEQ ID NO: 320840 - DNA, 558 bp, Homo sapiens
  misc_feature: GZ8MTXP02JXLJC.19.67.G01.1.454.CMB.2.raw
  modified_base (332)..(332): a, c, t, g, unknown or other
  misc_feature (332)..(332): n is a, c, g, or t
  modified_base (358)..(358): a, c, t, g, unknown or other
  misc_feature (358)..(358): n is a, c, g, or t
  modified_base (400)..(400): a, c, t, g, unknown or other
  misc_feature (400)..(400): n is a, c, g, or t
  modified_base (430)..(430): a, c, t, g, unknown or other
  misc_feature (430)..(430): n is a, c, g, or t
  modified_base (445)..(445): a, c, t, g, unknown or other
  misc_feature (445)..(445): n is a, c, g, or t
  modified_base (496)..(496): a, c, t, g, unknown or other
  misc_feature (496)..(496): n is a, c, g, or t
  modified_base (512)..(512): a, c, t, g, unknown or other
  misc_feature (512)..(512): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggccagcctgggcggtctctgagactgtcctgtgaaccctcgtggggtctccgtcagcagcgactgtattgcctggtccgcaggctaccaggggaagaggccggaggtgggtcncgaggtatttttagaggtggaccganattctaacggagactccagtcgggaggccgattcgaccatcnccgagagtacttttcacagaacacaacgtntctacttacaaaagngaaacacgcctagacggggcccgaaggaccgacggtcgtactagttagtgngtacgagtaggtttancggcgagtagcgtggtggacgagatacgacgtacgggacgaaccgg

SEQ ID NO: 320841 - DNA, 605 bp, Homo sapiens
  misc_feature: GZ8MTXP02FHL80.19.67.G01.1.454.CMB.2.raw
  modified_base (315)..(315): a, c, t, g, unknown or other
  misc_feature (315)..(315): n is a, c, g, or t
  modified_base (385)..(385): a, c, t, g, unknown or other
  misc_feature (385)..(385): n is a, c, g, or t
  modified_base (428)..(428): a, c, t, g, unknown or other
  misc_feature (428)..(428): n is a, c, g, or t
  modified_base (464)..(464): a, c, t, g, unknown or other
  misc_feature (464)..(464): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttcctgctgcaatttcaggagtgtccagtgtgagtgcaactggtgagactggcggaggcttggtccagcctgggcggtctctgagactgtcctgcgaaccctctggggtctccgtcagcagcgactgtattgcctgggtccgccagggctccgaggggaagnggccggagtggggtcgcgtaggttatttttagagggttgggaccctacgatctaacgggagaccttccgntgggaagggtccattccacaactctacccaggataacttttcnctagaaacacactcgtctcttacaaacttgaaaccncgtccgtaggacggggcgacggaccgacggtccttactattagttgtaggtacgtaaggttagtttagtcggtacggtagtcgggcgttagggtaacggacgtaacggtactaccggacggtacggggacccgtaacgggg

SEQ ID NO: 320842 - DNA, 678 bp, Homo sapiens
  misc_feature: GZ8MTXP02JIAJB.19.67.G01.1.454.CMB.2.raw
  modified_base (277)..(277): a, c, t, g, unknown or other
  misc_feature (277)..(277): n is a, c, g, or t
  modified_base (303)..(303): a, c, t, g, unknown or other
  misc_feature (303)..(303): n is a, c, g, or t
  modified_base (322)..(322): a, c, t, g, unknown or other
  misc_feature (322)..(322): n is a, c, g, or t
  modified_base (387)..(387): a, c, t, g, unknown or other
  misc_feature (387)..(387): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagtttggctgacctgggttttccttgctgcaatttcaggaggtgtccagtgtgaggtgcaactggtggagactgggcggaggcttggtccagccgtgggcggtctctgagctgtcctgtcgaccctgtggggtctccgtnagcagcgactgtattgccgtggtccncaggcaccgaggggaacgngggccgggtaggtcggggtcgctaagggttatttttagacggggtgggacgtagattcgacgganccgttccaggtcgggacggccgtattaccacctacgtcccttaccgagtaacgttactttttacactaacgaacctactacgttcgttccttacttacgtaaaactcggtaaaaccacggtaccggtacggggaaccgggaccggaacgggaacccgtacccgggtccgttactttaacgtttagttcggttaggtggttaaacggttacggtttaggtacgggtacggtaggttcgggtcggtggggtaacggtacggtaacggtacgttaccggtacgggtaccggggg

SEQ ID NO: 320843 - DNA, 741 bp, Homo sapiens
  misc_feature: GZ8MTXP02JZC0V.19.67.G01.1.454.CMB.2.raw
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgaccttgggttttccttgctgctaatttcaggaggtgtccagtgtgaggtgcaacgtggtggagacgtgggcggaggtcttggccaggccgtggggcggtctcgtgagtctgtcctgtcgaccctgtgggtcctcgtcagcagcgactgtatcgccgtggcccgcgacggcctaccggaaggggaacggacggggcccgggtagggtcggggtaccggtacgttaagggttttaagttttttaaggtacgggggtacggggaaccgtaacgttaacgtttacgtaaaccggtaaggtaccggtacccttacccggtaaggggttacgggggaacgggggtaccctaacgttacccaacccgtattcccgtacccgtaaggtacgttaccttttacacgaaacgtaaacctacgtacttacgttccttacttaacaaacgtacgaaccgacggtaccgtagggaccgggaccggacggaccgaccgggtcccgttagttaatttacggttaggtggtacggtaaggttacggtttaacgcgggtacggtagtcgggtacgtagggtacggacgtacggtacgtacggtaccgggg

SEQ ID NO: 320844 - DNA, 673 bp, Homo sapiens
  misc_feature: GZ8MTXP02GKLG9.19.67.G01.1.454.CMB.2.raw
  modified_base (508)..(508): a, c, t, g, unknown or other
  misc_feature (508)..(508): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgctaatttcaggaggtgtccagtgtggaggtgcaacgtggtggagacgtgggcggaggtcttggtccagccgtgggcgtctcgtgagactgtcctgtcgaccctcgtgggtctccgtcagcagcgactgtactgccgtgggtcccgcgaggcctccggaaggggaacggagggccgggaggtcggggtcgtcgtagggtttaatttttaggaggggttagggaccgtacgtagtttcgtacggaacgtaccttacgaggtagggacggggaccgtattaccgacctatccctacagtacgttactttcgacaagaacactacttgtctactacaaagtcgaaacncgtccgttagggacggggcccgaagggtacccgacgggtcttacgttagttacgtttggtacggtggttaggtaagtttagcgggtacggtagtcggggtacgttacgggtaaggtacgaggtacgttaccggaccgggttacggggaccccggtaaaccggggg

SEQ ID NO: 320845 - DNA, 770 bp, Homo sapiens
  misc_feature: GZ8MTXP02GIWT6.19.67.G01.1.454.CMB.2.raw
  modified_base (330)..(330): a, c, t, g, unknown or other
  misc_feature (330)..(330): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttcctgctgcaatttcaggaggtgtccagtgtgaggtgcaacgtggtggagacgtggcggaggcttggtccagcctggggcggtctctgagtactgtcctgtcgaaccctcgtggggtcctccgtcagcagcgactgtattcgccgtgggtccgccgaggcgtccgaaggggaaggngggccgggaggtcggggtcgcgtaggttagtttttagtagggtgggaccgacgtagttacgtacgggtagaaccttcgaggttggggaacggggtcccgtaagtttcccgaacctacgttcccgtaccgaagtacggttacctttttacctaccgtaaacgtaaacctaaccgtaccgttacggttacccttaccgtttaaaccgtaaaaacgttacggtaaaaccgtacggtaccccgttaggggaaccgggggtacccggaaaccgggggacccggtaccgggtacccgggttactttaacgtttagttagggtttggtagggttagggttaaagttttacgggtacggggtaccggtaggttcggggcgttagggggtaacggtacgtaaggtacgtaccggtaccgggtacgggggtacccggtaaacccgggggg

SEQ ID NO: 320846 - DNA, 720 bp, Homo sapiens
  misc_feature: GZ8MTXP02J0TGG.19.67.G01.1.454.CMB.2.raw
  modified_base (398)..(398): a, c, t, g, unknown or other
  misc_feature (398)..(398): n is a, c, g, or t
  modified_base (407)..(407): a, c, t, g, unknown or other
  misc_feature (407)..(407): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgctaatttcaggaggtgtccagtgtgaggtgcaacgtggtggagactgggcggaggcttggtccaggcctgggcgtctctgagctgtcctgtcgaccctcgtgggtctccgtcagcagcgctgtattcgccgtggtcccgcgaggctaccgaggggaagacggggccggaggtggggtacgcgtaggttaagttttttacgaggggtcgggaacccgactagttcgtaacggganccgtaccgngtaggggacgggtaccgtattacgaaccctataccgtacccaagtaacggttactttttacgacaaagaccaactaacgttgtacctttaccttaacaaaagttacgaaaccacgtacccgtagggaccggggacccgaagggtaacccgacggggtaccccgttattaagttaacgtttggtaggttacggtaaagggttacgttttaaacggtcggggacttaacggttcgggacggtttagggggttaacggaaccggtaaggtaccgtaccggtaacgggtaccggggggttaacccgaaacccggggg

SEQ ID NO: 320847 - DNA, 715 bp, Homo sapiens
  misc_feature: GZ8MTXP02H6CM6.19.67.G01.1.454.CMB.2.raw
  modified_base (306)..(306): a, c, t, g, unknown or other
  misc_feature (306)..(306): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagccgtgggcggtctcgtgagactgtcctgtagaacccctcgtggggtctccgtcagcagcgtactgtattgccgtgggtccnccgagggctccgaaggggaagcggccgggaggtcgggtcgcgtaggttactttttagagggttgggaccgactagtttccgaacgggtataccgtccaggttcggggacggggtacccgtatttcccgacctaagtccctacccgaagtacgttacctttttacgaccgaaacgtaaacctaccgtaacttcggtacctttccttaacgaaaacttcgaaaaccaggtaccccgttagggaacgggggacccgaaacggaaccgaaccggggttcccgtaaccttagtttaacgtttggttaggttacgtaggttaagttttacgtagggaccgttacgtagggtcgttagggggtcggaacgtaacggtacgttaccggacggttacgggggacccgtaaaccggggg

SEQ ID NO: 320848 - DNA, 618 bp, Homo sapiens
  misc_feature: GZ8MTXP02FH4JY.19.67.G01.1.454.CMB.2.raw
  modified_base (386)..(386): a, c, t, g, unknown or other
  misc_feature (386)..(386): n is a, c, g, or t
  modified_base (476)..(476): a, c, t, g, unknown or other
  misc_feature (476)..(476): n is a, c, g, or t
  modified_base (545)..(545): a, c, t, g, unknown or other
  misc_feature (545)..(545): n is a, c, g, or t
tcagtactctcgtgcacgaccggtgctcgatttagagtatacatattggggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagccgtgggcggtctcgtgagactgtcctgtcgaaccctcgtggggtctccgtcagcagcgactgtatgccgtggtccgcaggctccgaggggagaggccggagtgggtcgcgtaggtttattttagtagggtgggacccgatatcgtacggagacctcgngtggggacgggcgacgttcacactcctaccaagtacgttacttttctacaacgtaaaccactacttgtccttacttacaaaatcgaaacncgaccgtaggacggggaccgaggaccgacggccgtactagttagttgtcgtgtaggtagttttaacggnggtacgtagtcggtggtaggggtaacggaacgtacggtactacggacggggtaccggggacccggtaacgggg

SEQ ID NO: 320849 - DNA, 658 bp, Homo sapiens
  misc_feature: GZ8MTXP02FGB3B.19.67.G01.1.454.CMB.2.raw
  modified_base (238)..(238): a, c, t, g, unknown or other
  misc_feature (238)..(238): n is a, c, g, or t
  modified_base (304)..(304): a, c, t, g, unknown or other
  misc_feature (304)..(304): n is a, c, g, or t
  modified_base (364)..(364): a, c, t, g, unknown or other
  misc_feature (364)..(364): n is a, c, g, or t
  modified_base (439)..(439): a, c, t, g, unknown or other
  misc_feature (439)..(439): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctgcgggacatcgtgatgacccagtacccagactcactggctgtgtctctgggcgagaccggcaacaatcaactgcaggtccagccagaactatttcnccacctcaaagaaactaaaacttctagcctgtaccaacagacaccaggacagcctactaagtgctntatttactggtcttcgacgcgtacgtaagtccggggtccctgaccccgtagtcccggggnacggcgggtctaggggacaggtactttcgacctcttacaccagtccggacacggtcctgaccagggctagaaagnttgggcgtacttaaggtttactaacgttgtacgaataccttaaattttacttttttactaacttccccgttccgggtaggtttaaccggtttccggaaacccggtaaaaggggtaccccggttaaagggggttaaacgaaaacttccggaaaaggtaaacccggtaacgttgggtaacggtaccttcggaacccgtaccgtacttccgttacgtttccc

SEQ ID NO: 320850 - DNA, 627 bp, Homo sapiens
  misc_feature: GZ8MTXP02IW7QB.19.67.G01.1.454.CMB.2.raw
tcagtactctcgtgcacgaccggtgctcgatttagagtatacatattgggtttgggggtctgggagaggagcccagcactgggattccgaggtgtttccattcggtgctcagcactgaacacagaggactcaccatggagttttggctgaccttgggttttcctgctgctaatttcaggaggtgtccagtgtgaggtgcaacgtgggtggagactgggcggaggtcgttggcccaggccgttgggccggtctcgtgagtctgtctgtcgacctcgtcgggtctccgtcagcagcgactgtattcgccgtgggtccgcgacggcctaccgaggggaacgacgggaccgggaggtcggggtccgacgttaggttagtttttagtaggggtacgggacgtaactagtttacgtacggacgactcccgagtcggggacgggtcccgtatttccacctaagtctaccgagtacgtacttttcgtacacgaacacactgtcttacttacaaagttacgaactacgcccgtaggaccgggcgaacggaccgaacgggtccttacgttagtttaagttcgtgttaggattaagttagtcgacgtgtgtcgtggtgacagacgtcgacggtcgggg

SEQ ID NO: 320851 - DNA, 931 bp, Homo sapiens
  misc_feature: GZ8MTXP02JYZBS.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttcctgctgcaatttcaggaggtgtccagtgtgaggtgcaacgtggtggagactgggcggaggcttggtccaggccgtggggcggtctcgtgagtactgtcctgtcgaccctcgtggggtctccgtcagcagcgtactgttacttcggccgttggggtccccgccgagggtccgtacccggaaggggaacggacggggcccggggtaggtcggggtacggacgtaagggtttaatttttaaggtaggggtcggggaaccgtaacctagtttaccgtaacgggtacgaccttccgaggttcgggggaacggggtacccggtattaccgaaccctacttacccgtacccgtaacggttaaacgttaccctttttaccgaccgttaaacggaaaccctaaaccctaacgtttccggttacctttaccctttaaaccgtaaaaagtttacccggtaaaaccgaaccgggtacccggttaacgggggtaaacccggggggtaccccggggtaaaacgggggaacccccggttaaaccccgggggttacccccggttttaaacccggttttaaaggtttttaaaccggggtttcgggggttttaaacgggtttacgggggttaaaaggggtttacgggtttttaaaagggggtttcgggggaaacccgggttaacgggtttacgggggtccggttacgggggttaagggggaaaccgtaacggttaaacggtcccggtaaccgggggtttaccggggggaaaccccgttaaaaccccgggggg

SEQ ID NO: 320852 - DNA, 538 bp, Homo sapiens
  misc_feature: GZ8MTXP02JQ0PS.19.67.G01.1.454.CMB.2.raw
  modified_base (298)..(298): a, c, t, g, unknown or other
  misc_feature (298)..(298): n is a, c, g, or t
  modified_base (312)..(312): a, c, t, g, unknown or other
  misc_feature (312)..(312): n is a, c, g, or t
  modified_base (326)..(326): a, c, t, g, unknown or other
  misc_feature (326)..(326): n is a, c, g, or t
  modified_base (391)..(391): a, c, t, g, unknown or other
  misc_feature (391)..(391): n is a, c, g, or t
  modified_base (442)..(442): a, c, t, g, unknown or other
  misc_feature (442)..(442): n is a, c, g, or t
  modified_base (493)..(493): a, c, t, g, unknown or other
  misc_feature (493)..(493): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtcgaaccctcgtgggtctccgtcagcagcgactgtatgcctggtccncaggctcgaggagnggcggagtgggtcncaggtattttagaggtggaccgactattctacggagactacagtggaggcccgattcaaccatcnccagagactttctacaagaacacaactgtaccttcttacaaaatgaaaacngacctaggacgggaccgagacgacggcgtatattatgagtgagtagtttanggtacgagcggtctggtcggaacagacacgacgtcggacggacgg

SEQ ID NO: 320853 - DNA, 783 bp, Homo sapiens
  misc_feature: GZ8MTXP02JUE0O.19.67.G01.1.454.CMB.2.raw
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggagtgtccagtgtgaggtgcaacgtggtggagacgtgggcggaggcgttggtccagtccgtgggcggtctcgtgagactgtctgtcgaccctgtgggtctcgtcagcagcgactgtattcgccgtcggggtccgccgaggcctaccggaaggggaacggcggggaccgggtaggttcggggtaccggtagtaaggggtttaagtttttttaaggacgggggttggggaaccgtacgtacgtttaccgtaaccggggacaccgttccgaagggttaccggggacggggacccgtaatttcccgaaaccccgtatcccttacccgaagttaacggttacctttttccacgaaaccgttaaacaaccctacgttcgttacccttacgtttaaaccaaaattacggaaaacttacgggtcccggtaaggggaccgggggaacccggaaacgggaccggtaaacccggggtcccggtttaacctttaaagtttaacgtttcgggtaggttaacgggtagggtttaaaggtttacgtacggggccgttaaggtcggggtaacgtgggggttaacggacgaaacggtcgttaccgaaacgggggtacccggggg

SEQ ID NO: 320854 - DNA, 714 bp, Homo sapiens
  misc_feature: GZ8MTXP02HX4CK.19.67.G01.1.454.CMB.2.raw
  modified_base (290)..(290): a, c, t, g, unknown or other
  misc_feature (290)..(290): n is a, c, g, or t
  modified_base (320)..(320): a, c, t, g, unknown or other
  misc_feature (320)..(320): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagtttggctgaccttgggttttccttgctgctaatttcaggaggtgtccagtgtgaggtgcaacgtgggtggagacgtgggcggaggtcgttggccaggtccgtgggcggtctcgtagagtactcgtcctgtcgaccctcgtgggtctccgtnagcgagcgactgtatcggccgtgggtcccncgacggcctacggaagggaaggcgggacccgggaggttcggggccgtacgttaggggttaaatttttaggtacggggtacgggtaaccgtacgtacgtttaccggtaacgggacgttacccgtccgtaagggtcgggggaacgggtacccgttactacctaacccgtactcccgtaacgacgtaacgttaccctttacgtaacgaacgtaaaccactaccgttacgtaccttacgttaactaaaagtacgaaacacgtaccgtagggaacgggccggtaacggacgtaccggtcgttactagttaacgtagttggtaggttaacgttaggtttagtacgggtacgtagtcggtaaggtacggtacggaaccgagtacgttacgacggtacgggg

SEQ ID NO: 320855 - DNA, 639 bp, Homo sapiens
  misc_feature: GZ8MTXP02FICQY.19.67.G01.1.454.CMB.2.raw
  modified_base (285)..(285): a, c, t, g, unknown or other
  misc_feature (285)..(285): n is a, c, g, or t
  modified_base (311)..(311): a, c, t, g, unknown or other
  misc_feature (311)..(311): n is a, c, g, or t
  modified_base (346)..(346): a, c, t, g, unknown or other
  misc_feature (346)..(346): n is a, c, g, or t
  modified_base (561)..(561): a, c, t, g, unknown or other
  misc_feature (561)..(561): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttcctgctgcaatttcaggaggtgtccagtgtgaggtgcaactgggtggagacgtgggcggagggcttgggtccaggccgtggggcggtctcgtgagacttgtcctgtcgaaccctcgtggggtctccgtnagcagcgactgtattgcctgggtccncaggctaccgagggaagacgggccggaggtgggcncgttaggttattttagaggggtggaccgtactgttacgtacggagaccttccgagtcggggacgggccgtaattccgaacctatccgtaccagtacgtactttctacaagtacactactgtcctactacaaagtcgaaacacgtccgtaggacggggaccgacgggaaccacggggtaccttactatttagttggtagtagtaggttagtttagngggtacgtacgttggggccttaggggttaacggaactaggtacgttaccgaacggtcgggggaccgtaaacccggggg

SEQ ID NO: 320856 - DNA, 573 bp, Homo sapiens
  misc_feature: GZ8MTXP02G1882.19.67.G01.1.454.CMB.2.raw
  modified_base (266)..(266): a, c, t, g, unknown or other
  misc_feature (266)..(266): n is a, c, g, or t
  modified_base (305)..(305): a, c, t, g, unknown or other
  misc_feature (305)..(305): n is a, c, g, or t
  modified_base (344)..(344): a, c, t, g, unknown or other
  misc_feature (344)..(344): n is a, c, g, or t
  modified_base (358)..(358): a, c, t, g, unknown or other
  misc_feature (358)..(358): n is a, c, g, or t
  modified_base (429)..(429): a, c, t, g, unknown or other
  misc_feature (429)..(429): n is a, c, g, or t
  modified_base (437)..(437): a, c, t, g, unknown or other
  misc_feature (437)..(437): n is a, c, g, or t
  modified_base (450)..(450): a, c, t, g, unknown or other
  misc_feature (450)..(450): n is a, c, g, or t
  modified_base (457)..(457): a, c, t, g, unknown or other
  misc_feature (457)..(457): n is a, c, g, or t
  modified_base (465)..(465): a, c, t, g, unknown or other
  misc_feature (465)..(465): n is a, c, g, or t
  modified_base (471)..(471): a, c, t, g, unknown or other
  misc_feature (471)..(471): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggtttcctgctgcaatttcaggagtgtccagtgtgaggtgcaactggtggagactgggcggaggcttggtaccagccttggggcggtctactgagacctggtcctgtcgtaaccctntggggtctccgtcagcagcgactgtatcgcctggtaccncaggctccgaggggaacgaggtccggaggtcggggtccngtaggtatttttanaggggtcggaccgacagttctacggagaccgttccagtgggaagggtccctaattcacctatctacagtanactttcgnagaaactcatcgntacctanaatgaacncgacgngacggacgacgacgacgcgtcgtattagtgtgtagtagtagttagtagtcgtacgtcgtgtaggtaagtacgacgtacgtacgtacggtacggacggtacgg

SEQ ID NO: 320857 - DNA, 693 bp, Homo sapiens
  misc_feature: GZ8MTXP02F0T9R.19.67.G01.1.454.CMB.2.raw
  modified_base (197)..(197): a, c, t, g, unknown or other
  misc_feature (197)..(197): n is a, c, g, or t
  modified_base (234)..(234): a, c, t, g, unknown or other
  misc_feature (234)..(234): n is a, c, g, or t
  modified_base (554)..(554): a, c, t, g, unknown or other
  misc_feature (554)..(554): n is a, c, g, or t
  modified_base (656)..(656): a, c, t, g, unknown or other
  misc_feature (656)..(656): n is a, c, g, or t
tcagtactctcgtgcacgaccggtgctcgatttagagtatacatattggggtttgggggggagaggagcccagcactgggattccgaggtgtttccattcggtgctcagcactgaacacagaggactcaccatggagttttggctgaccttgggttttccttgctgctaatttcgaggaggtgtccagtgtgaggtncaacgtggtggagacgtgggcggaggtcttgggtccnggccgtggggcgtctcgtgagcctgtcctgtcgacctgtgggtctcgtcagcagcgactgtattcgccgtgggtcccgacacgggcctaccggaaggggaacgacgggtccggggaggtacgggggtccaggttaagggttttaattttacggaaagggggtttcggggaacctacgtaagtttacccgtacggggactacccgttacgtaggtcggggaaacggggtccctactttaccgactacttcccgtaccgagtaacgtttactttctaacgagtaaacactactcgttactacttacgaaacttgaactacgngttaccgggaggggtaccgaaacggccgtacgggtcccttaagttcgttaagtggtgtaaggtacgttagtttaaggtcggaggtacgtgggtcgttagggnggaacgagtacgtcgtcggaccggggtacgaaccggg

SEQ ID NO: 320858 - DNA, 602 bp, Homo sapiens
  misc_feature: GZ8MTXP02GNSWI.19.67.G01.1.454.CMB.2.raw
  modified_base (249)..(249): a, c, t, g, unknown or other
  misc_feature (249)..(249): n is a, c, g, or t
  modified_base (335)..(335): a, c, t, g, unknown or other
  misc_feature (335)..(335): n is a, c, g, or t
  modified_base (392)..(392): a, c, t, g, unknown or other
  misc_feature (392)..(392): n is a, c, g, or t
  modified_base (429)..(429): a, c, t, g, unknown or other
  misc_feature (429)..(429): n is a, c, g, or t
  modified_base (452)..(452): a, c, t, g, unknown or other
  misc_feature (452)..(452): n is a, c, g, or t
  modified_base (599)..(599): a, c, t, g, unknown or other
  misc_feature (599)..(599): n is a, c, g, or t
  modified_base (601)..(601): a, c, t, g, unknown or other
  misc_feature (601)..(601): n is a, c, g, or t
tcagtactctcgtgcacgaccggtgctcgatttagagtatacatattgggcttggtccagcctgggcggtctctgagactgtcctgtgaaccctctggggtctccgtcagcagcgactgtattgcctgggtccgccaggctccagggaagaggccggagtgggtcgcaggttattttttagtagggtgggacgacattctacggagactccagtgggagggccattcaccatctccagagtacttttcncagaacacactgtctcttcaaaatgaacagcctaggacggggccgaaggacaccgggccgtctaatttattgtgtgagtagtttanggcgtatgggctggtgacagatcacgtggggccagggaccctggtccacgtctcctnacgccctccaacgagggccccagtccgtccttccccnggccgccctgacctcgagggacnccaccgtccgagacgcacgacgccgggtcccgtggggcctcggcccgtggtaccgaaagggtaccctaaccgttaccccgaacggaacgacggtacctcggacggtccggggactcggggaaccaaaggggccgacgtaagacgcgngng

SEQ ID NO: 320859 - DNA, 650 bp, Homo sapiens
  misc_feature: GZ8MTXP02JGHOM.19.67.G01.1.454.CMB.2.raw
  modified_base (504)..(504): a, c, t, g, unknown or other
  misc_feature (504)..(504): n is a, c, g, or t
  modified_base (608)..(608): a, c, t, g, unknown or other
  misc_feature (608)..(608): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgaccttgggttttccttgctgctaatttcaggaggtgtccagtgtgaggtgcaacgtggtggagacgtgggcggaggcttggtccaggccgtgggcggtctcgtgagactgtcctgtcgaccctcgtgggtctcgtcagcagcgactgtattcggccgtcgggtcccgcgaggccgtaccggaaggggaacggtacggggccgggaggtcgggtcgtacgtaggtttagttttaggagggtgggaacccgtactagttacgtacggacgactcgaggtcgggacggaccgtattccgaacctactctaccgagtacgttactttcgacaagaacactactcgtactactacaaagtcaacncgtacgtagggacgggaccgacgggacgacggtacgtacgttagttagttggtaggtagtagttaggtttacgtggtacgtggtcgggtcgttagggcggtaanacggtacgtacgaaccggggtcggggtacccgtaaaccgggg

SEQ ID NO: 320860 - DNA, 702 bp, Homo sapiens
  misc_feature: GZ8MTXP02FG7VN.19.67.G01.1.454.CMB.2.raw
  modified_base (326)..(326): a, c, t, g, unknown or other
  misc_feature (326)..(326): n is a, c, g, or t
  modified_base (338)..(338): a, c, t, g, unknown or other
  misc_feature (338)..(338): n is a, c, g, or t
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttcctgctgcaatttcaggaggtgtccagtgtgaggtgcaactggtggagacgtgggcggaggtcttggttcagccgtggggcggttctctgagactgtcctgtcgaaccctcgtgggtctccgtcagcagcgactgtatgcctgggtccgccaggctccgagggaagnggcccgggaggnggggtcgcgaggttatttttagagggtgggacgatattacgtacggacgactccgaagtgggacgggtccgagttaccgacctatccgtaccacgatacgtttttcacgaacgtaaccaactacgttagtccttacttaaccaaaagttacgaaacgtacgtaccgttagggaaccggggacccggaagggaacccgtaaccggggtcccgttaccgtttaaaacgttagtttaccgggttagggttagggttaaagggttagtttttaaaccggtggggtaaacccggtagttacggggtaaccgttgggggttaacggtaaccggtaaggtaaccgtaccggaacgggtttaacccgggggg

SEQ ID NO: 320861 - DNA, 725 bp, Homo sapiens
  misc_feature: GZ8MTXP02JE2V4.19.67.G01.1.454.CMB.2.raw
tcagtactctcgtgcacgaccggtgctcgatttagagtatacatattgggtttgggggggagaggagcccagcactgggattccgaggtgtttccattcggtgctcagcactgaacacagaggactcaccatggagtttggctgacctgggttttccttgctgcaatttcgaggaggtgtccagtgtgaggtgcaacgtgggtggagacgtgggcggaggtcttggtccaggccgtggggcggtctcgtgagactgtcctgtacgacccgtgtcggggtcctccgtcagcagcgactgtatcgccgtcgggtccgccgaggcctaccggaaggggaacggacggggccgggaggtcggggtcgcgtaggtttaatttttaggaggggtacggacccgtactagttaccgtacgggacgtacctccgaggtcgggggacgggtccgtattaccgaccgtacttcccgtaccgagttaacgttacttttaccgacgaaagtaacccactacgttcgttacctacttaacaaaagttcgaaacgtacgtacccgtagggaccgggggacccgaaacgggacccgtaccggggtaccgttacgttatttaggttagttggtaacggtaaggtttacggtttacggtaggtccggtagtccggggtacggttagggtaaccggacgtaggtacgtaccggacggttaccgggggacgtaaaccccggggg

SEQ ID NO: 320862 - DNA, 639 bp, Homo sapiens
  misc_feature: GZ8MTXP02IPVDT.19.67.G01.1.454.CMB.2.raw
  modified_base (193)..(193): a, c, t, g, unknown or other
  misc_feature (193)..(193): n is a, c, g, or t
  modified_base (300)..(300): a, c, t, g, unknown or other
  misc_feature (300)..(300): n is a, c, g, or t
  modified_base (431)..(431): a, c, t, g, unknown or other
  misc_feature (431)..(431): n is a, c, g, or t
  modified_base (481)..(481): a, c, t, g, unknown or other
  misc_feature (481)..(481): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgaccttgggttttcctgctgctaatttcaggaggtgtccagtgtgaggtncaacgtggtggagacgtggcggagtcgttggtccagccgtgggcgtctcgtgagtctgtctgtcgacctgtgggtcctcgtcagcagcgactgtatcgcctggtccncgtaggcctccggaaggggaacggacggccgggtagttcggggcgcgtaagggtttactttttaggagggtggaccgtacacgtttacgaacggactaccgtccgagtcggggacgcccgtattccgaacncttccacaagttacgtactttcacaagtaaccactactcgtactacttanaaaacttcgaaacagtcccagggacgggaccgtacggacgtacccgcggttctaagtttagtgtaggtacgtagtacgtttaacggcggtacgtaggtcggtacggtaggaacggacgtaacggtaccgtacggtacggtaccggggaccgtaaccgg

SEQ ID NO: 320863 - DNA, 542 bp, Homo sapiens
  misc_feature: GZ8MTXP02INVQJ.19.67.G01.1.454.CMB.2.raw
  modified_base (278)..(278): a, c, t, g, unknown or other
  misc_feature (278)..(278): n is a, c, g, or t
  modified_base (403)..(403): a, c, t, g, unknown or other
  misc_feature (403)..(403): n is a, c, g, or t
  modified_base (415)..(415): a, c, t, g, unknown or other
  misc_feature (415)..(415): n is a, c, g, or t
  modified_base (427)..(427): a, c, t, g, unknown or other
  misc_feature (427)..(427): n is a, c, g, or t
  modified_base (476)..(476): a, c, t, g, unknown or other
  misc_feature (476)..(476): n is a, c, g, or t
  modified_base (503)..(503): a, c, t, g, unknown or other
  misc_feature (503)..(503): n is a, c, g, or t
  modified_base (509)..(509): a, c, t, g, unknown or other
  misc_feature (509)..(509): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgaccttgggttttccttgctgcaatttcaggaggtgtccagtgtgaggtgcaactggtggagactgggcggaggcttggtccagccgtgggcggtctctgagacctgtcctgtcgaaccctgtggggtctccgtnagcagcgactgtattgcctgggtccgcaggctccgagggaagcggccggaggtgggcgcaggtatttttagaggtggacgacattctacggagactcagtcggaagggccagttccacatctcanacgtactttcgnagtaacacactntctcttacaaattgaacagcctggacgggaccgaggaccgacggccgtnttattattgtgtgagtagttatcgggngagtgngtggtgagagatacacggtcgggaccaacgggg

SEQ ID NO: 320864 - DNA, 635 bp, Homo sapiens
  misc_feature: GZ8MTXP02JYSZO.19.67.G01.1.454.CMB.2.raw
  modified_base (329)..(329): a, c, t, g, unknown or other
  misc_feature (329)..(329): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagccgtgggcggtctctgagactgtcctgtgaccctcgtggggtctccgtcagcagcgactgtatgcctggtccgcaggctcgagggagaggccggagtgggcncgtaggttactttttagagggtggaccgactagttcgaacgggtagacctccgagtggggaacggggtccctattccgaaccctaattccctacccgaagtacggttacctttttcctacgaacgaaacacctacttagttccttcctttaacaaaacttgaaaccgtacgccgtagggacggggacccgaggacccgaccgggtaccgtacttaattagttggtgtaggagttagttaacgttggcgtagtcgggtgttaggggtcgaacgagagttaccgacggtcgggggaccaacccggggg

SEQ ID NO: 320865 - DNA, 678 bp, Homo sapiens
  misc_feature: GZ8MTXP02I40GS.19.67.G01.1.454.CMB.2.raw
  modified_base (239)..(239): a, c, t, g, unknown or other
  misc_feature (239)..(239): n is a, c, g, or t
  modified_base (246)..(246): a, c, t, g, unknown or other
  misc_feature (246)..(246): n is a, c, g, or t
  modified_base (291)..(291): a, c, t, g, unknown or other
  misc_feature (291)..(291): n is a, c, g, or t
  modified_base (305)..(305): a, c, t, g, unknown or other
  misc_feature (305)..(305): n is a, c, g, or t
  modified_base (387)..(387): a, c, t, g, unknown or other
  misc_feature (387)..(387): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatcgacccagtacccagactcactggcttgtgtctcgtgggcgagaccggccacaatcaactgacaggtccagccagtaactnttttccnccacctaccaaagtaaactaaaacttctacgccttaggaaccaanagacgaccaggacncgacctacctaagtgctctatttacgtggcttcgtacgcgtcgtaacgttccggggacctcggaccccgtacgtccgggganacgggtcgtacgttacgggacctagtactttcaaccttcgtacacgtatccgaagcctacgccgtgcgacggtctaggaagtagttaggtcgtacttaaggttttacttacgttgtactacggttacttaaaccgtttatttttcttacgtccgtttaccgtagggttccccgtttacggacccggtaaaggggtaacccggtacggggtaacggtaaaacttcggtaaaaccggtacggtaaacgttcggggtaacgtcccgtacgacccgtaacttacttacgtttccg

SEQ ID NO: 320866 - DNA, 696 bp, Homo sapiens
  misc_feature: GZ8MTXP02JRSOS.19.67.G01.1.454.CMB.2.raw
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttcctgctgcaatttcaggaggtgtccagtgtgaggtgcaactggtggagacgtgggcggaggcttggtccagcctgggcggtctctgagactgtcctgtcgaaccctcgtggggtctccgtcagcagcgactgtattgccgtggtcccgcgaggctccgagggaaggaggccggaggtcggggtcgcgtaggttattttacgagggtcgggaccgacgtagttctaacgggacgacttaccgaggttcgggaacgggggaccgagttccgaaccgtacttccgtacccgaagtacgtacttttaccgtcgtaaacgaaccacctaaacttcggttaccttacctttaacaaaacgttacgaaaaccacggtccgtagggaccggggacccggaacggaaccgaacccgggtcccggttacttagtttagttaggttagttacggtaagtaggtttaagtcggtacggttagttcgggccgttgggttaacggaacgtaacggtactaccggtacggtaccgggggtaccgtaaacccggggg

SEQ ID NO: 320867 - DNA, 660 bp, Homo sapiens
  misc_feature: GZ8MTXP02HCRIQ.19.67.G01.1.454.CMB.2.raw
  modified_base (233)..(233): a, c, t, g, unknown or other
  misc_feature (233)..(233): n is a, c, g, or t
  modified_base (317)..(317): a, c, t, g, unknown or other
  misc_feature (317)..(317): n is a, c, g, or t
  modified_base (484)..(484): a, c, t, g, unknown or other
  misc_feature (484)..(484): n is a, c, g, or t
  modified_base (498)..(498): a, c, t, g, unknown or other
  misc_feature (498)..(498): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttcctgctgcaatttcaggaggtgtccagtgtgaggtgcaactggtggagactggcggaggcttggccagcctgggcgtnctgagacctgtcctgtcgaaccctcgtggggtctccgtcagcagcgactgtattcgcctgggtacccgcaggctccgagggagnggccggaggtgggcgcgtaggttatttttacgagggttagggaccctaagtacgttacgtaacgggcgtaaccgttcccgagtcggggaacgggtcccgtaattcccgacctaatcccgttaccaagtacgtaaccttttcacgagtaacactactgtacctactanaaaactcggaaacncggtccgtagggacgggaccgacggaccgtacggtacgttacttaagttagttcggtacgtacggtaacggttaggtttacgagggtaacgtaggtcggtcgttaggggaacgtaacgtaacgtacgtaccgtaacggggtaccgggggacccgtaacgggg

SEQ ID NO: 320868 - DNA, 659 bp, Homo sapiens
  misc_feature: GZ8MTXP02IDCEZ.19.67.G01.1.454.CMB.2.raw
  modified_base (279)..(279): a, c, t, g, unknown or other
  misc_feature (279)..(279): n is a, c, g, or t
  modified_base (307)..(307): a, c, t, g, unknown or other
  misc_feature (307)..(307): n is a, c, g, or t
  modified_base (536)..(536): a, c, t, g, unknown or other
  misc_feature (536)..(536): n is a, c, g, or t
  modified_base (585)..(585): a, c, t, g, unknown or other
  misc_feature (585)..(585): n is a, c, g, or t
  modified_base (628)..(628): a, c, t, g, unknown or other
  misc_feature (628)..(628): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgctaatttcaggaggtgtccagtgtgaggtgcaactggttgagacgtggcggaggcttggccagccgtgggcggtctcgtgagactgtcctgtcgaaccctgtggggtctccgtnagcagcgactgtatcggcctggggtccnccgacggtcctccgaaggggaagacggggccgggtaaggtggggtccgacgtagggttatttttaagaggggtcggaccgtacctagttccgaacggagaccctcgtagtggggacgggccccgtatttaccccgactacttccgtaccctaaggaacgtttcctttttccaacgaaacgtaaaccaccgtacttcggtcctttaccttaacgaaaattccggaaaacnggtacccgtgaacgggggccgaacgggaacaccgggcttcgtaaatttntggttacgtggagttagtttacgtgggatgtcggtctaggggngagacgtctacggacggtacgggaccacggg

SEQ ID NO: 320869 - DNA, 607 bp, Homo sapiens
  misc_feature: GZ8MTXP02IXHN0.19.67.G01.1.454.CMB.2.raw
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttcctgctgcaatttcaggaggtgtccagtgtgaggtgcaacgtggtggagacgtgggcggaggtcttggccaggccgtggggccggtctctgagctgtcctgtcgaaccctgtggggtctccgtcgagcagcgactgtactcgccgtggtccgcgaggcctccgagggaagaggccggaggtgggtcgacgtaggttattttaggtacgggtagggacgtactgttcacggatccgtcgagtgggacgggccgtaacttcgacctactcgtactacgtacgttacttttccgacaacgtaacactactcgttctacttacaaatacgaactacgcgtaggaccgggacgacgggcgaacggtccgttactattagttcgtgtaggtacgttagttagcggtacgagtggtaacgtgggttacgacgtagtactcggaacggtccggggg

SEQ ID NO: 320870 - DNA, 672 bp, Homo sapiens
  misc_feature: GZ8MTXP02GUBGR.19.67.G01.1.454.CMB.2.raw
  modified_base (236)..(236): a, c, t, g, unknown or other
  misc_feature (236)..(236): n is a, c, g, or t
  modified_base (265)..(265): a, c, t, g, unknown or other
  misc_feature (265)..(265): n is a, c, g, or t
  modified_base (280)..(280): a, c, t, g, unknown or other
  misc_feature (280)..(280): n is a, c, g, or t
  modified_base (295)..(295): a, c, t, g, unknown or other
  misc_feature (295)..(295): n is a, c, g, or t
  modified_base (297)..(297): a, c, t, g, unknown or other
  misc_feature (297)..(297): n is a, c, g, or t
  modified_base (309)..(309): a, c, t, g, unknown or other
  misc_feature (309)..(309): n is a, c, g, or t
  modified_base (355)..(355): a, c, t, g, unknown or other
  misc_feature (355)..(355): n is a, c, g, or t
tcagtactctcgtgcacgaccggtgctcgatttagagtatacatattgggtttggggggtagctcaggaagcagagcctggagcatctccactatggcctgggctccactacttctcaccctcctcgctcactgcacaggttcttgggccaactttatgctgactcacgccccactctgtgtcggagtcgtcggggaagacggtaacattctttcgcaccacaacagtggacaacnttgccagctaattttgcgcaggtcgtacngcacgccgccgggcncgttcccccacatgngntcatgagtatanacaaacgcgtcgtcgggtcctaggtactcggttctacgtcggtccnccgtatccgacagtcctcccgtaccaacttctccgaccctccctaccacctactccttacgtcggacgttacgaacgtacgtggaacgggacgcgggtacctcgttaaactaccgttaacttacggttactaccggtttagtttaacgtacggtaaactcccggtaccgggtaccggttagtacggttcggtttcgggttaccgggtttccgggggaaccgggtaacccggggaacctaacgggtccgtaccggtacccggtacgtaacggtaccgacggtaccggaacggtcccgtacccggtcccccgttaccgg

SEQ ID NO: 320871 - DNA, 710 bp, Homo sapiens
  misc_feature: GZ8MTXP02GZ08Q.19.67.G01.1.454.CMB.2.raw
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagactgggcggaggcttggtccagccgtgggcgtctctggagactgtcctgtcgaccctcgtgggtcctccgtcagcgagcgtactgtagtgccgtcgggtccgccgtacggcctaccggaaggggtaacggacggggacccgggtaggttggggtccggtacgtaggggtttaacgtttttttaggacggggtttacggggaaccgtacttaacgtttacggtaaccggggtaacgtaccgtaccgtaaacggtgggggaaaccgggggtcccgtaaacgtttcccaaccctacgttacccgtacccgtaaggtacgttaaacctttttccgactaacgaaaccactacttacgtcttacttaccaaatacgtaacgacgtaccgtaggaccgggccgacggacaaccgggttcgtacttaagttcgttaggtggtagtagtaagttttcggcggtacgtgtcgggtgttacggtcggacgtagtacgtcggtacggtcggg

SEQ ID NO: 320872 - DNA, 654 bp, Homo sapiens
  misc_feature: GZ8MTXP02H3DS8.19.67.G01.1.454.CMB.2.raw
tcagtactctcgtgcacgaccggtgctcgatttagagtatacatattgggtttggggtctgggagaggagcccagcactgggattccgaggtgtttccattcggtgctcagcactgaacacagaggactcaccatggagttttggctgaccttggggttttccttgctgctaatttcaggaggtgtccagtgtgaggtgcaacgtgggtggagacgtgggcggaggcgttggtcccaggcccgtggggcggtctcgtgagactgtcctgtcgaccctcgtcgggtctccgtcagcagcgactgtagttcgccgtcgggtccgccgaggcctcgagggaagcgggcgggaggtgggcgcgtaggttatttttagagggtggtaccgactagttcgtacggatccgtcgaagtcggggtacggcccgtacttaccaccctacgtaccgttcccaagtacgttaaccctttttctaccgaacgtaaccacgtacgttcgttcctaactttacgaaacgttcggaaacacgtacccgggaggacgggaccggacggaccggtaccggtccgttagttaacgtttagttcgtaggttagacgttagtttacgtggacgtggtcggtggtggtacggactagtacgtcgacggtacgggg

SEQ ID NO: 320873 - DNA, 777 bp, Homo sapiens
  misc_feature: GZ8MTXP02JTILU.19.67.G01.1.454.CMB.2.raw
  modified_base (284)..(284): a, c, t, g, unknown or other
  misc_feature (284)..(284): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctggcggggacatcgtgatcgacccagtacccagactcactggctgtgtctcgtgggcgagacggccaacaatcaactgacaggtccagccagaactatttcaccacctacaaagaaacaaaacttctacgccttagtaccaanagacgaccaggacacgtcctacgtaagtcgactctaatttacgtgggtacctttcgaccggcgtacggtaaacgttccggggtaccctggaacccccggtacggttcccgggggactacggggtccgggttacgtacggggacctaacggttacttttaccaaccttccctaccgaacctaactccgaaacggtccctaacggtccccgttcgggaacccgaaaggggtaccgtaaagggtaaaagggtaaccgttgggggttaccggtaaaccgtttaaaggttttttaacgttaccgttacgggtaactaacggttaactttaaaactttttaacttttttccgtaaacgttccccggtttaggtcgggttaaaccggtttccgggaaacggtaaaaccgggggaccgtaagggggttaaaagaaacgtacggtaaacgaacggtaacgtcggtacggtaccgtacgaccctaaccgttagttaccgttcg

SEQ ID NO: 320874 - DNA, 661 bp, Homo sapiens
  misc_feature: GZ8MTXP02GD2B0.19.67.G01.1.454.CMB.2.raw
  modified_base (302)..(302): a, c, t, g, unknown or other
  misc_feature (302)..(302): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggtcttgggtccagcctagggcggtctctgagctgtcctgtcgaaccctctggggtctccgtcagcagcgactgtatgcctgggtccnccgaggctccgaggggaagcggccggagtgggtcgcgtaggttattttagaggtggaccgatattcgtacggagacctcgagtcgggagggtccgtagttccgaccctatacctcccaaggtacgttacttttcctacaagaaactactacgttgtccttacttacaaaattcgaaactacggaccgtacgggaacggggcccggaaacggaccgacccgggtccgttacccttaagtttacgttggttaggtacggtaggttaaagtttaggtaccgggacgttaacggtggtccggttaggggtaacggggtacaaggtacgtaccgtacggttcgggggaacccggtaacccgggg

SEQ ID NO: 320875 - DNA, 681 bp, Homo sapiens
  misc_feature: GZ8MTXP02H6Q7B.19.67.G01.1.454.CMB.2.raw
tcagtactctcgtgcacgaccggtgctcgatttagagtatacatattgggtttggggggagaggagcccagcactgggattccgaggtgtttccattcggtgctcagcactgaacacagaggactcaccatggagttttggctgaccttgggttttccttgctgcaattttcaggaggtgtccagtgtgaggtgcaactgggtggagacgtgggcggaggcttggtccaggccgtgggcgtctcgtggagtctgtcctgtacgtacccgtcgtcggggtcctccgtcacgcacgcgactgtattcgccgtcgggtccgccgaggctccggaaggggaacggcgggccgggaggtggggtacgtcggtaaggtttagtttttaggaggggtcgggaaccgacgttagtttacgacgggtacgaccgtaccgagttgggggaacggcccggttaattaccgacccgtattaccctcccgaagtacgttactttcgtacaacgtaactacacttcgttccttacttaacaaagttagaaccacgtacgcgggaacggccggaacgacgaccggtcgtacgttattagtggtgtagtaagttggttacgtgggaccggtagtcggtacgttagggtaacggtacgacgtacgttaccggacggtacgggggtaccgaaaccgggg

SEQ ID NO: 320876 - DNA, 600 bp, Homo sapiens
  misc_feature: GZ8MTXP02GV8W5.19.67.G01.1.454.CMB.2.raw
  modified_base (262)..(262): a, c, t, g, unknown or other
  misc_feature (262)..(262): n is a, c, g, or t
  modified_base (319)..(319): a, c, t, g, unknown or other
  misc_feature (319)..(319): n is a, c, g, or t
  modified_base (378)..(378): a, c, t, g, unknown or other
  misc_feature (378)..(378): n is a, c, g, or t
  modified_base (529)..(529): a, c, t, g, unknown or other
  misc_feature (529)..(529): n is a, c, g, or t
  modified_base (546)..(546): a, c, t, g, unknown or other
  misc_feature (546)..(546): n is a, c, g, or t
tcagtactctcgtgcacgaccggtgctcgatttagagtatacatattggggtttgggggggagaggagcccagcactgggattccgaggtgtttccattcggtgctcagcactgaacacagaggactcaccatggattttggctgacctgggttttcctgctgcaatttcaggaggtgtccagtgtgaggtgcaactggtggagactgggcggaggcttaggtccagcctgggcgtctctgacactgtcctgtcgaaccctntggggtctcgtcagcagcactgtatgcctagggtcccgagggctccgaggggaacgnggccggagtgggtccgataggttattttagaggttgggaacctctagttcgaacggganacttccgaggtcggacggggtcccagttccgcaaagtccctcgaagtacgtaacttttcacaagaaaccactaactcgttactaccttcaaaaagttcgaaacagcccgttagacggggccgaaaggaccgtacgtcgtactattagtcgnggtacagttattacggnggacgtcgtcggtcgtaggaacgacacgtacacgtacggtaccgggacgtacgg

SEQ ID NO: 320877 - DNA, 643 bp, Homo sapiens
  misc_feature: GZ8MTXP02JO0OE.19.67.G01.1.454.CMB.2.raw
  modified_base (435)..(435): a, c, t, g, unknown or other
  misc_feature (435)..(435): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggtagttttggctgaccttgggttttccttgctgcaatttcaggaggtgtccagtgtgaggtgcaacgtggtggagacgtgggcggaggtcttggtccagccgtgggcggtctctgagtactgtcctgtcgaccctcgtgggtctccgtcagcagcgactgtattcgccgtgggtccgccaggcctcgaggggaagcgggccgggaggtggggtcgcgtagggtttatttttagtaggggttgggaccgtacgtatttcgaacggagtacgtccgagtcggggagggccgtagttccaacctntcctccgagtaacgttactttcactaacgaactacacttgttcctacttactaaaattcgaaactacgaccgtagggacggggaccgacggacgacgggccgttcttaagtttgttgttaggtggtaggttagtttacgtgggtacgtagtcggtacgttgggtaacggacgtagtactagacgggtcggggacccggtaaaccgggg

SEQ ID NO: 320878 - DNA, 767 bp, Homo sapiens
  misc_feature: GZ8MTXP02JS3CY.19.67.G01.1.454.CMB.2.raw
  modified_base (283)..(283): a, c, t, g, unknown or other
  misc_feature (283)..(283): n is a, c, g, or t
  modified_base (312)..(312): a, c, t, g, unknown or other
  misc_feature (312)..(312): n is a, c, g, or t
  modified_base (336)..(336): a, c, t, g, unknown or other
  misc_feature (336)..(336): n is a, c, g, or t
  modified_base (691)..(691): a, c, t, g, unknown or other
  misc_feature (691)..(691): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtgggcggaggtcttggtccagccgtgggcggtctcgtgacgtactgtcctgtcgaaccctgtgggtctccgtcncgcagcgtactgtatcgccgtcgggtccnccgaggcctaccggaggggaacgnggggaccccgggagggttcggggtaccgaccgttaaaggtttaacgttttttaaggacggggtttacggggaaccgtactacgtttccgtaacgggactaccgtcgacgtgggggaacgggtcccgtattacccgaccctagtacctaccgaacggtacttaacttttccaacaacccgaaactacccgtacttacgttacccttaaccttacgtaaaaacgttggaaacccgtaacggtaccccgttgggggaaccgggggtacccgaaaccgggggaaaccgtacccggggtacccggtttaaccttaagtttacgtttaaggtcggtttacggaaggtttaaggttttacgnggtaccggtgtacgggtgttaggggtaagacgtaaacgtacggtaccgaccgggtcggggaaccgtaacccggggg

SEQ ID NO: 320879 - DNA, 254 bp, Homo sapiens
  misc_feature: GZ8MTXP01ADOCA.44.26.C04.1.454.CMB.2.raw
  modified_base (253)..(254): a, c, t, g, unknown or other
  misc_feature (253)..(254): n is a, c, g, or t
tcagacagtatatacacgaccggtgctcgatttagtctagcgactttgggtttgggagttgcatactactactacggtatggacgtctgggccaagggaccacggtcaccgtctcctcagcttccaccaagggcccatcggtcttcccctggcgccctgctccaggagcacctctggggcacagcggccctgggctgcctggtcaaggactacttcctatatactgtctgagcgggctggcaaggcgcatagnn

SEQ ID NO: 320880 - DNA, 565 bp, Homo sapiens
  misc_feature: GZ8MTXP01B45CD.44.26.C04.1.454.CMB.2.raw
  modified_base (198)..(198): a, c, t, g, unknown or other
  misc_feature (198)..(198): n is a, c, g, or t
  modified_base (253)..(253): a, c, t, g, unknown or other
  misc_feature (253)..(253): n is a, c, g, or t
  modified_base (351)..(351): a, c, t, g, unknown or other
  misc_feature (351)..(351): n is a, c, g, or t
  modified_base (547)..(547): a, c, t, g, unknown or other
  misc_feature (547)..(547): n is a, c, g, or t
tcagacagtatatacacgaccggtgctcgatttagtctagcgactttgggtttgggggtgggcacaagaggcagcactcaggacaatctccagcatggcctggtctcctctcctcctcactctcctcgctcactgcacagggtcctgggcccactctgtgctgacgcagcccgccctcagtgtcgtggggccccgggnagagggtcaccatctcctgcacgtgggagcagactccaacatcgggacagattcngatgtccatggtaccaacaccttcaggaacacgcccccaaatcctcattctttaggaaacactatccggccctcgacggggtcccctgaccgattccnctggctccaagtctggcacctcacgccctcccgtggcctattacgtgggacctccgagggctagaaagtagtggagggtagtattacttacgtcgccgtagttccctatcgacagcagccctgtaggttgggttgggtgttcgggcggacgggtaccaaggcgtcgaccgttcgttgggtcacggcccgaaggccnccgtccccgttcggtccc

SEQ ID NO: 320881 - DNA, 827 bp, Homo sapiens
  misc_feature: GZ8MTXP01AE3HJ.44.26.C04.1.454.CMB.2.raw
  modified_base (201)..(201): a, c, t, g, unknown or other
  misc_feature (201)..(201): n is a, c, g, or t
  modified_base (232)..(232): a, c, t, g, unknown or other
  misc_feature (232)..(232): n is a, c, g, or t
  modified_base (265)..(265): a, c, t, g, unknown or other
  misc_feature (265)..(265): n is a, c, g, or t
tcagacagtatatacacgaccggtgctcgatttagtctagcgactttgggtttgggggtgggcacaagaggcagcactcaggacaatctccagcatggcctggtctcctctcctcctcactctcctcgctcactgcacagggtcctgggcccactctgtgttgacgcacgcccgccctcagtgtcgtcgggggccccgggnaggacggtcaccatctcctgcacgtggggancaagactaccaactagtcgggacagtacttcgnggactcggtaccacgtcggtaacccaacgtacccgttccgaaacgggaaacccaccggtacccccccaaaaactttcccctacgtaacgtttccggtttttaacgggaaaaccctaaaccgttacggtccccgggtaccccctttacgggtaaaccggggggttcccctacgggtaaacccggtacttttccgtaaccgttccggggccttaacccgtaaacggttccgtaacgggaccctaacccgttccgaacccgggtcccctttaccccgtgggaccctaaacgttcccgaaccggtttcgggcccttacggacgggtaccgttaacggaaacggtacgtacggggtaacgggttacgttaatttaacgttccgttacgaccggggttaacgttcccttaagtacgggaacctaggaccgtaacgtccccgttaaggtcgggttgggttcggggtacggttcgggacgggttacggaccgaaacgtcgtacggttaccgttcggttcgggaacccgcggtaacccgaacggtcccgacccgttccccgcggttccccg

SEQ ID NO: 320882 - DNA, 626 bp, Homo sapiens
  misc_feature: GZ8MTXP02G6ZC3.44.26.C04.1.454.CMB.2.raw
  modified_base (264)..(264): a, c, t, g, unknown or other
  misc_feature (264)..(264): n is a, c, g, or t
  modified_base (624)..(626): a, c, t, g, unknown or other
  misc_feature (624)..(626): n is a, c, g, or t
tcagacagtatatacacgaccggtgctcgatttagtctagcgactttgggtttgggggacgcctagttcggccgggggggcccctaagactctcctgtctcgtctctgaacccacctttagcagctactggatgcactgggtccgccaagctccaggaaagggcctgatgtgggtctcacgtattaacaccgatgggactatcactggttactcagacgccgtgaagggccattcatcatctccagagacaatgtacgaaaacncggtgtattacaaatgaacagtctaagagtcgaggacacggctgtctactattgtgtgagtaccttatgtatttcacgtttgggggatttagtcggtttggcccacaccgtggggcccaggggtaaccttgggtccgttcgtcctccttcacgtccttccaccgaacggggccccagttcccggttcccttccccccgtgggcccgccccgttgcctcccgaggtacgccgtacccgtcggtcgggggacacggcggcccggcccgtggggcctcggcccgtggtaccaagggtccttacgttcccgtaatacgtactgtccgtcgacggtcgggctcggaacgaacggggcacgatcgnnn

SEQ ID NO: 320883 - DNA, 527 bp, Homo sapiens
  misc_feature: GZ8MTXP01C8TOV.19.13.B02.1.454.CMB.2.raw
  modified_base (302)..(302): a, c, t, g, unknown or other
  misc_feature (302)..(302): n is a, c, g, or t
  modified_base (521)..(521): a, c, t, g, unknown or other
  misc_feature (521)..(521): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggaggtccctgagactctcctgtgcagcctctggatcaccttcagtagctatggcatgcactgggtccnccaggcctccgagggcaagggggctggagtgggtgcagttatatcataatgaatagggaaagtaaataaatactatgcagactccgtagaagggccgatacaccatctaccagagaacaacttaccaaagaaacaacgctagtatctgacaaatcgaaacagccctaagagagcgttggaaggacacggcttgtgttattaacgtggtgacggtaaggnggtaag

SEQ ID NO: 320884 - DNA, 726 bp, Homo sapiens
  misc_feature: GZ8MTXP01ETRLU.19.13.B02.1.454.CMB.2.raw
  modified_base (263)..(263): a, c, t, g, unknown or other
  misc_feature (263)..(263): n is a, c, g, or t
  modified_base (276)..(276): a, c, t, g, unknown or other
  misc_feature (276)..(276): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagcgtggtttcgtcgttagctctttaagaggtgtccagtgtcaggtgcagctggtggagtcgtgggggagcgtggtccagcctgggaggtccctgagactctcctgtgcagcctntggattcaccttnagtagctagtgctagtcgcctacgtcgggcccgcgacggtcctaccggagggacggaagggggtcgtaggggtagggttggggtcggtaccgtaaggtttatacgtacgtaagttaagtaggtaaggttaaagggtaaaagttaaaattaaaacgttaacgttaagtacgtaccgtaacgtaccgttaccgggtaagggaaccgggtacccgttaactttacccaacctacttacccgaaccgaacgtaacgtaaacgtaaaccgttaaccgtaaacgtaaaccgtaaccgtacgttacgttacgtacgtacgtaacgtaaacgtaacgtaaacgtaacgtacgtaacggaacggacggtacggttacggaacggaacggttacggttcgttacggttaagttacgttaacgttacggtacgggttacgggtaacgggttaacgggtaag

SEQ ID NO: 320885 - DNA, 548 bp, Homo sapiens
  misc_feature: GZ8MTXP01AVMRS.19.13.B02.1.454.CMB.2.raw
  modified_base (263)..(263): a, c, t, g, unknown or other
  misc_feature (263)..(263): n is a, c, g, or t
  modified_base (301)..(301): a, c, t, g, unknown or other
  misc_feature (301)..(301): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagctctcctgtgcagcctcnggatcacttcagtagctatggcatgcactggggtcccncaggctccgagggcaagggggctgggagtggggtgccaggttatagtcataatgaatagggaaataaataaatactatgcagtactccgtaggaagggcctagttacacatctaccagacgaactaacttaccgaaagaacacgtactagtactctagacaaatagaactacgcctaaggaagagcgttaggaacggacgacgggcttaggtaagtattaacgtggtggacggaacgggttggtaag

SEQ ID NO: 320886 - DNA, 593 bp, Homo sapiens
  misc_feature: GZ8MTXP01D8QF6.19.13.B02.1.454.CMB.2.raw
  modified_base (310)..(310): a, c, t, g, unknown or other
  misc_feature (310)..(310): n is a, c, g, or t
  modified_base (514)..(514): a, c, t, g, unknown or other
  misc_feature (514)..(514): n is a, c, g, or t
  modified_base (548)..(548): a, c, t, g, unknown or other
  misc_feature (548)..(548): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagccgtgggacgtccctgacgactctcctgtgcagcctcgtggatccaccttcagtagctagtggcatgcacgtcggggtcccnccgaggcctccgagggcgaagggggcttagggaggtggggtgcctaggttatatcaataagtgaagtagggaaagttaaataaaactactatgacaagtactaccggtaggaacgggccgtaatttaccaacctattccaccgaagaacgaactaaacttaccgaaacgaaacacgactagtactcgtagaacaaatcgaaacncgcctaagaagagcgttaggaaggacgacggttnttaggtaagttacttaagttggcggacggtaagggttcggttaag

SEQ ID NO: 320887 - DNA, 513 bp, Homo sapiens
  misc_feature: GZ8MTXP01BH1MB.19.13.B02.1.454.CMB.2.raw
  modified_base (303)..(303): a, c, t, g, unknown or other
  misc_feature (303)..(303): n is a, c, g, or t
  modified_base (344)..(344): a, c, t, g, unknown or other
  misc_feature (344)..(344): n is a, c, g, or t
  modified_base (490)..(490): a, c, t, g, unknown or other
  misc_feature (490)..(490): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaggtccctgagactctcctgtgcagcctctggatcaccttcagtagctatggcatgcactgggtccncaggctccagggcaagggggctggagtgggtggccagttanatcataatgaatggaaagtaataatactatgcagactccgtgaacgggccgattcaaccatcctccagagaacaattccaaagaacacgactgtatctagacaaatgaaacagcctgaagaggcttggacggacacgggcttggtntataactgtgcgaaggcggtaag

SEQ ID NO: 320888 - DNA, 518 bp, Homo sapiens
  misc_feature: GZ8MTXP01D7R07.19.13.B02.1.454.CMB.2.raw
  modified_base (302)..(302): a, c, t, g, unknown or other
  misc_feature (302)..(302): n is a, c, g, or t
  modified_base (333)..(333): a, c, t, g, unknown or other
  misc_feature (333)..(333): n is a, c, g, or t
  modified_base (341)..(341): a, c, t, g, unknown or other
  misc_feature (341)..(341): n is a, c, g, or t
  modified_base (494)..(494): a, c, t, g, unknown or other
  misc_feature (494)..(494): n is a, c, g, or t
  modified_base (499)..(499): a, c, t, g, unknown or other
  misc_feature (499)..(499): n is a, c, g, or t
  modified_base (504)..(504): a, c, t, g, unknown or other
  misc_feature (504)..(504): n is a, c, g, or t
  modified_base (508)..(508): a, c, t, g, unknown or other
  misc_feature (508)..(508): n is a, c, g, or t
  modified_base (510)..(510): a, c, t, g, unknown or other
  misc_feature (510)..(510): n is a, c, g, or t
  modified_base (513)..(513): a, c, t, g, unknown or other
  misc_feature (513)..(513): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctgggtggagtcgtggggggagcgtggtccagcctgggagtccctgagactctcctgtgcagcctctggatcacttcagtagctatggcatgcactgggtccncaggctccgaggcaagggggctggagtgggngcagttanagtcataatgaagtgggaaagtaaataaagtactaatgacagactccggtagaacgggccgattcaccatctaccaagagaactaaattaccgaaagtaacacgctagtatctagacaaatgaacacgctaagagagcttagagacacggttnttgtntatgngtgngnggngtaag

SEQ ID NO: 320889 - DNA, 541 bp, Homo sapiens
  misc_feature: GZ8MTXP01BETI6.19.13.B02.1.454.CMB.2.raw
  modified_base (304)..(304): a, c, t, g, unknown or other
  misc_feature (304)..(304): n is a, c, g, or t
  modified_base (473)..(473): a, c, t, g, unknown or other
  misc_feature (473)..(473): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctggggagtccctgagctctcctgtgcagcctctggatcaccttcagtagctatggcatgcacgtggggtcccncaggcctccgaggcgaagggggctgggagtggggtgcctaggttatatcataatgaatagggaaattaaataaatactatgacagactccgtaggaacgggccgtatcgaccatcctaccagagaacaacttaccgaaagaacacgctagtatctagacaaatgaaacngcctaagagagcgttaggacggacacgggcttgtgtagttaacgtggtggacggtaagggttcgtaag

SEQ ID NO: 320890 - DNA, 516 bp, Homo sapiens
  misc_feature: GZ8MTXP01DI5AJ.19.13.B02.1.454.CMB.2.raw
  modified_base (305)..(305): a, c, t, g, unknown or other
  misc_feature (305)..(305): n is a, c, g, or t
  modified_base (401)..(401): a, c, t, g, unknown or other
  misc_feature (401)..(401): n is a, c, g, or t
  modified_base (418)..(418): a, c, t, g, unknown or other
  misc_feature (418)..(418): n is a, c, g, or t
  modified_base (423)..(423): a, c, t, g, unknown or other
  misc_feature (423)..(423): n is a, c, g, or t
  modified_base (425)..(425): a, c, t, g, unknown or other
  misc_feature (425)..(425): n is a, c, g, or t
  modified_base (457)..(457): a, c, t, g, unknown or other
  misc_feature (457)..(457): n is a, c, g, or t
  modified_base (463)..(463): a, c, t, g, unknown or other
  misc_feature (463)..(463): n is a, c, g, or t
  modified_base (511)..(511): a, c, t, g, unknown or other
  misc_feature (511)..(511): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcctctggatcaccttcagtagctaatggcatgcacgtggggtcccnccaggcctccagggccgaagggggctgggagtggggtgccaggttatatcaataatgaatagggaaaattaaataaaatactatgcagactaccgngaagggccatcacatcncagananaattacaagaacacgctatatcagacaaatanaacacncaagagagacgagagacgacgcttgtaagtataagtgtgagtaacggngtaag

SEQ ID NO: 320891 - DNA, 577 bp, Homo sapiens
  misc_feature: GZ8MTXP01AZ7OZ.19.13.B02.1.454.CMB.2.raw
  modified_base (306)..(306): a, c, t, g, unknown or other
  misc_feature (306)..(306): n is a, c, g, or t
  modified_base (351)..(351): a, c, t, g, unknown or other
  misc_feature (351)..(351): n is a, c, g, or t
  modified_base (361)..(361): a, c, t, g, unknown or other
  misc_feature (361)..(361): n is a, c, g, or t
  modified_base (517)..(517): a, c, t, g, unknown or other
  misc_feature (517)..(517): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagcgtggtggagtcgtgggggaggcgtggtccagccgtgggagtccctgagctctcctgtgcagcctgtggatcaccttcagtagctatggcatgcacgtcgggtcccncgaggctcgaggcgaagggggctgggagtggggtgcctaggttanagtcataagngaatagggtaaaattaaataaatactaagtcgacagtacctccggtaggaacgggtccgtaattaccgaccgtactccgtacccgagaacgactaaacgttaccgaaagaacctacgtactagtactcgtagaaccaatacgaacagtccaagagngacgttgaacggacgacggttcttgtaagtattaacgtggtcgacggtgggttcgttaag

SEQ ID NO: 320892 - DNA, 626 bp, Homo sapiens
  misc_feature: GZ8MTXP01BCCXM.19.13.B02.1.454.CMB.2.raw
  modified_base (267)..(267): a, c, t, g, unknown or other
  misc_feature (267)..(267): n is a, c, g, or t
  modified_base (278)..(278): a, c, t, g, unknown or other
  misc_feature (278)..(278): n is a, c, g, or t
  modified_base (288)..(288): a, c, t, g, unknown or other
  misc_feature (288)..(288): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagcgtggtttcgcgttaggctctttaagaggtgtccagtgtcaggtgcagctggtggagtgtgggggagcgtggtccagccgtgggacggtccctgagtactctcctgtgctacgcctnggatcaccttnagtagctagngcagtcgctacgtcggccgacgacggcctacgaggacggaagggggtcgtaggggtacgggttgggggtacgtaccgttaagtttataagtactaagtaagtaggtaagtaagggtaaaattaaactaaatacgtagtacgtacgtacgtacgtaccggtaggacggtaccgtataccactactacgacaagaacgaactaactaaccgaaagtaacgtacgtacgtagtactactacgaacgtaaacgtaacgaacgacgcgtaagagacgacgacgacgacgacgttcgttacgtaagtacgtaacgtgtcggttacggtaacggttaacggtaag

SEQ ID NO: 320893 - DNA, 550 bp, Homo sapiens
  misc_feature: GZ8MTXP01DZMHM.19.13.B02.1.454.CMB.2.raw
  modified_base (301)..(301): a, c, t, g, unknown or other
  misc_feature (301)..(301): n is a, c, g, or t
  modified_base (404)..(404): a, c, t, g, unknown or other
  misc_feature (404)..(404): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggagtccctgagactctcctgtgcagcctctggatcaccttcagtagctatggcatgcactggggtccncaggctccgaggcaagggggctgggagtggggtgccagttatatcataatgaatgggaaagtaaataaatctatgcagactcgtgaagggccgattcacatcnccagagacaattaccaaagaacacgctagtatctagacaaatgaaacacgcctgaaggagaccgttaggaacgggaaccgaccgggttcgttggtaaggttaatttaaccgttgggtcggttacgggtaagggttcgggttaaagg

SEQ ID NO: 320894 - DNA, 597 bp, Homo sapiens
  misc_feature: GZ8MTXP01AKAMO.19.13.B02.1.454.CMB.2.raw
  modified_base (256)..(256): a, c, t, g, unknown or other
  misc_feature (256)..(256): n is a, c, g, or t
  modified_base (264)..(264): a, c, t, g, unknown or other
  misc_feature (264)..(264): n is a, c, g, or t
  modified_base (274)..(274): a, c, t, g, unknown or other
  misc_feature (274)..(274): n is a, c, g, or t
  modified_base (302)..(302): a, c, t, g, unknown or other
  misc_feature (302)..(302): n is a, c, g, or t
  modified_base (388)..(388): a, c, t, g, unknown or other
  misc_feature (388)..(388): n is a, c, g, or t
  modified_base (492)..(492): a, c, t, g, unknown or other
  misc_feature (492)..(492): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtncagcctcnggatcacttnagtagctatggcatgcacgtgggtcccncaggcctccgagggccgaagggggcttagggaggtggggtggcctaggttatatcataatggaatagggaaataaataaatactangacagtactccggtaggaacgggcctattaccacctactcaccgagtaacaactaacttaccgaaagtaaccgactcgtataactcgtagacaaatacgaaacncgtaccgtaagaacgttacgaccgttagaacgggaaccgttacgggttcttggttaagttacgtttaacggtggtaggttaccggggtaaggttccgggttaagg

SEQ ID NO: 320895 - DNA, 519 bp, Homo sapiens
  misc_feature: GZ8MTXP01BNRI6.19.13.B02.1.454.CMB.2.raw
  modified_base (345)..(345): a, c, t, g, unknown or other
  misc_feature (345)..(345): n is a, c, g, or t
  modified_base (438)..(438): a, c, t, g, unknown or other
  misc_feature (438)..(438): n is a, c, g, or t
  modified_base (462)..(462): a, c, t, g, unknown or other
  misc_feature (462)..(462): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggagtccctgagactctcctgtgcagcctctggatcaccttcagtagctatggcatgcactgggtccgccaggctccgagggcaagggggctggagtgggtgccaggttanagtcataatgaatgggaaagttaaataaatactatgacagactccgtgaagggccgattacgacctatcgtaccagagaacaattaccgaaanaacacgctacgtatctgacaaatnaacagcctgacgagcttgaggacacggcttgtgtataactggtgcgaaggcggtaag

SEQ ID NO: 320896 - DNA, 585 bp, Homo sapiens
  misc_feature: GZ8MTXP01EHE3I.19.13.B02.1.454.CMB.2.raw
  modified_base (307)..(307): a, c, t, g, unknown or other
  misc_feature (307)..(307): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtggagtcgtgggggagcgtggtccagccgtgggagtccctgagactctcctgtgcagcctctggatccaccttcagtagctatggcatgcacgtggggtcccnccaggcctccgagggcgaagggggctgggagtggggtgcctagttatatcattaatgaagtagggtaaaattaaataaatactatgacagacgtaccggtaggaacgggccgtattaccacctatcctaccaagaacaaactaaacttaccgaaacgaaacacgacttagtactctagaacaaatagaaacacgacctaaggaagaggacgttaggaacggaacgacggttcgttggttaagttagttaacgtggtggacgggtaagggttcggtaag

SEQ ID NO: 320897 - DNA, 522 bp, Homo sapiens
  misc_feature: GZ8MTXP01EPIUO.19.13.B02.1.454.CMB.2.raw
  modified_base (300)..(300): a, c, t, g, unknown or other
  misc_feature (300)..(300): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcctctggatcacttcagtagctatggcatgcactgggtccncaggctccgaggcaagggggctgggagtggggtgccagttatagtcataagtgaatagggaaagtaaataaatactatgacagactccgtagagggccgattacacatctacagagaacaattaccgaaagtaacacgctagtatctagacaaatgaaacagcctgaagagcttggaaggacacggcttggtgttattaacgtgtggcgtaagggcggtaag

SEQ ID NO: 320898 - DNA, 533 bp, Homo sapiens
  misc_feature: GZ8MTXP01DCFR6.19.13.B02.1.454.CMB.2.raw
  modified_base (275)..(275): a, c, t, g, unknown or other
  misc_feature (275)..(275): n is a, c, g, or t
  modified_base (303)..(303): a, c, t, g, unknown or other
  misc_feature (303)..(303): n is a, c, g, or t
  modified_base (450)..(450): a, c, t, g, unknown or other
  misc_feature (450)..(450): n is a, c, g, or t
  modified_base (466)..(466): a, c, t, g, unknown or other
  misc_feature (466)..(466): n is a, c, g, or t
  modified_base (502)..(502): a, c, t, g, unknown or other
  misc_feature (502)..(502): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcctctggatcaccttnagtagctatggcatgcacgtggggcccnccaggctccgagggcgaagggggctgggagtggggtcggccaggttatagtcattaatgaatgggaaaagttaaataaaatacatgacagactcgtagaaggccgatcaccatcacagacgaacaattccgaaagaacacgctgtanctagacaaatgaaacncgcctaagacgagcaggaagcgacggttcttaggtntaagttcgtggtcgacgggaaggcggttaag

SEQ ID NO: 320899 - DNA, 550 bp, Homo sapiens
  misc_feature: GZ8MTXP01CR6R2.19.13.B02.1.454.CMB.2.raw
  modified_base (359)..(359): a, c, t, g, unknown or other
  misc_feature (359)..(359): n is a, c, g, or t
  modified_base (541)..(541): a, c, t, g, unknown or other
  misc_feature (541)..(541): n is a, c, g, or t
  modified_base (544)..(544): a, c, t, g, unknown or other
  misc_feature (544)..(544): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccagccgtgggagtcctgagctctcctgtgcagcctctggatcaccttcagtagctagtggcatgccacgtggggtcccgcaggctccgagggcgaagggggctgggaggtgggtgctagttatatcataangaataggaaagtaaataaagtactatgacagtacgtaccggtaggaacgggccgtaattaccaacctactaccaccaagaacgaaactaacttaccgaaacgtaaccacgtactagtactcgtagaacaaatagaacacgcaagagagcgagacgacgacgcgttgtgtataagtgtgcggnggnggtaag

SEQ ID NO: 320900 - DNA, 598 bp, Homo sapiens
  misc_feature: GZ8MTXP01DTTFH.19.13.B02.1.454.CMB.2.raw
  modified_base (264)..(264): a, c, t, g, unknown or other
  misc_feature (264)..(264): n is a, c, g, or t
  modified_base (277)..(277): a, c, t, g, unknown or other
  misc_feature (277)..(277): n is a, c, g, or t
  modified_base (305)..(305): a, c, t, g, unknown or other
  misc_feature (305)..(305): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtggagtcgtgggggagcgtggtccagcctgggagtccctgagactctcctgtgcagcctntggactcaccttnagtagctatggcatgcacgtggggcccnccaggcctccgagggcgaagggggctagggagtggggtgacctaggtttatatcaattaagtagaagtagggtaaaattaaaacttaaaatactaagtgacaagtacgtccggtaggaacgggcctaattaccactactcctaccaagaacaactaaacttaccgaaacgaacacgactagtactctagaaacaaagtacgaacacgccaagagagacgttaggaagtaccgaacgggttcgttaggttaagttaacgttcgtggtcggttacggtaacgggttaacggtaag

SEQ ID NO: 320901 - DNA, 504 bp, Homo sapiens
  misc_feature: GZ8MTXP01D1RXK.19.13.B02.1.454.CMB.2.raw
  modified_base (300)..(300): a, c, t, g, unknown or other
  misc_feature (300)..(300): n is a, c, g, or t
  modified_base (339)..(339): a, c, t, g, unknown or other
  misc_feature (339)..(339): n is a, c, g, or t
  modified_base (453)..(453): a, c, t, g, unknown or other
  misc_feature (453)..(453): n is a, c, g, or t
  modified_base (479)..(479): a, c, t, g, unknown or other
  misc_feature (479)..(479): n is a, c, g, or t
  modified_base (484)..(484): a, c, t, g, unknown or other
  misc_feature (484)..(484): n is a, c, g, or t
  modified_base (492)..(492): a, c, t, g, unknown or other
  misc_feature (492)..(492): n is a, c, g, or t
  modified_base (499)..(499): a, c, t, g, unknown or other
  misc_feature (499)..(499): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggaggtccctgagactctcctgtgcagcctctggatcacttcagtagctatggcatgcactgggtccnccaggctccgaggcaagggggctggagtggtgcagttanatcatatgaatggaaagtaaataaatactatgacagactcgtagaacgggccgattacacatctccagagaacaattaccaaagtaacacgctagtaatctagacaaatgaacngcctgagagcttggacgacacggttnttgtntatcgtgngcgtggngtaag

SEQ ID NO: 320902 - DNA, 590 bp, Homo sapiens
  misc_feature: GZ8MTXP01C5WMW.19.13.B02.1.454.CMB.2.raw
  modified_base (274)..(274): a, c, t, g, unknown or other
  misc_feature (274)..(274): n is a, c, g, or t
  modified_base (304)..(304): a, c, t, g, unknown or other
  misc_feature (304)..(304): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttggctgagctgggttttcctcgttgctcttttaagaggtgtccagtgtcaggtgcagctggtggagtcgtgggggagcgtggtccagccgtgggagtccctgagctctcctgtgcagcctctggatcaccttnagtagctatggcatgcacgtggggtccccnccgaggcctaccgagggcgaagggggtctggggaggtggggtgacctaggtttatatcaagtaatgaacgtagggaaaattaaataaatctatggacagactccggtaggacggccgtataccaacctatcctaccaagacgaactaacttaccgaaagtaacccaacgtcctagtactcgtagaacaaatcgaaacacggtccaaggagttagcgaggaacgtacgacggttcttaggttaacgttaagttccgtggtacggaccggtaagggttaaccggtaag

SEQ ID NO: 320903 - DNA, 578 bp, Homo sapiens
  misc_feature: GZ8MTXP01D32K9.19.13.B02.1.454.CMB.2.raw
  modified_base (306)..(306): a, c, t, g, unknown or other
  misc_feature (306)..(306): n is a, c, g, or t
  modified_base (353)..(353): a, c, t, g, unknown or other
  misc_feature (353)..(353): n is a, c, g, or t
  modified_base (536)..(536): a, c, t, g, unknown or other
  misc_feature (536)..(536): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtggggggagcgtggtccagccgtgggagtccctgagactctcctgtgcagcctctggatcaccttcagtagctatggcatgcacgtggggtcccnccaggcctccgagggcgaagggggctgggaggtgggtgactagttanatcaattaagagaagtagggaaagttaaataaaagttactaatcgacagtacgtccggtaggaaacggggcctaattaccacctatcctaccaagaagaactaacttaccgaaagtaaacacgtactagtaactctagtaacaaagtcgaaacacgcctaagagagcgaggaacggacgacgngttagtaagttagttcgtaggtcgacggtaaggttcggtaag

SEQ ID NO: 320904 - DNA, 605 bp, Homo sapiens
  misc_feature: GZ8MTXP01CMR3N.19.13.B02.1.454.CMB.2.raw
  modified_base (303)..(303): a, c, t, g, unknown or other
  misc_feature (303)..(303): n is a, c, g, or t
  modified_base (345)..(345): a, c, t, g, unknown or other
  misc_feature (345)..(345): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagcctgggagtccctgagctctcctgtgcagcctctggatcaccttcagtagctatggcatgcactggggtcccncaggctccgagggcaagggggctggagtgggtgcctagttanatcataatgaatagggaaagtaataaatctaatgacagtacgtaccgtaggaacgggccgtaattacacccatccgtacccaagaacgaacctaaattacccgaaaacgaaaccaaccggtaccttaggtaactccgttaggaaacctaaattacggaaactacgccgttaaggaacggagtccgttaggaaagggaccgaacgggttcttaggttaagtaatttaacgtgggtcggttacgggtaagggttcgggtaag

SEQ ID NO: 320905 - DNA, 568 bp, Homo sapiens
  misc_feature: GZ8MTXP01AYPE9.19.13.B02.1.454.CMB.2.raw
  modified_base (302)..(302): a, c, t, g, unknown or other
  misc_feature (302)..(302): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagcctgggagtccctgagctctcctgtgcagcctctggatcaccttcagtagctatggcatgcacgtgggtccncaggcctccgagggcaagggggctgggagtggggtgccaggttatagtcaataatgaagtagggaaaattaaataaatactatgacagactccggtagaacgggccattacactatctccaagacaactaacttaccgaaagaaccacgacctatactacctagaacctaaatcggaaacacgcctaagagacgcttggaaacggaacacgggttcgttagttaagttacgttaacgtggtacggacggtaagggttaacggtaag

SEQ ID NO: 320906 - DNA, 528 bp, Homo sapiens
  misc_feature: GZ8MTXP01A76PN.19.13.B02.1.454.CMB.2.raw
  modified_base (304)..(304): a, c, t, g, unknown or other
  misc_feature (304)..(304): n is a, c, g, or t
  modified_base (347)..(347): a, c, t, g, unknown or other
  misc_feature (347)..(347): n is a, c, g, or t
  modified_base (355)..(355): a, c, t, g, unknown or other
  misc_feature (355)..(355): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggagtccctgagactctcctgtgcagcctctggatcaccttcagtagctatggcatgcacgtggggtccncaggcctccgagggcgaagggggctgggagtgggtgcagttanatcataangaatagggaaataaataatactatgacagactcgtagacggccgattacacatctacagagactaactaccgaaagaacacgctagtactctagactaatagaacagcctaagagagcttggaaggacacggcttaggtaagtagttcgtaggtcggacggtaagggcgtaag

SEQ ID NO: 320907 - DNA, 589 bp, Homo sapiens
  misc_feature: GZ8MTXP01BVPLV.19.13.B02.1.454.CMB.2.raw
  modified_base (349)..(349): a, c, t, g, unknown or other
  misc_feature (349)..(349): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcctctggactcaccttcagtagctagtggcagtgcacgtgggtcccgcaggcctcgaggcgaaggggctggaggtgggtgcctaggttanagtcagtaatgaagtacgaaagtaaataaatactatgacagactacggagaacggccgtaatcacctatccaccaagacgaaacaacttaccgaaagaacgacgtcttagtactcgtagaactaaagtacgaaaccagtccctaaggaagacgtacgttgggaaacggaccgaaccggggttcttaggttaacgttacgtttaacgtgggtacgggttacggtaacgggttaacggtaag

SEQ ID NO: 320908 - DNA, 533 bp, Homo sapiens
  misc_feature: GZ8MTXP01AIP1F.19.13.B02.1.454.CMB.2.raw
  modified_base (265)..(265): a, c, t, g, unknown or other
  misc_feature (265)..(265): n is a, c, g, or t
  modified_base (309)..(309): a, c, t, g, unknown or other
  misc_feature (309)..(309): n is a, c, g, or t
  modified_base (446)..(446): a, c, t, g, unknown or other
  misc_feature (446)..(446): n is a, c, g, or t
  modified_base (473)..(473): a, c, t, g, unknown or other
  misc_feature (473)..(473): n is a, c, g, or t
  modified_base (487)..(487): a, c, t, g, unknown or other
  misc_feature (487)..(487): n is a, c, g, or t
  modified_base (506)..(506): a, c, t, g, unknown or other
  misc_feature (506)..(506): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtggagtcgtgggggagcgtggtccagcctgggacgtccctgagactctcctgtgcagcctntggatcaccttcagtagctatggctatgcacgtgggggtccccncgaggcctccgagggcgaagggggctagggaggtggggtcgcctaggttatatcataatgaagtagggaaattaataaatctagtgacagactcgtagacggccatcacatcacagagacaattaccgaagtaaccncgctagtactctagacaaatgaaaccncggcctaagaacgngcgttagagggacacgggnttgtgtatcgtgtggcgtgggcgtaag

SEQ ID NO: 320909 - DNA, 657 bp, Homo sapiens
  misc_feature: GZ8MTXP01BD8OW.19.13.B02.1.454.CMB.2.raw
  modified_base (268)..(268): a, c, t, g, unknown or other
  misc_feature (268)..(268): n is a, c, g, or t
  modified_base (309)..(309): a, c, t, g, unknown or other
  misc_feature (309)..(309): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtggggggagcgtggtccagccgtggggacgtccctgagactctcctgtgcagcctntggatccacttcagtagctatggcatgcacgtggggtcccnccaggcctacgagggacgaagggggctggggaggtgggtcggacctaggttatagtcaataagtgaagtagggtaaaacttaaataaatctagtcgactacgtacgtccggtaaggaacgggtcctaatttacccacctagttacccaccgaaagaacgtaaactaaaccttaccggaaaagtaaacccgtaccggtacttagtaacttaccgtagtaaacctaaaagttacggaaaccaacggtcccgtaaggaaacgacggtaccgagggaaacgggaaccgttaccgggttcttacggttaagttaacttaacggtgggtaggaccgggtaagggttcggttaag

SEQ ID NO: 320910 - DNA, 523 bp, Homo sapiens
  misc_feature: GZ8MTXP01BMDGU.19.13.B02.1.454.CMB.2.raw
  modified_base (303)..(303): a, c, t, g, unknown or other
  misc_feature (303)..(303): n is a, c, g, or t
  modified_base (356)..(356): a, c, t, g, unknown or other
  misc_feature (356)..(356): n is a, c, g, or t
  modified_base (405)..(405): a, c, t, g, unknown or other
  misc_feature (405)..(405): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggaggtccctgagactctcctgtgcagcctctggatcaccttcagtagctatggcatgcacgtgggtccnccaggctccgaggcaagggggctggagtggggtgccaggttatatcataatgntaggaaagtaaataatactatgacagactcgtgaaggcgattcacatcncagagacaacgttcaaagaacacgctagtatctagacaaatgaacacgcctaagagagtcgttaggacggacgacggttcgttgtgttataacgtggtgacggtaagggttcggtaag

SEQ ID NO: 320911 - DNA, 630 bp, Homo sapiens
  misc_feature: GZ8MTXP01AT2SA.19.13.B02.1.454.CMB.2.raw
  modified_base (299)..(299): a, c, t, g, unknown or other
  misc_feature (299)..(299): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggagtccctgagactctcctgtgcagcctctggatcacttcagtagctatggcatgcactggggccnccaggcctccgagggcaagggggctgggagtggggtggcctaggttatatcataatggaattgggaaaggttaaaatagttaagtttagtgggaagtactccggtaggaacggggaccgtattaccaaccctattcctacccagaacgaactaaacttacccaaagggaacaacgtaaggtacggatccgtagacctaaaagtcgaaaacacgcccgtaggaaggaacggcggttacgggggaaccgtaccggggtcgttaggttggtttaaccgttttaacggttagggttggaccgggtaagggacgggtccggggttccgtaacgggg

SEQ ID NO: 320912 - DNA, 509 bp, Homo sapiens
  misc_feature: GZ8MTXP01B6NGR.19.13.B02.1.454.CMB.2.raw
  modified_base (302)..(302): a, c, t, g, unknown or other
  misc_feature (302)..(302): n is a, c, g, or t
  modified_base (465)..(465): a, c, t, g, unknown or other
  misc_feature (465)..(465): n is a, c, g, or t
  modified_base (493)..(493): a, c, t, g, unknown or other
  misc_feature (493)..(493): n is a, c, g, or t
  modified_base (497)..(497): a, c, t, g, unknown or other
  misc_feature (497)..(497): n is a, c, g, or t
  modified_base (499)..(499): a, c, t, g, unknown or other
  misc_feature (499)..(499): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaggtcctgagactctcctgtgcagcctctggatcacttcagtagctatggcatgcactgggtcccncaggctccgagggcaaggggctggagtggggtggccaggttatatcataatgaatgggaaatataaatactatgacagactccgtgaagggccagttacacatctccagagacaacttccgaaagtaacacgctagtactctgacaaatggaacagcctgagngcttggaggcaggcttgtgtattaacgngtgngnggttcgtaag

SEQ ID NO: 320913 - DNA, 538 bp, Homo sapiens
  misc_feature: GZ8MTXP01CD5WE.19.13.B02.1.454.CMB.2.raw
  modified_base (304)..(304): a, c, t, g, unknown or other
  misc_feature (304)..(304): n is a, c, g, or t
  modified_base (405)..(405): a, c, t, g, unknown or other
  misc_feature (405)..(405): n is a, c, g, or t
  modified_base (413)..(413): a, c, t, g, unknown or other
  misc_feature (413)..(413): n is a, c, g, or t
  modified_base (427)..(427): a, c, t, g, unknown or other
  misc_feature (427)..(427): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccagcctgggagtccctgagactctcctgtgcagcctctggatcaccttcagtagctatggcatgcacgtgggtccncaggctccgagggcaagggggctgggagtggggtgcctaggttatatcaataatgaatagggaaataataaatctatgacagactcgtagaggccatcacntcacaganacaacttacgaaanaacacgctgtactctagaacaaatcgaacacgtccaagaagacgacgttaggaacggacgttaacggcgttagttgttaactttcgtgggttgaccggtaaggcggttaag

SEQ ID NO: 320914 - DNA, 547 bp, Homo sapiens
  misc_feature: GZ8MTXP01BRTCF.19.13.B02.1.454.CMB.2.raw
  modified_base (263)..(263): a, c, t, g, unknown or other
  misc_feature (263)..(263): n is a, c, g, or t
  modified_base (346)..(346): a, c, t, g, unknown or other
  misc_feature (346)..(346): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggaggtcctgagactctcctgtgcagcctntggatcacttcagtagctatggcatgcacgtgggtcccgccaggctccgaggcgaagggggctggagtggggtgccaggttanatcataatgaatggaaagtaataaatactatgacagactccggtagaagggccgattaccacctatctaccagtagaactaacttaccgaaagaacacgctagtactctagactaaatcgaacacgcctaagagagcgttaggaacggaccacgggcttggtaagttattaacgtggtacggacggtaacgggcggttaag

SEQ ID NO: 320915 - DNA, 559 bp, Homo sapiens
  misc_feature: GZ8MTXP01DHTYN.19.13.B02.1.454.CMB.2.raw
  modified_base (263)..(263): a, c, t, g, unknown or other
  misc_feature (263)..(263): n is a, c, g, or t
  modified_base (302)..(302): a, c, t, g, unknown or other
  misc_feature (302)..(302): n is a, c, g, or t
  modified_base (339)..(339): a, c, t, g, unknown or other
  misc_feature (339)..(339): n is a, c, g, or t
  modified_base (524)..(524): a, c, t, g, unknown or other
  misc_feature (524)..(524): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcctntggatcaccttcagtagctatggcatgcactggggtccnccaggcctccgagggcgaagggggctgggagtggggngctagttatatcataatgaatagggaaattaaataaatactatagacagtactaccggtaggaacgggccgtaattaccaccattaccaccgaagaacgactaaacttaccaaagtaaacacgtactagtaactctagacaaatagaaacacgcctaagacgagcgttagaacggacacgggttnttagtgtattcgtggtcgacggtaaggttcgtaag

SEQ ID NO: 320916 - DNA, 592 bp, Homo sapiens
  misc_feature: GZ8MTXP01CJE68.19.13.B02.1.454.CMB.2.raw
  modified_base (178)..(178): a, c, t, g, unknown or other
  misc_feature (178)..(178): n is a, c, g, or t
  modified_base (548)..(548): a, c, t, g, unknown or other
  misc_feature (548)..(548): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagnggtgtccagtgtcaggtgcagctggtggagtcgtgggggagcgtggtccagccgtgggacggtccctgagactctcctgtgcagcctctggactcaccttcagtagctatggcatgcacgtggggtcccgccgaggcctcccgagggccgaagggggctggggaggtggggtggcctaggttatagtcaataagtgaatagggtaaaacgttaaattaaatactaatcgactaagtaccgtaccggaggaacgggccgtattacaacctattccaccgaagaacgactaaacttaccgaaacgaacacgactagtactctagaacaaatagaaccagcctaagagagcgttaggaacggacaccgggttnttaggtaagttagttcgtgggtacggacggtaacggttcgtaag

SEQ ID NO: 320917 - DNA, 516 bp, Homo sapiens
  misc_feature: GZ8MTXP01EMS13.19.13.B02.1.454.CMB.2.raw
  modified_base (301)..(301): a, c, t, g, unknown or other
  misc_feature (301)..(301): n is a, c, g, or t
  modified_base (332)..(332): a, c, t, g, unknown or other
  misc_feature (332)..(332): n is a, c, g, or t
  modified_base (341)..(341): a, c, t, g, unknown or other
  misc_feature (341)..(341): n is a, c, g, or t
  modified_base (498)..(498): a, c, t, g, unknown or other
  misc_feature (498)..(498): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggaggtccctgagactctcctgtgcagcctctggatcacttcagtagctatggcatgcactgggtccncaggctccaggcaagggggctggagtggggngccagttanatcataatgaatgggaaataaataaatactatgacagactccgtgaagggccgattccaccatcctaccagagaacaattaccgaaagaacacgctagtactctagacaaatcgaacagcctgagagcttaggacgacacggcttgtgtattaacgnggtgcgtaaggcggtaag

SEQ ID NO: 320918 - DNA, 556 bp, Homo sapiens
  misc_feature: GZ8MTXP01CQA2J.19.13.B02.1.454.CMB.2.raw
  modified_base (302)..(302): a, c, t, g, unknown or other
  misc_feature (302)..(302): n is a, c, g, or t
  modified_base (343)..(343): a, c, t, g, unknown or other
  misc_feature (343)..(343): n is a, c, g, or t
  modified_base (385)..(385): a, c, t, g, unknown or other
  misc_feature (385)..(385): n is a, c, g, or t
  modified_base (526)..(526): a, c, t, g, unknown or other
  misc_feature (526)..(526): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagccgtgggagtccctgagactctcctgtgcagcctctggatcaccttcagtgctatggcatgcactgggtccnccaggctccgagggcaagggggctggagtgggtgcagttantcataatgaataggaaataaataaatactatgacagactcgngaaggcattcacatctccgagacgaactaattccgaaagaacacgactagtactcgtagaactaaagtgaaacagccctaaggaacggagtaccgttggaaacgggacgttacgggttcttaggttaagtacgtttaacgngggttagaccgggtaagggttccggttaag

SEQ ID NO: 320919 - DNA, 522 bp, Homo sapiens
  misc_feature: GZ8MTXP01DRYG9.19.13.B02.1.454.CMB.2.raw
  modified_base (304)..(304): a, c, t, g, unknown or other
  misc_feature (304)..(304): n is a, c, g, or t
  modified_base (408)..(408): a, c, t, g, unknown or other
  misc_feature (408)..(408): n is a, c, g, or t
  modified_base (425)..(425): a, c, t, g, unknown or other
  misc_feature (425)..(425): n is a, c, g, or t
  modified_base (486)..(486): a, c, t, g, unknown or other
  misc_feature (486)..(486): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtggggggagcgtggtccagcctgggagtccctgagactctcctgtgcagcctctggatcacttcagtagctatggcatgcacgtggggtcccnccaggctccgagggcaagggggctgggagtgggtgccagttatatcataagtgaagtaggaaagtaaataaatctatgacagactcgtagaggcatacacatcncagacgacaatacgaanaacacgctgtatctagaacaaatgaaacacgcctaagacgagtcttaggagacgacggttnttagtgttaattaacgtggtgacggtaaggcgtaag

SEQ ID NO: 320920 - DNA, 553 bp, Homo sapiens
  misc_feature: GZ8MTXP01BOWIQ.19.13.B02.1.454.CMB.2.raw
  modified_base (305)..(305): a, c, t, g, unknown or other
  misc_feature (305)..(305): n is a, c, g, or t
  modified_base (352)..(352): a, c, t, g, unknown or other
  misc_feature (352)..(352): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgagactctcctgtgcagcctctggatcaccttcagtagctatggcatgcacgtggggtcccnccaggcctccgagggcaagggggctgggagtggggtgcctaggttanatcataatgaatgggaaataaataaatactatgacagactccggtagaacggggccattaccacctatcctaccaagtacgaactaaacttaccgaaagaacaccgactagtatcgtgaacaaatcgaacagcctaagagagtcaggaagacacgggttcttaggtgtattaacgtggtacggcggtaagggttcggtaag

SEQ ID NO: 320921 - DNA, 748 bp, Homo sapiens
  misc_feature: GZ8MTXP01ECLWG.19.13.B02.1.454.CMB.2.raw
  modified_base (162)..(162): a, c, t, g, unknown or other
  misc_feature (162)..(162): n is a, c, g, or t
  modified_base (286)..(286): a, c, t, g, unknown or other
  misc_feature (286)..(286): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagcgtggttttccncgttagctcttttaagaggtgtccagtgtcaggtgcagctggtggagtcgtgggggagcgtggtccaggccgtgggacggtccctggacgacctctcctgtgcagcctcgtggacttcaccttnagtagctagtcggactagtcgaccgtacggtccgggggtccccgaccggtacggtcccgtacccggaacggggacgggaaacggggggtccgttagggggtacggggttcgggggtacggtaccgttaaggtttaataacgtacgtaagttaaacggtagggtaaggttaaagggtaaaaaagtttaaaacttaaaacgtacgtaagtacgtaaccgtaacggtaccgttaccgggtaaggaaccgggtaccgtacttaaccaccgtataccgtacgaagaacgtaaactaaacgttaaccgaaacgtaaaccgtacgtacgtagtactacgtaacgaaactaaacgtaacgaacgaacgaccgtaacgaacgacggtacgttacggaacggaacgttacggttcgttacgttaacgttacgttaacgtcggtacggttacgggtaacggttaacggtaacg

SEQ ID NO: 320922 - DNA, 568 bp, Homo sapiens
  misc_feature: GZ8MTXP01C878W.19.13.B02.1.454.CMB.2.raw
  modified_base (301)..(301): a, c, t, g, unknown or other
  misc_feature (301)..(301): n is a, c, g, or t
  modified_base (344)..(344): a, c, t, g, unknown or other
  misc_feature (344)..(344): n is a, c, g, or t
  modified_base (353)..(353): a, c, t, g, unknown or other
  misc_feature (353)..(353): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagctctcctgtgcagcctctggatcaccttcagtagctatggcatgcacgtggggccncaggctccgagggcaagggggctgggagtgggtggcaggttanatcaataangaatagggaaataaataaatactagtgacagactcggtagaacggcgtattaccacctatcctacagtaacgaactaaacttaccgaaagtaaacctacgttagtaactcctagaacaaatcgaaacagacctggaagagcgtacggaggacgaaccgggttcgttggttacgttaagttacgtgtacggacggttagggtaacgttaagtaacg

SEQ ID NO: 320923 - DNA, 527 bp, Homo sapiens
  misc_feature: GZ8MTXP01BWWQ8.19.13.B02.1.454.CMB.2.raw
  modified_base (304)..(304): a, c, t, g, unknown or other
  misc_feature (304)..(304): n is a, c, g, or t
  modified_base (348)..(348): a, c, t, g, unknown or other
  misc_feature (348)..(348): n is a, c, g, or t
  modified_base (478)..(478): a, c, t, g, unknown or other
  misc_feature (478)..(478): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcctctggatcaccttcagtagctatggcatgcacgtggggtcccncaggctccgagggcgaagggggctggagtggggtgcctagttanatcataatgaagtaggaaagtaaataaatactatgacagactccgtagaacgggccgattacactatctaccagagacaattaccgaaagaacacgactagtatctagacaaatgaaacagcctaagagngcaggacggacacggcttagtgtataacgtgtggcggtaaggcggtaag

SEQ ID NO: 320924 - DNA, 596 bp, Homo sapiens
  misc_feature: GZ8MTXP01CVUOC.19.13.B02.1.454.CMB.2.raw
  modified_base (258)..(258): a, c, t, g, unknown or other
  misc_feature (258)..(258): n is a, c, g, or t
  modified_base (263)..(263): a, c, t, g, unknown or other
  misc_feature (263)..(263): n is a, c, g, or t
  modified_base (309)..(309): a, c, t, g, unknown or other
  misc_feature (309)..(309): n is a, c, g, or t
  modified_base (362)..(362): a, c, t, g, unknown or other
  misc_feature (362)..(362): n is a, c, g, or t
  modified_base (550)..(550): a, c, t, g, unknown or other
  misc_feature (550)..(550): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgagctctcctgtgcngcctntggatccacttcagtagctagtggcagtgctacgtcggggtccccnccgaggcctccgagggccgaaggggggctgggaggttggggtgcctaggttantcaataatgaatagggaaataaataaatactatgacagactccggtaggaacggccgtattaccgaacctagtacctaccgagaacgaactaaacgttaccgaaacgaaccacgtaccttagtaactccgtagaacctaaaagtcgaaaccacgccgtaaggaagacgtcgaggaacggaacgacggnttggttaagttattaacgtggtacggttacggaagggttcggtaag

SEQ ID NO: 320925 - DNA, 528 bp, Homo sapiens
  misc_feature: GZ8MTXP01BPNGI.19.13.B02.1.454.CMB.2.raw
  modified_base (260)..(260): a, c, t, g, unknown or other
  misc_feature (260)..(260): n is a, c, g, or t
  modified_base (307)..(307): a, c, t, g, unknown or other
  misc_feature (307)..(307): n is a, c, g, or t
  modified_base (352)..(352): a, c, t, g, unknown or other
  misc_feature (352)..(352): n is a, c, g, or t
  modified_base (363)..(363): a, c, t, g, unknown or other
  misc_feature (363)..(363): n is a, c, g, or t
  modified_base (445)..(445): a, c, t, g, unknown or other
  misc_feature (445)..(445): n is a, c, g, or t
  modified_base (469)..(469): a, c, t, g, unknown or other
  misc_feature (469)..(469): n is a, c, g, or t
  modified_base (486)..(486): a, c, t, g, unknown or other
  misc_feature (486)..(486): n is a, c, g, or t
  modified_base (523)..(523): a, c, t, g, unknown or other
  misc_feature (523)..(523): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagtcttgggtttttcctcgttgcttcttttaagaggtgtccagtgtcaggtgcagcgtggtggagtcgtgggggagcgtggtccagccgtgggagtccctgagctctcctgngcagcctctggatcacttcagtagctatggcatgcacgtgggtcccncaggcctcgaggcgaagggggctgggagtggggtgcctaggttanagtcaattaangaagtagggaaattaaactaaagtactagtgacagtactcggtagacgggctattcactatcacagagacaattaccgaaanacacgctagtatctagaactaaanagaacacgcaagagagngagagacgacgcgttgtaagtagtcgtagtgcgtggngtaag

SEQ ID NO: 320926 - DNA, 545 bp, Homo sapiens
  misc_feature: GZ8MTXP01DALP2.19.13.B02.1.454.CMB.2.raw
  modified_base (264)..(264): a, c, t, g, unknown or other
  misc_feature (264)..(264): n is a, c, g, or t
  modified_base (281)..(281): a, c, t, g, unknown or other
  misc_feature (281)..(281): n is a, c, g, or t
  modified_base (285)..(285): a, c, t, g, unknown or other
  misc_feature (285)..(285): n is a, c, g, or t
  modified_base (304)..(304): a, c, t, g, unknown or other
  misc_feature (304)..(304): n is a, c, g, or t
  modified_base (346)..(346): a, c, t, g, unknown or other
  misc_feature (346)..(346): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctggggagtccctgagactctcctgtgcagcctntggatcaccttcagtanctanggcatgcactggggtcccncaggcctccgagggcgaagggggctggagtgggtgcagttantcataatgaataggaaataaataaatctatgacagactcggtagaacgggcctaattcaacctatccaccagacgaactaacttaccaaagaacacgactagtactcagaacaaatgaaacacgcctaagaagagacgaggaacggacgaacggttcttaggttaagtaacgttgtggtcgggacgtgggttcggtaag

SEQ ID NO: 320927 - DNA, 582 bp, Homo sapiens
  misc_feature: GZ8MTXP01D0HCK.19.13.B02.1.454.CMB.2.raw
  modified_base (305)..(305): a, c, t, g, unknown or other
  misc_feature (305)..(305): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctgggtggagtcgtggggggagcgtggtccagcctggggagtccctgagactctcctgtgcagcctctggatcacttcagtagctatggcatgcactggggtcccncaggctccgagggcaagggggctgggaggtggggtgctagttatatcaataatgaagtagggaaaacttaaataaatacgtatagacagacgtaccggtaggaagggaccgattactaccactaccgtaccaagaacgaactaaacttaaccgaaacgaaacgaacgtacctagtaactctagaacaaatagaaacacgcctaagagagacgttggaacggacgaccggttcgttagttaagtattaacgtaggtggaccggtaagggttcggtaag

SEQ ID NO: 320928 - DNA, 524 bp, Homo sapiens
  misc_feature: GZ8MTXP01AIYKW.19.13.B02.1.454.CMB.2.raw
  modified_base (162)..(162): a, c, t, g, unknown or other
  misc_feature (162)..(162): n is a, c, g, or t
  modified_base (302)..(302): a, c, t, g, unknown or other
  misc_feature (302)..(302): n is a, c, g, or t
  modified_base (344)..(344): a, c, t, g, unknown or other
  misc_feature (344)..(344): n is a, c, g, or t
  modified_base (371)..(371): a, c, t, g, unknown or other
  misc_feature (371)..(371): n is a, c, g, or t
  modified_base (410)..(410): a, c, t, g, unknown or other
  misc_feature (410)..(410): n is a, c, g, or t
  modified_base (445)..(445): a, c, t, g, unknown or other
  misc_feature (445)..(445): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttccncgttgctcttttaagaggtgtccagtgtcaggtgcagctggtggagtcgtgggggagcgtggtccagcctgggaggtccctgagctctctgtgcagcctctggatcaccttcagtagctatggcatgcacgtgggtcccncaggctccgaggcgaagggggctggagtggggtgccagttangtcataatgaatggaaagtataaactntatgacagactccggtagaacgggccattacaccatccnccagacgacaacttacgaagaacacgactgtatcngacaaagtagaacgacgccgtgagagcgagacggacgaccgcgttgtgttagtaacgtgtggcggtaacggcggtaagg

SEQ ID NO: 320929 - DNA, 718 bp, Homo sapiens
  misc_feature: GZ8MTXP01EBPLZ.19.13.B02.1.454.CMB.2.raw
  modified_base (263)..(263): a, c, t, g, unknown or other
  misc_feature (263)..(263): n is a, c, g, or t
  modified_base (307)..(307): a, c, t, g, unknown or other
  misc_feature (307)..(307): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcctntggatcaccttcagtagctatggcatgccacgtcggggtccccnccgaggcctccgagggcgaagggggcttgggaggtggggtcggacctaggttatagtacaagttaataggtaagttaagggtaaaagttaaaattaaaaacttacgttaagttacgggaacccgtaaggtaacccgttacccgggttaacgggaaaacgggggtccccgttaaacttttaccccgaaccccgttaattaccccgtaacccgaaaagtaaacgtaaaaccctaaacctttaacccggaaaacggtaaaccgtaaccggtactttagttaaactaccgtaagtaaacccaaaagttacggaaaactcggtaccgtaaggaaggacggtaccgttagggaaacggacgacgggttcttaggttaagttattaaccgtggtacggcgggtaaggttcgggttaag

SEQ ID NO: 320930 - DNA, 585 bp, Homo sapiens
  misc_feature: GZ8MTXP01EYYR6.19.13.B02.1.454.CMB.2.raw
  modified_base (300)..(300): a, c, t, g, unknown or other
  misc_feature (300)..(300): n is a, c, g, or t
  modified_base (345)..(345): a, c, t, g, unknown or other
  misc_feature (345)..(345): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagctctcctgtgcagcctctggatcacttcagtagctatggcatgcactggggtccncaggctccgaggcgaagggggctggagtggggtgcctaggtttanagtcataatgaagtagggaaattaaataaatactagtgacagactccggtaggacgggccgtattaccacctatccgtaccagacgaactaacttaccgaaacgtaacacgtctagtaactctagactaaagtcgaaactacgccctaaggaacgacggtccgttaggaacggaaccgaacgggttcttggttaagttaacgtttaacgtggtcggacggtaacgggttaacggttaagg

SEQ ID NO: 320931 - DNA, 606 bp, Homo sapiens
  misc_feature: GZ8MTXP01CJC1Q.19.13.B02.1.454.CMB.2.raw
  modified_base (261)..(261): a, c, t, g, unknown or other
  misc_feature (261)..(261): n is a, c, g, or t
  modified_base (287)..(287): a, c, t, g, unknown or other
  misc_feature (287)..(287): n is a, c, g, or t
  modified_base (310)..(310): a, c, t, g, unknown or other
  misc_feature (310)..(310): n is a, c, g, or t
  modified_base (548)..(548): a, c, t, g, unknown or other
  misc_feature (548)..(548): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagcttgggtttttcctcgttgcttcttttaagaggtgtccagttgtcaggtgcagctggtggagtcgtgggggagcgtggtccagccgtgggagtccctgacgactctcctgngcagcctctggatccaccttcagtanctatggcatgcacgtgggtcccncgaggctccgagggcgaagggggctgggagtggggtgcctagtttatagtcattaatggtaatagggtaaaacttaaataaaacgtctaagtgacaagtacctcggtaggaacggggtaccctaattaccaccctattccgacccgaaagtaacgaacctaaacgtttaccaaaacgtaaaccgtacgtaactgttaaactcgtacggaaactaaatcggaaactacgcctaagaagnggaccttaggaacgcgacggcttaggttgtattcgtaggtggacggtgggcggttaag

SEQ ID NO: 320932 - DNA, 657 bp, Homo sapiens
  misc_feature: GZ8MTXP01CGJSV.19.13.B02.1.454.CMB.2.raw
  modified_base (266)..(266): a, c, t, g, unknown or other
  misc_feature (266)..(266): n is a, c, g, or t
  modified_base (309)..(309): a, c, t, g, unknown or other
  misc_feature (309)..(309): n is a, c, g, or t
  modified_base (360)..(360): a, c, t, g, unknown or other
  misc_feature (360)..(360): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagcgtggtggagtcgtgggggagcgtggtccagccgtgggagtccctgagctctcctgtgcagcctntggatcaccttcagtagctatggcatgccacgtcggggtcccnccgaggcctccgagggtcgaagggggtctgggaggtgggtgcctaggttanagtcaataagtagaagtagggtaaacttaaataaatactagtcgactagtaccgtaccggtaggaacgggtcctaagttaccaacctactccgtacccgaagtaacgaactaaacgttacccgaaaagtaaacctaccgtacttaggttaactcgtagaacctaaaagttaccggaaactacgtcccggtaagaacggaggtaccgttagggaaacgggtaccgttacgggttcgtttaggttaagttaacgtttaaccggtgggttacggaccgggtaagggttccgggtttaaag

SEQ ID NO: 320933 - DNA, 572 bp, Homo sapiens
  misc_feature: GZ8MTXP01B7ON1.19.13.B02.1.454.CMB.2.raw
  modified_base (257)..(257): a, c, t, g, unknown or other
  misc_feature (257)..(257): n is a, c, g, or t
  modified_base (305)..(305): a, c, t, g, unknown or other
  misc_feature (305)..(305): n is a, c, g, or t
  modified_base (350)..(350): a, c, t, g, unknown or other
  misc_feature (350)..(350): n is a, c, g, or t
  modified_base (358)..(358): a, c, t, g, unknown or other
  misc_feature (358)..(358): n is a, c, g, or t
  modified_base (360)..(360): a, c, t, g, unknown or other
  misc_feature (360)..(360): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtggagtcgtgggggagcgtggtccagccgtgggagtccctgagctctcctgtncagcctctggatcaccttcagtagctatggcatgcacgtggggtcccnccgaggcctcgagggcaagggggctgggagtgggtgaccagttanatcataangntaggaaagtaataaatactatcgacagactccgtagacgggcattacaccatctaccagacgaactaacttaccgaaagaacctacgaccttagtactcgtagacctaaatcgaaacacgcctaaggacgagccgttagggaaacggacacggggttcttaggttaagttaacgttaaccgtggtaggttaccggtaagggttccggttaag

SEQ ID NO: 320934 - DNA, 684 bp, Homo sapiens
  misc_feature: GZ8MTXP01CBXAG.19.13.B02.1.454.CMB.2.raw
  modified_base (309)..(309): a, c, t, g, unknown or other
  misc_feature (309)..(309): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtggggacgtccctgagactctcctgtgcagcctctggattcaccttcagtagctatggcatgcacgtggggtcccnccgaggcctccgagggcgaagggggctgggaggtggggtcgctaggttatatcataagtgaattaggaaagttaaataaatctaatgacagtactccggtaggaacgggtaccgatttacccgacctacttccaccgaacgtaagaacctaaacgtttacccgaaaacgtaaacccgtaccgtaccttaggtaacttacccgtaggtaaacccaaaagttaccggaaaaccgacgtaccccgttaagggaaacggttaggtacccggttaagggtaaacggggaacccgttaacgggggttccgttagggttaacggtttaacgtttaaccggttagggttcgggaccgggtaaggggttaaccggggtttaaag

SEQ ID NO: 320935 - DNA, 606 bp, Homo sapiens
  misc_feature: GZ8MTXP01CMVI3.19.13.B02.1.454.CMB.2.raw
  modified_base (306)..(306): a, c, t, g, unknown or other
  misc_feature (306)..(306): n is a, c, g, or t
  modified_base (353)..(353): a, c, t, g, unknown or other
  misc_feature (353)..(353): n is a, c, g, or t
  modified_base (356)..(356): a, c, t, g, unknown or other
  misc_feature (356)..(356): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagcgtgggttttcctcgttagctcttttaagaggtgtccagtgtcaggtgcagctggtggagtcgtgggggagcgtggtccagccgtggggagtccctgagactctcctgtgcagcctctggatccacttcagtagctatggcatgcacgtgggcccnccaggcctccgagggcgaagggggctagggagtgggtgcctagttanatnataatgaatagggtaaaataaataaatactagtgacgagacgtaccggtaggaacgggtaccgtaattaccaacctataccctaccgaaagaacaactaaaccgttaccaaacggaaacctaccgtacttagtaactcctagaaccaaagtacgaaacacgcccgtaaggaacgaggtacgaggaacgggacgaccgggttcttaggttaagttacgttcgtggtacggacggtaagggttaacggtaag

SEQ ID NO: 320936 - DNA, 532 bp, Homo sapiens
  misc_feature: GZ8MTXP01EE6VE.19.13.B02.1.454.CMB.2.raw
  modified_base (180)..(180): a, c, t, g, unknown or other
  misc_feature (180)..(180): n is a, c, g, or t
  modified_base (306)..(306): a, c, t, g, unknown or other
  misc_feature (306)..(306): n is a, c, g, or t
  modified_base (430)..(430): a, c, t, g, unknown or other
  misc_feature (430)..(430): n is a, c, g, or t
  modified_base (437)..(437): a, c, t, g, unknown or other
  misc_feature (437)..(437): n is a, c, g, or t
  modified_base (487)..(487): a, c, t, g, unknown or other
  misc_feature (487)..(487): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagcttgggttttcctcgttgcttcttttaagnggtgtccagtgtcaggcgcagctggtggagtcgtgggggagcgtggtccagcctgggagtccctgagactctcctgtgcagcctctggatcaccttcagtagctatggcatgcacgtggggtcccnccgagggcctccgagggccgaaagggggcttgggaggtgggggtgcctaggttatatcaattaatgaagtaggaaaagtaaataaaatactagtgacagactcgtagaacggccgattcactancacaganacaatcaaagaacacgctgtaatctagacaaatagaacacgcctgagagngagaggacgacgcgttgtgtagttaacgtgtgcgaaggcggtaag

SEQ ID NO: 320937 - DNA, 574 bp, Homo sapiens
  misc_feature: GZ8MTXP01B7L3C.19.13.B02.1.454.CMB.2.raw
  modified_base (309)..(309): a, c, t, g, unknown or other
  misc_feature (309)..(309): n is a, c, g, or t
  modified_base (361)..(361): a, c, t, g, unknown or other
  misc_feature (361)..(361): n is a, c, g, or t
  modified_base (366)..(366): a, c, t, g, unknown or other
  misc_feature (366)..(366): n is a, c, g, or t
  modified_base (426)..(426): a, c, t, g, unknown or other
  misc_feature (426)..(426): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtggagtcgtgggggaggcgtggtccagccgtgggagtccctgagctctcctgtgcagcctgtggacttcaccttcagtagctatggcatgcacgtcggggtcccnccgaggcctccgagggcgaagggggctgggaggtggggtgcctagttatatnataanagaataggaaataataaatctatgacagactaccggtgaacggcattacacatcacaganacaacttaccgaaagaacacgctagtactcgtagaacaaatacgaaactacgacctaagaaggttagaccgttaggaacggacgacggttcgttaggtaagttaacgttaacgttggtaggttacgggtaaccgggttaacggttaag

SEQ ID NO: 320938 - DNA, 585 bp, Homo sapiens
  misc_feature: GZ8MTXP01AI7CF.19.13.B02.1.454.CMB.2.raw
  modified_base (310)..(310): a, c, t, g, unknown or other
  misc_feature (310)..(310): n is a, c, g, or t
  modified_base (388)..(388): a, c, t, g, unknown or other
  misc_feature (388)..(388): n is a, c, g, or t
  modified_base (507)..(507): a, c, t, g, unknown or other
  misc_feature (507)..(507): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtggggacgtccctgacgactctcctgtgcagcctcgtggactcaccttcagtagctatggcatgcacgtggggtcccncaggcctcgaggcgaagggggctgggagtgggtgcaggttatagtcataagtgaatagggaaagtaaataaatactangcagactccggtaggaacgggccgtattaccacctatcctaccaagagaactaacttaccgaaacggtaaacaccgtactagtactactaaacaaagtcgaaactacgaccctgaaggngaccgtaggaacggtaaccgtaacgggttcttggttagttaacttacgtcggtggacggagggtcgttaagaaccggg

SEQ ID NO: 320939 - DNA, 602 bp, Homo sapiens
  misc_feature: GZ8MTXP01DM1OQ.19.13.B02.1.454.CMB.2.raw
  modified_base (178)..(178): a, c, t, g, unknown or other
  misc_feature (178)..(178): n is a, c, g, or t
  modified_base (309)..(309): a, c, t, g, unknown or other
  misc_feature (309)..(309): n is a, c, g, or t
  modified_base (514)..(514): a, c, t, g, unknown or other
  misc_feature (514)..(514): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagnggtgtccagtgtcaggtgcagctggtggagtcgtgggggagcgtggtccagccgtggggacgtccctgagactctcctgtgcagcctgtggactcaccttcagtagctatggcatgcacgtggggtccccncaggcctaccgagggcgaagggggctgggaggtggggtgcctaggtttatatcaataatgaagtagggtaaaataaataaatctaagtgacagtaccgtccggtaggaaacgggccctaattaccgaacctacgtactacccgaagaacgaaactaacttaccgaaagaaacacgtctagtactcgtagactaaagtgaaaaccngaccgtaaggacgacgtacgaggaacggtacgttacggttcgttagttaagttacgttcggtggtcggacggtaacgggttcggtaag

SEQ ID NO: 320940 - DNA, 549 bp, Homo sapiens
  misc_feature: GZ8MTXP01CSQQT.19.13.B02.1.454.CMB.2.raw
  modified_base (248)..(248): a, c, t, g, unknown or other
  misc_feature (248)..(248): n is a, c, g, or t
  modified_base (480)..(480): a, c, t, g, unknown or other
  misc_feature (480)..(480): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtcctgagactntcctgtgcagcctctggatcaccttcagtagctatggcatgcacgtgggtcccgccaggctccgagggcgaagggggctggagtggggtgcctaggttatagtcaataatagaagtaggtaaagtaaataaagtactatgacagtactacgtagaacggccgattacaacatctaccaagacgaactaattaccgaaagaaacacgactagtatctagaacaaatagaaacncgacctgaacgagcgagacggacacgggcttggtaatagttaactggtacgcggtaagggttcggtaag

SEQ ID NO: 320941 - DNA, 621 bp, Homo sapiens
  misc_feature: GZ8MTXP01D4T0X.19.13.B02.1.454.CMB.2.raw
  modified_base (287)..(287): a, c, t, g, unknown or other
  misc_feature (287)..(287): n is a, c, g, or t
  modified_base (310)..(310): a, c, t, g, unknown or other
  misc_feature (310)..(310): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagtcttgggttttcctcgttgcttcttttaagaggtgtccagtgtcaggtgcagctggtggagtcgtggggggagcgtggtccaggccgtggggagtccctgagactctcctgtgcagcctctggatcaccttcagtanctatggcatgcacgtgggtcccnccaggcctcgaggcgaagggggctgggagtggggtgcctagttatatctaataatgaagtagggtaaaataaactaaagtactatgacagtactccggtaggaacgggcctaattaccaacctatccaccaagtaacgaactaacttaccgaaaagaaccacgtcttagtaactcctagaacctaaaagtcgaaactacgtccgtaagaacggacgtaccgttaggaaacggaaccgttaccggggttcttagggtttaaggtaaactttaacggttgggacggttacgggtaacgggttccggttaaagg

SEQ ID NO: 320942 - DNA, 588 bp, Homo sapiens
  misc_feature: GZ8MTXP01A28AQ.19.13.B02.1.454.CMB.2.raw
  modified_base (160)..(160): a, c, t, g, unknown or other
  misc_feature (160)..(160): n is a, c, g, or t
  modified_base (263)..(263): a, c, t, g, unknown or other
  misc_feature (263)..(263): n is a, c, g, or t
  modified_base (280)..(280): a, c, t, g, unknown or other
  misc_feature (280)..(280): n is a, c, g, or t
  modified_base (356)..(356): a, c, t, g, unknown or other
  misc_feature (356)..(356): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagcgtggtttcncgttagctctttaagaggtgtccagtgtcaggtgcagctggtggagtcgtggggggagcgtggtccagccgtgggaggtccctgagctctcctgtgcagcctntggatcaccttcagtanctatggcatgctacgtgggtccgccaggcctccgagggcgaagggggtctgggagtggggtagcctaggttatatntataagtagtaagtaaggtaaagtaaataaataatagtacgactacgtacgtacggtacggaacggtacgtactacctacctactactacgacgaacgaactaactaacgaaacgaacgacgtacgtatatactacgaacaaactacgaacgacgacgtaagaagagacgacggacggacgacgttcgttacgtaagtagttaacgtggtcggacggtaacggttcggtaag

SEQ ID NO: 320943 - DNA, 606 bp, Homo sapiens
  misc_feature: GZ8MTXP01A7VST.19.13.B02.1.454.CMB.2.raw
  modified_base (305)..(305): a, c, t, g, unknown or other
  misc_feature (305)..(305): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggacggtccctgagactctcctgtgcagcctctggatcaccttcagtagctatggcatgcacgtgggtcccncaggcctccgagggcgaagggggctgggagtggggtgcctaggttatagtcaataatgaatagggaaataaataaatactaatgacagactcgtaggaaggccgattaccactagtcctaccgaagacgaactaacttaccgaaacggtaaacaccgtacgttagtaactacctaaactaaatacggtaaaccacgaccgtgaagaacggaccgttagggacggaacgtaacgggttccgttggttacggttaattaccgttggtcggacggggttacgggtaacgggttaagtaaccggg

SEQ ID NO: 320944 - DNA, 577 bp, Homo sapiens
  misc_feature: GZ8MTXP01A6JNC.19.13.B02.1.454.CMB.2.raw
  modified_base (305)..(305): a, c, t, g, unknown or other
  misc_feature (305)..(305): n is a, c, g, or t
  modified_base (352)..(352): a, c, t, g, unknown or other
  misc_feature (352)..(352): n is a, c, g, or t
  modified_base (493)..(493): a, c, t, g, unknown or other
  misc_feature (493)..(493): n is a, c, g, or t
  modified_base (507)..(507): a, c, t, g, unknown or other
  misc_feature (507)..(507): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggcggagtcgtgggggagcgtggtccagcctgggagtccctgagactctcctgtgcagcctctggattcaccttcagtagctatggcatgcacgtggggtcccnccaggcctccgagggcgaagggggctgggagtggggtgccaggttanatcataagtgaataggaaagtaaataaatctaatgacagtacgtcgtaggaacgggtccgattaccacctatccgtaccagaacgaactaacttaccgaaagtaaaccacgacttagtaactcgtagaacaaatcgaaacncgccgtaagaacgngaccgttaggaacggtaacgacgggttcttagtaagttagttaacgtgtgggacggaagggttcggtaag

SEQ ID NO: 320945 - DNA, 583 bp, Homo sapiens
  misc_feature: GZ8MTXP01CXH2W.19.13.B02.1.454.CMB.2.raw
  modified_base (267)..(267): a, c, t, g, unknown or other
  misc_feature (267)..(267): n is a, c, g, or t
  modified_base (306)..(306): a, c, t, g, unknown or other
  misc_feature (306)..(306): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttggactgagctgggttttcctcgttgctcttttaagaggtgtccagtgtcaggtgcagctggtggagtcgtgggggagcgtggtccagccgtggggacgtccctgacgactctcctgtgcagcctntggatcacttcagtagctatggcatgcacgtgggtcccncaggcctcgaggcgaaggggctggagtgggtgcctaggttatatcaataatgaagttagggaaacgttaaataaatactatcgacagactcggtaggaacggccgattacacctatctaccagacgaacaacttaccgaaacgaacctaacgctagtactactagaacctaaagtacgaaacacgtcctaaggaagacgtcgttagggaacggacgaacgggttcgttaggttaagttacgttaacgtggtacgggacgggtaagggttcggttaag

SEQ ID NO: 320946 - DNA, 581 bp, Homo sapiens
  misc_feature: GZ8MTXP01DZLGA.19.13.B02.1.454.CMB.2.raw
  modified_base (307)..(307): a, c, t, g, unknown or other
  misc_feature (307)..(307): n is a, c, g, or t
  modified_base (344)..(344): a, c, t, g, unknown or other
  misc_feature (344)..(344): n is a, c, g, or t
  modified_base (352)..(352): a, c, t, g, unknown or other
  misc_feature (352)..(352): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctgggtggagtcgtggggggagcgtggtccagcctggggagtccctgagactctcctgtgcagcctctggatcaccttcagtagctatggcatgcacgtggggtcccnccaggcctccgagggcgaagggggctgggagtggggngcagttanatcataatgaagtagggaaataaataaatactatgacagactccggtaggaacgggccgtattaccaccatctacccaagaacgaacctaaattacccgaaagtaaaccacggtaccttagtaactcgtagaacaaaagtcgaaacacgccctaaggaagagacgttaggaacggaaccgacggcttaggttgttaattaacgtggtcggacgggtaagggcggttaag

SEQ ID NO: 320947 - DNA, 590 bp, Homo sapiens
  misc_feature: GZ8MTXP01D7NKP.19.13.B02.1.454.CMB.2.raw
  modified_base (246)..(246): a, c, t, g, unknown or other
  misc_feature (246)..(246): n is a, c, g, or t
  modified_base (361)..(361): a, c, t, g, unknown or other
  misc_feature (361)..(361): n is a, c, g, or t
  modified_base (460)..(460): a, c, t, g, unknown or other
  misc_feature (460)..(460): n is a, c, g, or t
  modified_base (485)..(485): a, c, t, g, unknown or other
  misc_feature (485)..(485): n is a, c, g, or t
  modified_base (494)..(494): a, c, t, g, unknown or other
  misc_feature (494)..(494): n is a, c, g, or t
  modified_base (500)..(500): a, c, t, g, unknown or other
  misc_feature (500)..(500): n is a, c, g, or t
  modified_base (510)..(510): a, c, t, g, unknown or other
  misc_feature (510)..(510): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagagactcaccatggagtttgggctgagcttgggttttcctcgttgcttcttttaagaggtgtccagtgtcaggtgcagcgtggtggagtcgtgggggagcgtggtccagccgtgggacgtcccngacgctctcctgtgcacgcccctgtactccaccttcagtagctagtaggcatgccgacgtcggtccggcccgaggtccgtccgacggacggaagggggtcggtgggaggtggggnggtctacgttagtatcatagtagataagggaaataaacttaaatactatagcaacgtacgtacggtgaacgggcgtactactaccgattccaccagaanacaaacttaccaaaggtaacacgtntacgtattncgtaanaaatacgaanaacgtcgtacgaagacgcgtaagcgggaacgtcgttagttgttcgtaattacgtgtcggaggaggtccgttaagtaaccg

SEQ ID NO: 320948 - DNA, 596 bp, Homo sapiens
  misc_feature: GZ8MTXP01BS41L.19.13.B02.1.454.CMB.2.raw
  modified_base (278)..(278): a, c, t, g, unknown or other
  misc_feature (278)..(278): n is a, c, g, or t
  modified_base (306)..(306): a, c, t, g, unknown or other
  misc_feature (306)..(306): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtggggagtccctgacgactctcctgtgcagcctctggatcaccttnagtagctatggcatgcacgtgggtcccncaggcctccgagggcgaagggggctgggaggtggggtgcctagttatatcataatgaatagggaaagttaaataaatactatgacagtactccggtaggaacgggacccgtattaccacctattcctaccgaagacgaactaaacgttacccgaaagaacctaccgtacttagtactcgtagaacctaaatacggaaacacgtcccgtaaggaaggacgtccgagggaacggacgacgggttcttaggttaattattaaccgtggttcggacggtaagggttcggttaag

SEQ ID NO: 320949 - DNA, 540 bp, Homo sapiens
  misc_feature: GZ8MTXP01B0920.19.13.B02.1.454.CMB.2.raw
  modified_base (304)..(304): a, c, t, g, unknown or other
  misc_feature (304)..(304): n is a, c, g, or t
  modified_base (345)..(345): a, c, t, g, unknown or other
  misc_feature (345)..(345): n is a, c, g, or t
  modified_base (352)..(352): a, c, t, g, unknown or other
  misc_feature (352)..(352): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagcgtggttttcctcgttgctcttttaagaggtgtccagtgtcaggtgcagctggtggagtcgtgggggaggcgtggtccagccgtggggagtccctgagactctcctgtgcagcctctggatcaccttcagtagctatggcatgcacgtgggccncaggctccgagggcaagggggctggagtgggtgccagttanatcatangaatggaaattaataaactactatgacagtactccggtaggaacggcctattaccacctatcctaccaagaacaacaacttaccgaaacgaacgaacgactagtatactacgacaatagaacgacgcgaagagagacgagacggacgacgcgttcgtgtagtaacgtgtggacggtcggttcggtaag

SEQ ID NO: 320950 - DNA, 537 bp, Homo sapiens
  misc_feature: GZ8MTXP01A4VMC.19.13.B02.1.454.CMB.2.raw
  modified_base (346)..(346): a, c, t, g, unknown or other
  misc_feature (346)..(346): n is a, c, g, or t
  modified_base (412)..(412): a, c, t, g, unknown or other
  misc_feature (412)..(412): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactaaccatggatttgggctgagctgggttttcctcgttgctcttttaagaggtgtccagtgtcaggtgcagctggtggagtcgtgggggagcgtggtccagcctgggagtccctgagactctcctgtgcagcctctggattcaccttcagttagctatggcatgcacgtggtcccgccaggctccgaggcgaagggggctggagtgggtggctagttanatcatatagatggaaagtaaataaatactatagacagactcgtagacgggccatcaccatctacanagacaataccaagaacacgctagtatcgtagactaaatcgtaaacacgaccgtgaaggagcgtaggaacggacgcggttcgttgttagtaagttcgtgtcggcggttaggtcggttaagtaacgg

SEQ ID NO: 320951 - DNA, 522 bp, Homo sapiens
  misc_feature: GZ8MTXP01AGQ4F.19.13.B02.1.454.CMB.2.raw
  modified_base (302)..(302): a, c, t, g, unknown or other
  misc_feature (302)..(302): n is a, c, g, or t
  modified_base (468)..(469): a, c, t, g, unknown or other
  misc_feature (468)..(469): n is a, c, g, or t
  modified_base (478)..(478): a, c, t, g, unknown or other
  misc_feature (478)..(478): n is a, c, g, or t
  modified_base (504)..(504): a, c, t, g, unknown or other
  misc_feature (504)..(504): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcctctggatcaccttcagtagctatggcatgcactggggtccncaggctccgaggcaagggggctggagtggggtggccaggttatagtcataatgaagtgggaaagtaataaatactatgacagactccggtagagggccgattcactatctccagagacaattaccaagtaacacgctagatctagacaaatgaacagcctgagagnnggaggaacncggttattgtggtattaacgttgggngcggtaaggttcggtaag

SEQ ID NO: 320952 - DNA, 640 bp, Homo sapiens
  misc_feature: GZ8MTXP01DGR30.19.13.B02.1.454.CMB.2.raw
  modified_base (196)..(196): a, c, t, g, unknown or other
  misc_feature (196)..(196): n is a, c, g, or t
  modified_base (285)..(285): a, c, t, g, unknown or other
  misc_feature (285)..(285): n is a, c, g, or t
  modified_base (549)..(549): a, c, t, g, unknown or other
  misc_feature (549)..(549): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtncagcgtggtggagtcgtggggggagcgtggtccagccgtgggagtccctgagactctcctgtcgcagcctctggactcaccttcagtanctatggcatgcacgtcggggtccgccaggcctccgagggcgaagggggctagggaggtgggggtcggacctaggtttatacgtcattaaagtgtaagtaggaaagttaaataaagtactagtagacctaagtacctaccggtaggaacggggtacctattacccaacctactccctaccagaacaactaaacgttaccaaaggaaacctacgtccgttagtaactcgtagaacctaaagtacgaaacacgtcctaaggaacggngacgttagggaccgggaacacggggttcttacgggttgttaaaccgtttcgttagggtacggttacggggtaaccgggttgttaaaccggg

SEQ ID NO: 320953 - DNA, 674 bp, Homo sapiens
  misc_feature: GZ8MTXP01A6MAR.19.13.B02.1.454.CMB.2.raw
  modified_base (315)..(315): a, c, t, g, unknown or other
  misc_feature (315)..(315): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccaggccgtggggacgtccctgacgtactctcctgtcgcagcctcgtggactccaccttcagtagctatggcatgcacgtggggtcccncgaggcctcgaggcgaagggggctgggaggtgggtggacctaggttatatcaataagtagaagttaggggaaaattaaagttaaaatactaagtcgacaagtaccgtaccggtagggaacgggtccgtaatttaccacctatcctaaccgagaaacgaacctaaacttacccggaaaggtaaacctaccgtacgttacgttaactacgttacgaaacctaaaagtacggaaaacccgtacggacccggttaaggaaggacggtcccgttagggaacgggaacccgttacgggttccgttacggttaaggtttaacgttcgtagggtacggttaccgggtaaggggttcggttaaaccgg

SEQ ID NO: 320954 - DNA, 545 bp, Homo sapiens
  misc_feature: GZ8MTXP01AMJRH.19.13.B02.1.454.CMB.2.raw
  modified_base (258)..(258): a, c, t, g, unknown or other
  misc_feature (258)..(258): n is a, c, g, or t
  modified_base (266)..(266): a, c, t, g, unknown or other
  misc_feature (266)..(266): n is a, c, g, or t
  modified_base (486)..(486): a, c, t, g, unknown or other
  misc_feature (486)..(486): n is a, c, g, or t
  modified_base (494)..(494): a, c, t, g, unknown or other
  misc_feature (494)..(494): n is a, c, g, or t
  modified_base (529)..(529): a, c, t, g, unknown or other
  misc_feature (529)..(529): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctggggtttttcctcgttgcttcttttaagaggtgtccagtgtcaggtgcagctggtggagtcgtgggggagcgtggtccagccgtgggagtccctgagctctcctgngcagcctntggatcaccttcagtagctatggcatgcacgtcgggggtcccgccagggcctccgagggccgaagggggctgggaggtggggtggcctaggttatagtcataatgaatagggaaataaataaagtctatgacagactccgtagacggccgattacacctatctaccagacgactaactaccgaaagaacacgctagtactctagacaaatcgaacagccngacgagcnggacgacgacggttcttgtgtagttcgtggtacgngtaagggttcggtaag

SEQ ID NO: 320955 - DNA, 621 bp, Homo sapiens
  misc_feature: GZ8MTXP01C2VZC.19.13.B02.1.454.CMB.2.raw
  modified_base (309)..(309): a, c, t, g, unknown or other
  misc_feature (309)..(309): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggtttttcctcgttgctcttttaagaggtgtccagtgtcaggtgcagctggtggagtcgtgggggagcgtggtccagccgtggggagtccctgagactctcctgtgcagcctctggatccaccttcagtagctagtggcatgcacgtggggtcccnccgaggcctccgaggcgaagggggctgggagtggggtgccaggttatatcataatgaagtagggaaagttaaataaatctaatgacaagtactccggtagaacgggccgtattacgaccattaccgaccaagaacgaacctaaaacgtttacccggaaaacgtaaaccgaaccgtaccgttaggtaactaccgtagaaacctaaaagttacggaaactacggcccgtaagaaggacgtcgttaggaaccgggacgacggttcgttaggttgttaagttaaccgtggtacggacggtaaggttccgggttaag

SEQ ID NO: 320956 - DNA, 596 bp, Homo sapiens
  misc_feature: GZ8MTXP01BE08I.19.13.B02.1.454.CMB.2.raw
  modified_base (263)..(263): a, c, t, g, unknown or other
  misc_feature (263)..(263): n is a, c, g, or t
  modified_base (305)..(305): a, c, t, g, unknown or other
  misc_feature (305)..(305): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcctntggactcaccttcagtagctatggcatgcacgtggggtcccncaggctccgagggcgaagggggctgggaggtggggtggccaggttatatcaataatagaatagggaaagtaaataaatactatgacagactcggtagaacgggcagttcactatctacagacgaactaacttacgaaagtaaaccgacgtaccgttagtactccgtagaactaaaataggaacctaacggaccgtaaggaagacggtaccttagggaaacggtacgaaaccgggttcttacggttaagttacgtttaacggtggtacggacgggtaagggttaacggtaag

SEQ ID NO: 320957 - DNA, 609 bp, Homo sapiens
  misc_feature: GZ8MTXP01CYDYH.19.13.B02.1.454.CMB.2.raw
  modified_base (335)..(335): a, c, t, g, unknown or other
  misc_feature (335)..(335): n is a, c, g, or t
  modified_base (344)..(344): a, c, t, g, unknown or other
  misc_feature (344)..(344): n is a, c, g, or t
  modified_base (346)..(346): a, c, t, g, unknown or other
  misc_feature (346)..(346): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcctgggagtccctgagctctcctgtgcagcctctggatcaccttcagtagctatggcatgcacgtgggtccccgccaggctccgaggcgaaggggctggagtggngcagttatntnataatgaataggaaagtaaataaagtactagtgacagaccgtccggtagaacggggtaccgagttaccaccatacctaccaagaacgaactaaacttaccgaaacgaaacgtacgtacccgttagtaacttccgttaggaacctaaagtacgaaactacggacccgttaaggaagacggaccgttagggaaacggtccgaaccgggttcttaggttaaggttactttaacggttggtacggccggtaaggggttcggttaagg

SEQ ID NO: 320958 - DNA, 755 bp, Homo sapiens
  misc_feature: GZ8MTXP01BWVHO.19.13.B02.1.454.CMB.2.raw
  modified_base (333)..(333): a, c, t, g, unknown or other
  misc_feature (333)..(333): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagcttgggttttcctcgttgcttctttttaagaggtgtccagtgtcaggtgcagctggtggagtcgtgggggagcgtggtccagccgtgggagtccctgacgactctcctggtcgcacgcctctggtactccaaccctttcaagttagccttaagtggacctagtgccacgttcgggggtccccncccgaagggtccctaccggagggcgaaaggggggtctaggggaggtgggggtggaccctaaggtttatagtacctaagttaaatggtaagttagggtaaaaagttaaataaaaacgttacgtaaagttcggaaccgtaacgtaaaccgttacccgggtagggaaaccggggtcccgttaaactttaccgaaccctaacttccctaacccgaagaaacggtaaacctaaacgtttaccccgaaaaggtaaaccgtaccggtaccttagtaacgttacccgttaagaacctaaaacgttgaaaaccgtacggtccctaagggaaacggcgtaacccggttagggaaacggtacccgaacgggttccttaggttaaggttaaactttcggaggttacggaccgggtaagggttccgggtttaaag

SEQ ID NO: 320959 - DNA, 741 bp, Homo sapiens
  misc_feature: GZ8MTXP01D0K28.19.13.B02.1.454.CMB.2.raw
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagcgtggtggagtcgtggggggagcgtggtccagccgtgggacgtccctgacgtctctcctgtcgcagcctgtggactccaccttcagtagctagtcggctagtcgcacggtcggggtcccccgccgaagggtccctaccggaaggggacggaaaggggggtccttagggggagggtgggggtcgacctaaggtttaactagtacaagttaaagtaggtaagtaaagggtaaaagtttaaaactaaaattacctaaaggttcggaaaccgaacggtaacccgttaccgggtaaggaaaccggggtacccgtaacgtttaccaaccgtacttaccgtaccgaaacggaactaaaccgtaaaccttaaccggaaaacgtaaaccgaaccggttacctaggttaactaccgtagtaaaacctaaagttaacggaaaactcggaccgtaaggaaggacgtacgacgggaacggaacgacggggttcttaggttaagttaacgtttaacgtgggttacgggaccgggtaagggttaacgggttaaagg

SEQ ID NO: 320960 - DNA, 557 bp, Homo sapiens
  misc_feature: GZ8MTXP01E4NOR.19.13.B02.1.454.CMB.2.raw
  modified_base (309)..(309): a, c, t, g, unknown or other
  misc_feature (309)..(309): n is a, c, g, or t
  modified_base (358)..(358): a, c, t, g, unknown or other
  misc_feature (358)..(358): n is a, c, g, or t
  modified_base (391)..(391): a, c, t, g, unknown or other
  misc_feature (391)..(391): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccagcctgggagtccctgagactctctgtgcagcctctggtatccaccttcagtagctatggcatgccacgtcggggtcccnccgaggcctccgagggcgaagggggctgggaggtggggtgcctagttanatcataatgaataggaaataaataaatactatncagactcggtagaaggcgattacacctatccacagaacaacaaacttaccgaaagaacacgctagtatcgagaacaaagtacgaaacacgccctaagaagagacgttaggaacgggacacgggttcttaggtgttagttaacgtggtggacggtaagggcggtaag

SEQ ID NO: 320961 - DNA, 843 bp, Homo sapiens
  misc_feature: GZ8MTXP01BIJUE.19.13.B02.1.454.CMB.2.raw
  modified_base (264)..(264): a, c, t, g, unknown or other
  misc_feature (264)..(264): n is a, c, g, or t
  modified_base (312)..(312): a, c, t, g, unknown or other
  misc_feature (312)..(312): n is a, c, g, or t
  modified_base (373)..(373): a, c, t, g, unknown or other
  misc_feature (373)..(373): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggtttcctcgttgctcttttaagaggtgtccagtgtcaggtgcagctgggtggaggtcgtggggggaggcgtggtccagccgtggggacgtccctgagactctctgtgacngcctctggactccaccttcagtagctatggcatgcacgtggggtcccncgaggcctacgagggaccgaaggggggctagggagggtgggggtcggtacctaaggtttanacttacgtaagttaaagtacggaagtaagggggtaaaaagttaaaaaccttaaaaagtaccttaaaggtacggtaaccgtaacgggttaaacccggttaccccgggttaaggggaaaccggggggtaccccgttaaacgttttacccccgaaaccccttaaaccggttccccttaaaccccggtaaaagggaaaccgtaaaacccgttaaaacctttaaaccccccggggaaaaagggttaaaacccccaaaccgggttaccctttaaggttaaaccgtacccttaaaggaaaccccgtaaaaattaccgggtaaaacctaacggtacccgtaaagggtaaaggacccgggacggttaaggaaacggggaaccccggttaaacgggggtttcgtttaacgggttaacggtttaacggtttaacggttcggggtaagggttaccggggtaacggggttaacggtttaacgg

SEQ ID NO: 320962 - DNA, 780 bp, Homo sapiens
  misc_feature: GZ8MTXP01EU0O3.19.13.B02.1.454.CMB.2.raw
  modified_base (323)..(323): a, c, t, g, unknown or other
  misc_feature (323)..(323): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagcgtggtggagtcgtgggggagcgtggtccagccgtggggacgtccctgacgactctcctgtcgcacgcctcgtggtattccaccttcaggtagctagtggcatggcctacgtcggggtcccnccgaggcctaccgagggacgaagggggtctagggaggtggggtggcctaaggtttatagtacaataagtgaagttaagggtaaaacgttaaaattaaaatacgtagtacgactaacgtaaccgttaccggtagggaaacggggtacccgtaacgttttaaccccaaacccttacgttaccctacccgaaacgggtaaacgtaaaccgttaaaacctttaaccccggaaaacggtaaaacccgtaaccgtacccgtttaaggttaaccttaccgttacggaaaaccctaaaagttaaccggaaaaccgaccgggtacccgttaagggtaaagggacggtacccggttaagggaaacggggtaaccccgttaccggggttcggtttagggtttaaggttaaacgttttaaccggtgggttaccgggaccggggttaaggggttaacccgggtttaaagg

SEQ ID NO: 320963 - DNA, 592 bp, Homo sapiens
  misc_feature: GZ8MTXP01C7ISY.19.13.B02.1.454.CMB.2.raw
  modified_base (264)..(264): a, c, t, g, unknown or other
  misc_feature (264)..(264): n is a, c, g, or t
  modified_base (305)..(305): a, c, t, g, unknown or other
  misc_feature (305)..(305): n is a, c, g, or t
  modified_base (354)..(354): a, c, t, g, unknown or other
  misc_feature (354)..(354): n is a, c, g, or t
  modified_base (487)..(487): a, c, t, g, unknown or other
  misc_feature (487)..(487): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgagactctcctgtgcagcctntggatcaccttcagtagctatggcatgcacgtggggtcccnccaggcctccgagggcgaagggggctgggagtggggtgcctaggtttantcataatgaatagggaaattaaataaatctatgacagacgtccggtagaacgggcctaattcaccatcctaccaagagaactaacttaccgaaacgaaccgacgtctgtaactctacgaacaaagtcgaaacncgccctaaggaagttaggaccgttagggaaacgggaccgaacgggttccttaggttaagttaacgtttaacgtgggtcggaccgggtaagggttccgggttaagg

SEQ ID NO: 320964 - DNA, 637 bp, Homo sapiens
  misc_feature: GZ8MTXP01BSB9X.19.13.B02.1.454.CMB.2.raw
  modified_base (179)..(179): a, c, t, g, unknown or other
  misc_feature (179)..(179): n is a, c, g, or t
  modified_base (278)..(278): a, c, t, g, unknown or other
  misc_feature (278)..(278): n is a, c, g, or t
  modified_base (307)..(307): a, c, t, g, unknown or other
  misc_feature (307)..(307): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactaaccatggagtttgggctgagcttgggttttcctcgttgctcttttaagnggtgtccagtgtcaggtgcagcgtggtggagtcgtgggggagcgtggtccagccgtgggagtccctgagactctctgtgcagcctctggattcaccttnagtagctatggcatgcacgtcgggtcccnccgaggctccgaggaccgaagggggctgggaggtggggtggactaaggttatatcattagtagaattggggaaataaataaatacgtatggacaagtactaccggtaggaacgggccgtaattccaaccctactcctaccgaaggtaacgaactaaacttaacccaaacgggtaaacctaaccgtaccgttaggtaactaccgtacgtaacctaaaattacgaaaacacggtacccgtaggaacggagttacgtagggaacggaccgtacgggttacgttggttacggttaagttacgtggttggaccgggagggtcggttaagtaacgg

SEQ ID NO: 320965 - DNA, 540 bp, Homo sapiens
  misc_feature: GZ8MTXP01BRM7F.19.13.B02.1.454.CMB.2.raw
  modified_base (346)..(346): a, c, t, g, unknown or other
  misc_feature (346)..(346): n is a, c, g, or t
  modified_base (355)..(355): a, c, t, g, unknown or other
  misc_feature (355)..(355): n is a, c, g, or t
  modified_base (408)..(408): a, c, t, g, unknown or other
  misc_feature (408)..(408): n is a, c, g, or t
  modified_base (444)..(444): a, c, t, g, unknown or other
  misc_feature (444)..(444): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcctctggatcacttcagtagctatggcatgcacgtggggtccccgaggctccgagggcaagggggctggagtgggtgcctaggttanagtcataangaatggaaagtaaataaatactagtgacagactcgtagaagggcatcacatcncagagacaattaccgaagaacacgctagtatcgtanaacaaagtacgaacacgcgtaaggagagtcgaggaacggtacgacggttcgttaggttaagttagttcgtggtcggacggtaacgggttcggtaag

SEQ ID NO: 320966 - DNA, 595 bp, Homo sapiens
  misc_feature: GZ8MTXP01AG0SN.19.13.B02.1.454.CMB.2.raw
  modified_base (312)..(312): a, c, t, g, unknown or other
  misc_feature (312)..(312): n is a, c, g, or t
  modified_base (360)..(360): a, c, t, g, unknown or other
  misc_feature (360)..(360): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccaggcctggggacggtccctgagacctctcctgtgcagcctctggtatcaccttcagtagctatggcatgccacgtggggtcccnccgaggcctccgagggcgaagggggctgggagtggggtggccagttanatcataatagaatagggaaagttaaataaatactatgacaagtacgtaccggtagaacgggtccgattaccaccacgtcctaccagaacgaactaaattacccgaaagtaaaccgacgacctagtataccgtagaacctaaatcgaaacacggaccctaaggaacgacggaccgttaggacggacgacggttcttaggtaagtattaacgtcggtgacggtaacggttcggtaag

SEQ ID NO: 320967 - DNA, 657 bp, Homo sapiens
  misc_feature: GZ8MTXP01B0CXG.19.13.B02.1.454.CMB.2.raw
  modified_base (313)..(313): a, c, t, g, unknown or other
  misc_feature (313)..(313): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagcgtggtggagtcgtgggggaggcgtggtccaggccgtgggacggtcctggacgtctctcctgtgcagcctcgtggtactcactcagtagctagtgcatgcacgtcgggtcccnctaggctaccgagggcgaagggggctaggggaggtggggaggacctaggttatatacattaagagaagttagggaaaattaaactaaagtacttagtcacgagtacctacggtaggaaacgggtcctaattacccaactaatccaaccgaagaacaaactaacttaaccggaaaagaaccggactacgttacgtacttccgtaagaacctaaagtaacgaaacgaacgaccgtaacggaagaccgtacgaggtaacggtaaccggacccggttacgttacggttaacgtttacgtttaacggttcggttagggttaccgggtaacgggttaacgggttaacggg

SEQ ID NO: 320968 - DNA, 564 bp, Homo sapiens
  misc_feature: GZ8MTXP01C0CFO.19.13.B02.1.454.CMB.2.raw
  modified_base (304)..(304): a, c, t, g, unknown or other
  misc_feature (304)..(304): n is a, c, g, or t
  modified_base (438)..(438): a, c, t, g, unknown or other
  misc_feature (438)..(438): n is a, c, g, or t
  modified_base (529)..(529): a, c, t, g, unknown or other
  misc_feature (529)..(529): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagctctcctgtgcagcctctggatcaccttcagtagctatggcatgcacgtggggtccccnccagggcctccgagggcgaagggggctgggagtggggtggcctaggttatatcaataatagaagtagggaaataaataaattactagtgacacgacgtccggtaggaacgggccgtatccaccatccaccaganaactaattaccgaaagaaccacgactgtaatctagacaaatgaaacagtccgtaagacgagtccgagaacgggaccacggttcttagggtnttagttaactggtcggacggtaacgggcggttaag

SEQ ID NO: 320969 - DNA, 595 bp, Homo sapiens
  misc_feature: GZ8MTXP01DE9AV.19.13.B02.1.454.CMB.2.raw
  modified_base (313)..(313): a, c, t, g, unknown or other
  misc_feature (313)..(313): n is a, c, g, or t
  modified_base (360)..(360): a, c, t, g, unknown or other
  misc_feature (360)..(360): n is a, c, g, or t
  modified_base (512)..(512): a, c, t, g, unknown or other
  misc_feature (512)..(512): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggaggcgtggtccagccgtggggacggtccctgacgtctctcctgtcgcagcctctggatccaccttcagtagctatggcatgcacgtggggtcccncaggcctcgagggcgaagggggctgggagtggggtcgactaggttantcaataagtgaagtagggtaaaacttaaataaaatctaagtcgacaagtaccgtcggtaggaacgggccgtaactacacctatacctaccgaaagacgaactaaacgtaccaaagacctacggacttagtactctagaaactaaatgaacgngcctaaggacgagcgttaggaacggacgttaacggttgttaggttaattacgttcgtggtcggacggtaaggttccggttaag

SEQ ID NO: 320970 - DNA, 602 bp, Homo sapiens
  misc_feature: GZ8MTXP01A30AG.19.13.B02.1.454.CMB.2.raw
  modified_base (308)..(308): a, c, t, g, unknown or other
  misc_feature (308)..(308): n is a, c, g, or t
  modified_base (466)..(466): a, c, t, g, unknown or other
  misc_feature (466)..(466): n is a, c, g, or t
  modified_base (492)..(492): a, c, t, g, unknown or other
  misc_feature (492)..(492): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtggggacgtccctgagctctcctgtgcagcctctggatcaccttcagtagctatggctatgcacgtggggtcccncgaggcctccgaggcgaagggggctgggaggtgggtgcctaggttatatcataatgtaatagggaaataaactaaatctaatgactaagtactccggtaggaacgggcctattaccaccgtatcaccgataacgactaacgtaccaaacgaacaccgntagtactctagaacaagtacgaaacncgacctaaggaacgttacggacgttacggaacgggaaccttaccgggttcgttaggtttaacgtaagtttccggtgggtcgggttaaccggtggggttccgggtttaaag

SEQ ID NO: 320971 - DNA, 579 bp, Homo sapiens
  misc_feature: GZ8MTXP01AZYRK.19.13.B02.1.454.CMB.2.raw
  modified_base (256)..(256): a, c, t, g, unknown or other
  misc_feature (256)..(256): n is a, c, g, or t
  modified_base (306)..(306): a, c, t, g, unknown or other
  misc_feature (306)..(306): n is a, c, g, or t
  modified_base (512)..(512): a, c, t, g, unknown or other
  misc_feature (512)..(512): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtggagtcgtgggggagcgtggtccagcctgggacgtccctgagctctcctgngcagcctctggatcaccttcagtagctatggcatgcacgtcggggtcccnccgaggcctaccgagggccgaaggggggcttaggggaggtggggtaggcctaggtttatatcattaagtgaagttagggaaactaaataaatctaatgactagactcggtagacgggccattcactatcacagacacaacttaccgaaagaacacgtactagtactcgtagaccaaagtcgaaactcgccgtaagacggagtccgnggaacgggacacgggttcttggtaaggttacttaacgtggtcggacggtaacgggttcggttaacgg

SEQ ID NO: 320972 - DNA, 619 bp, Homo sapiens
  misc_feature: GZ8MTXP01ACVJY.19.13.B02.1.454.CMB.2.raw
  modified_base (268)..(268): a, c, t, g, unknown or other
  misc_feature (268)..(268): n is a, c, g, or t
  modified_base (310)..(310): a, c, t, g, unknown or other
  misc_feature (310)..(310): n is a, c, g, or t
  modified_base (370)..(370): a, c, t, g, unknown or other
  misc_feature (370)..(370): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtggggacgtccctgacgactctcctgtgcagcctntggatcacttcagtagctatggcagtgcacgtcggggtcccnccgaggcctccgagggccgaagggggctgggaggtggggtgcctaggttatatacataanagtaagtagggaaattaaataaagtactagtgacagtactaccggtaggaaacggggcctaattccaacacttccaccaggaactaacaacttaaccggaaagaaccgtacgctaccgttaactactaacgaactaaagtacgaacctacgcgtaaggaaggacgtacgacgggaacggtacgttacggttcgttaggttaacgttagttaacggtgggtacgggacgggtaacgggttaacggtaacg

SEQ ID NO: 320973 - DNA, 578 bp, Homo sapiens
  misc_feature: GZ8MTXP01DG5JX.19.13.B02.1.454.CMB.2.raw
  modified_base (162)..(162): a, c, t, g, unknown or other
  misc_feature (162)..(162): n is a, c, g, or t
  modified_base (258)..(258): a, c, t, g, unknown or other
  misc_feature (258)..(258): n is a, c, g, or t
  modified_base (265)..(265): a, c, t, g, unknown or other
  misc_feature (265)..(265): n is a, c, g, or t
  modified_base (306)..(306): a, c, t, g, unknown or other
  misc_feature (306)..(306): n is a, c, g, or t
  modified_base (358)..(358): a, c, t, g, unknown or other
  misc_feature (358)..(358): n is a, c, g, or t
  modified_base (506)..(506): a, c, t, g, unknown or other
  misc_feature (506)..(506): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttccncgttgctcttttaagaggtgtccagtgtcaggtgcagcgtggtggagtcgtgggggagcgtggtccagccgtgggacgtccctgagctctcctgtncagcctntggatcaccttcagtagctatggcatgcacgtggggtcccnccgaggcctccgagggcgaagggggctgggaggtggggtgacctaggtttanagtcaattaagtgaagtagggaaaacgttaaataaaagtactagtgacagactcgtaggaacggcctattaccactatcctaccgaagacgaacaacttaccgaaacgtaaacacgtacttagtaatccgtagaacctaaatgaaacncgtaccaagagagtcgaggaacggacgacgttcttaggttgtaattcgtaggtggaccggtaagggcgtaag

SEQ ID NO: 320974 - DNA, 565 bp, Homo sapiens
  misc_feature: GZ8MTXP01BUCB3.19.13.B02.1.454.CMB.2.raw
  modified_base (306)..(306): a, c, t, g, unknown or other
  misc_feature (306)..(306): n is a, c, g, or t
  modified_base (352)..(352): a, c, t, g, unknown or other
  misc_feature (352)..(352): n is a, c, g, or t
  modified_base (360)..(360): a, c, t, g, unknown or other
  misc_feature (360)..(360): n is a, c, g, or t
  modified_base (523)..(523): a, c, t, g, unknown or other
  misc_feature (523)..(523): n is a, c, g, or t
  modified_base (543)..(543): a, c, t, g, unknown or other
  misc_feature (543)..(543): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagcgtggtggagtcgtgggggagcgtggtccagcctggggacgtccctgagctctcctgtgcagcctctggatcacttcagtagctatggcatcgcacgtggggtcccncaggctccgagggcaagggggctgggaggtggggtgcctaggttanatcataangaatagggaaataaataaatactatgacagtactccgtggaaggccgattacacctatcctaccaagacgaactaacttaccgaaagtaaccacgactagtaactccgtaagactaaagtgaaaccgacgccgtaagaagagcgttaggaggaccgacggttnttggtaagtatttcgtaggnggttacgtaaggggttcgtaag

SEQ ID NO: 320975 - DNA, 721 bp, Homo sapiens
  misc_feature: GZ8MTXP01APEA9.19.13.B02.1.454.CMB.2.raw
  modified_base (316)..(316): a, c, t, g, unknown or other
  misc_feature (316)..(316): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccaggccgtggggacggtccctgacgacctctcctgtgcagtcctctggatccaccttcagtacgctatggcatgcacgtcggggtcccncgaggcctaccgagggcgaagggggctagggacggtggggtcggacctaggtttatagtcgaattaactaggaagttagggtaaaagttaaattaaaagttaccgttaagtacggaacctaacggaacccgttacccgggtaagggaaacggggtacccgtaagtttacccgaacctacgtacccctacccgaaagaacgtaacctaaaccgttaccggaaaacgtaaaccgtaaccgtaccttacggttactaaccgttacggaaacctaaaagttacggaaaaccacggtcccggtaagaagggacggtaccgttagggaacccgggtaaccgttacgggttcgttacggttaagttacgttaacggttcgggtaggttaccggggtaaggttcgggtttaag

SEQ ID NO: 320976 - DNA, 557 bp, Homo sapiens
  misc_feature: GZ8MTXP01A4481.19.13.B02.1.454.CMB.2.raw
  modified_base (261)..(261): a, c, t, g, unknown or other
  misc_feature (261)..(261): n is a, c, g, or t
  modified_base (272)..(272): a, c, t, g, unknown or other
  misc_feature (272)..(272): n is a, c, g, or t
  modified_base (277)..(277): a, c, t, g, unknown or other
  misc_feature (277)..(277): n is a, c, g, or t
  modified_base (281)..(281): a, c, t, g, unknown or other
  misc_feature (281)..(281): n is a, c, g, or t
  modified_base (300)..(300): a, c, t, g, unknown or other
  misc_feature (300)..(300): n is a, c, g, or t
  modified_base (338)..(338): a, c, t, g, unknown or other
  misc_feature (338)..(338): n is a, c, g, or t
  modified_base (340)..(340): a, c, t, g, unknown or other
  misc_feature (340)..(340): n is a, c, g, or t
  modified_base (345)..(345): a, c, t, g, unknown or other
  misc_feature (345)..(345): n is a, c, g, or t
  modified_base (517)..(517): a, c, t, g, unknown or other
  misc_feature (517)..(517): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtcctgagctctctgtgcagcctntgatcaccttnagtanctanggcatgcacgtgggtcccncaggcctcgaggcgaagggctgggagtggtgcagttantnataangaagtaggaaataataaatctatgacagacgtaccggtagacgggccgattaccaacctattacctaccgaagaacgaactaacttaccgaaagaaaccacgtacttagtactacgtagaactaaagtacgaaacacgaccgtaaggaaggagcgaggacggacgacggttnttagttgtagtaacgttggtgacggtaagggttcggtaag

SEQ ID NO: 320977 - DNA, 611 bp, Homo sapiens
  misc_feature: GZ8MTXP01DNHH0.19.13.B02.1.454.CMB.2.raw
  modified_base (267)..(267): a, c, t, g, unknown or other
  misc_feature (267)..(267): n is a, c, g, or t
  modified_base (282)..(282): a, c, t, g, unknown or other
  misc_feature (282)..(282): n is a, c, g, or t
  modified_base (314)..(314): a, c, t, g, unknown or other
  misc_feature (314)..(314): n is a, c, g, or t
  modified_base (355)..(355): a, c, t, g, unknown or other
  misc_feature (355)..(355): n is a, c, g, or t
  modified_base (367)..(367): a, c, t, g, unknown or other
  misc_feature (367)..(367): n is a, c, g, or t
  modified_base (370)..(370): a, c, t, g, unknown or other
  misc_feature (370)..(370): n is a, c, g, or t
  modified_base (377)..(377): a, c, t, g, unknown or other
  misc_feature (377)..(377): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctgggtggagtcgtggggggaggcgtggtccagcctggggagtccctgacgctctcctgtgcagcctntggacttccaccttnagtagctatggcagtgctacgtcggggccccncgaggcctccgagggccgaagggggtcttgggaggtggggngcctaggtttanatnaataagngaagtacgaaagttaaataaatctagtgactagacgttccggtagaacggggtccaattaccaacctactccgtaccaagacgaaactaacttaccgaaagaaccgacgtccgttagtactcgtagaacctaaatcggaaacacgcctaaggaaggacgtcgttggaacgggtacaccgggttcttaggttaacgttattaacgtggtcggttacggaagggttaaccggtaag

SEQ ID NO: 320978 - DNA, 602 bp, Homo sapiens
  misc_feature: GZ8MTXP01B8BK9.19.13.B02.1.454.CMB.2.raw
  modified_base (312)..(312): a, c, t, g, unknown or other
  misc_feature (312)..(312): n is a, c, g, or t
  modified_base (359)..(359): a, c, t, g, unknown or other
  misc_feature (359)..(359): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctgggtggagtcgtgggggaggcgtggtccagccgtggggacggtccctgagactctcctgtgcagcctctggactcaccttcagtagctagtggcatgccacgtggggcccnccgaggcctccgagggcgaagggggctgggagtggggtgccagttanatcataatgaatagggaaaattaaataaatactaagtgacagacgtaccggtaggaacgggaccgtattaccacctatacctaccgaagaacgaactaaacttaccgaaaagaaccgacgactacgtaactcctagaactaaatacgaaacacgcctaagagagcgttaggaacggacgttacggttcgttacggttaagttagttaacgtggtacgggacgggtaacgggttaaggttaacg

SEQ ID NO: 320979 - DNA, 687 bp, Homo sapiens
  misc_feature: GZ8MTXP01CA1A9.19.13.B02.1.454.CMB.2.raw
  modified_base (307)..(307): a, c, t, g, unknown or other
  misc_feature (307)..(307): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccaggcctggggagtccctgagactctcctgtgcagcctcgtggatcaccttcagtagctatggcatgcacgtgggtcccnccaggcctccgagggccaagggggctgggaggtggggtcgaccgtaggttatatcattaagtggtaagtagggaaaacgtttaaattaaaacgtaccttatacggacctaaggtaccgttacccggtagggaaacggggtacccgtaagtttacccaacccgtattcccgtaccgaagtaacggaaacctaaactttacccgaaaacggtaaacctaccggtacttacggtaactaccgttacggaacctaaaagtaccggaaaaccgtacggtacccgtaaggaaacggttacggaccgttaggaaacgggtaccgacgggttcgttagggttaacgttaacgttaacgtgggttacggacgggtaacgggcggttaag

SEQ ID NO: 320980 - DNA, 597 bp, Homo sapiens
  misc_feature: GZ8MTXP01BM53G.19.13.B02.1.454.CMB.2.raw
  modified_base (275)..(275): a, c, t, g, unknown or other
  misc_feature (275)..(275): n is a, c, g, or t
  modified_base (304)..(304): a, c, t, g, unknown or other
  misc_feature (304)..(304): n is a, c, g, or t
  modified_base (356)..(356): a, c, t, g, unknown or other
  misc_feature (356)..(356): n is a, c, g, or t
  modified_base (560)..(560): a, c, t, g, unknown or other
  misc_feature (560)..(560): n is a, c, g, or t
  modified_base (567)..(567): a, c, t, g, unknown or other
  misc_feature (567)..(567): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgagctctcctgtgcagcctctggatcaccttnagtagctatggcatgcacgtggggtcccnccaggcctccgagggcgaagggggctgggggagtgggggtggccaggtttanatcaattaagtgaagtagggaaagttaaataaataccgtatcgactagactccggtaggaacgggccgtattaccgacctatcctaccgaagtaacgaacctaaacttacccgaaaggtaaaccgacgtaccgttagttactcgtagaaacctaaagtcgaaactacgcccgtaaggagacgtcgttaggacggacacgggttnttaggtntagttcgtggtggcgtaagggttcggtaag

SEQ ID NO: 320981 - DNA, 597 bp, Homo sapiens
  misc_feature: GZ8MTXP01CLDH9.19.13.B02.1.454.CMB.2.raw
  modified_base (253)..(253): a, c, t, g, unknown or other
  misc_feature (253)..(253): n is a, c, g, or t
  modified_base (275)..(275): a, c, t, g, unknown or other
  misc_feature (275)..(275): n is a, c, g, or t
  modified_base (305)..(305): a, c, t, g, unknown or other
  misc_feature (305)..(305): n is a, c, g, or t
  modified_base (353)..(353): a, c, t, g, unknown or other
  misc_feature (353)..(353): n is a, c, g, or t
  modified_base (546)..(546): a, c, t, g, unknown or other
  misc_feature (546)..(546): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgagctctccngtgcagcctctggatcaccttnagtagctatggcatgccacgtggggtcccncgaggcctccgagggcgaagggggctgggaggtgggtgcctaggttanatcataagtgaagtaggtaaagtaaactaaaagtctaatgacgacgtactacccggtaggaacggggtcccaattccaacctactcctacccgaagaacgtaacctaaactttaccggaaacgtaaacctaccggttagtactccgtgaaccaaagtacgaaactacgcctaggaagtaagccgtagacgacncggacgttggttacgtaattcgtgtcggtcgagggtccgttaagtaaccgg

SEQ ID NO: 320982 - DNA, 607 bp, Homo sapiens
  misc_feature: GZ8MTXP01BB8B1.19.13.B02.1.454.CMB.2.raw
  modified_base (264)..(264): a, c, t, g, unknown or other
  misc_feature (264)..(264): n is a, c, g, or t
  modified_base (276)..(276): a, c, t, g, unknown or other
  misc_feature (276)..(276): n is a, c, g, or t
  modified_base (307)..(307): a, c, t, g, unknown or other
  misc_feature (307)..(307): n is a, c, g, or t
  modified_base (580)..(580): a, c, t, g, unknown or other
  misc_feature (580)..(580): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgagtctctcctgtgcagcctnggtatcaccttnagtagctagtggcatgccacgtcgggtcccncgtaggcctaccggaggtccgaagggggctgggaggtggggtacggcctaggtttacatcaagtaatagaatacgggaaaattaaataaatactagtgaactaacgtactccggtaggaacgggtcctataccgacctatcctacgaagaacgaactaaaccttccgaaaagtaaccgacggtacttaagtaccttcgacgaaacctaaatacgaaacacgcgtaagaggagtcacgggaagacgaacggcgttaggtaagtatttaacgggnggtacggacgggtaaggttaacgtaag

SEQ ID NO: 320983 - DNA, 640 bp, Homo sapiens
  misc_feature: GZ8MTXP01CI1EJ.19.13.B02.1.454.CMB.2.raw
  modified_base (198)..(198): a, c, t, g, unknown or other
  misc_feature (198)..(198): n is a, c, g, or t
  modified_base (284)..(284): a, c, t, g, unknown or other
  misc_feature (284)..(284): n is a, c, g, or t
  modified_base (289)..(289): a, c, t, g, unknown or other
  misc_feature (289)..(289): n is a, c, g, or t
  modified_base (314)..(314): a, c, t, g, unknown or other
  misc_feature (314)..(314): n is a, c, g, or t
  modified_base (368)..(368): a, c, t, g, unknown or other
  misc_feature (368)..(368): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtncagctgggtggagtcgtgggggagcgtggtccagccgtggggacgtccctgagtctctcctgtgcagcctcgtggtatccaccttnagtanctatggcatgcacgtcggggtcccnccgaggcctaccgagggcgaagggggctggggaggtggggtagcctaaggttanatcaattaaagtagaagtagggtaaaacttaaattaaatactagtcgacacgtacgtaccggtaggaacgggtccgtacttaccgacctactacctaccgaagaacgaactaaaccttaaccgaaacgtaaaccgacgtaccgttagtaacttacgtacgaaacctaaagtacgaaacacgtacccgtaaggaacgaggacgttaggaacggacgacggttcgttaggtaagtagttaacgtggtacggttacggtaacgggttaaggtaag

SEQ ID NO: 320984 - DNA, 612 bp, Homo sapiens
  misc_feature: GZ8MTXP01CELTP.19.13.B02.1.454.CMB.2.raw
  modified_base (260)..(260): a, c, t, g, unknown or other
  misc_feature (260)..(260): n is a, c, g, or t
  modified_base (267)..(267): a, c, t, g, unknown or other
  misc_feature (267)..(267): n is a, c, g, or t
  modified_base (283)..(283): a, c, t, g, unknown or other
  misc_feature (283)..(283): n is a, c, g, or t
  modified_base (307)..(307): a, c, t, g, unknown or other
  misc_feature (307)..(307): n is a, c, g, or t
  modified_base (354)..(354): a, c, t, g, unknown or other
  misc_feature (354)..(354): n is a, c, g, or t
  modified_base (362)..(362): a, c, t, g, unknown or other
  misc_feature (362)..(362): n is a, c, g, or t
  modified_base (380)..(380): a, c, t, g, unknown or other
  misc_feature (380)..(380): n is a, c, g, or t
  modified_base (385)..(385): a, c, t, g, unknown or other
  misc_feature (385)..(385): n is a, c, g, or t
  modified_base (412)..(412): a, c, t, g, unknown or other
  misc_feature (412)..(412): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccagccgtgggagtccctgacgtctctcctgtncagcctntggatcacttcagtanctatggcatgcacgtcgggtcccncaggcctccgagggcgaagggggtctgggagtggggtgaccagttanatcataangaataggaaataaataanactangacagactacggagacggctatcactntctaccaagacgaactaaacttaccgaaagtaacctacgtacgttacgtaactaccgtagaaacctaaaagttacgaaaaccgtcgacccgtaaggaacggaggtaccgttaggggaaacggtacgttacgggttcttaggttaagtttaaacgttaacggttgggtacgggttacgggtaacgggttaaccggtttaag

SEQ ID NO: 320985 - DNA, 591 bp, Homo sapiens
  misc_feature: GZ8MTXP01BSSO2.19.13.B02.1.454.CMB.2.raw
  modified_base (265)..(265): a, c, t, g, unknown or other
  misc_feature (265)..(265): n is a, c, g, or t
  modified_base (308)..(308): a, c, t, g, unknown or other
  misc_feature (308)..(308): n is a, c, g, or t
  modified_base (351)..(351): a, c, t, g, unknown or other
  misc_feature (351)..(351): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggacgtccctgagactctcctgtgcagcctntggatcccacttcagtagctatggcatcgcacgtggggtcccncgaggcctccgagggcgagggggctgggagtgggtgcagttanatcataatgaatagggaaactaaataatactatgacagactccggtaggaacggggcctattaccacctactcctaccgaagaacgaactaacttaccggaaacgtaaccgacgtacttagtactcgtacgaactaaatacggaaacacggtacctaaggaagacgtcggttaggaacgggtaacgaccggttgttaggtaagttagttaacgtggtacggcggtaacgggttcggtaag

SEQ ID NO: 320986 - DNA, 610 bp, Homo sapiens
  misc_feature: GZ8MTXP01A0F00.19.13.B02.1.454.CMB.2.raw
  modified_base (283)..(283): a, c, t, g, unknown or other
  misc_feature (283)..(283): n is a, c, g, or t
  modified_base (313)..(313): a, c, t, g, unknown or other
  misc_feature (313)..(313): n is a, c, g, or t
  modified_base (339)..(339): a, c, t, g, unknown or other
  misc_feature (339)..(339): n is a, c, g, or t
  modified_base (355)..(355): a, c, t, g, unknown or other
  misc_feature (355)..(355): n is a, c, g, or t
  modified_base (358)..(358): a, c, t, g, unknown or other
  misc_feature (358)..(358): n is a, c, g, or t
  modified_base (364)..(364): a, c, t, g, unknown or other
  misc_feature (364)..(364): n is a, c, g, or t
  modified_base (390)..(390): a, c, t, g, unknown or other
  misc_feature (390)..(390): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagcgtggttttcctcgttgctcttttaagaggtgtccagtgtcaggtgcagcgtggtggagtcgtgggggagcgtggtccagccgtggggacggtccctgacgactctcctgtcgcagcctctggactcaccttnagtagctatggcatgcacgtggggtccccncgaggccacgaggcgaggggctgggnggtggtcgctagttanatnataagngaagtagggaaataataaactactancgacacgacgtcgtagacggctactacactactacacgagaacgtaactaactaaccgaaacgtaaccgtacgtacgttacgtactcgtacgaactaaacgtaacgtaacgtacgtacgtaacgacggacggtacgttacggtaacggtaacggacggttcgttacggttaagttacgttaacgttacggtcgggttacggtaacgggttaacggtaacg

SEQ ID NO: 320987 - DNA, 540 bp, Homo sapiens
  misc_feature: GZ8MTXP01AGSHX.19.13.B02.1.454.CMB.2.raw
  modified_base (272)..(272): a, c, t, g, unknown or other
  misc_feature (272)..(272): n is a, c, g, or t
  modified_base (314)..(314): a, c, t, g, unknown or other
  misc_feature (314)..(314): n is a, c, g, or t
  modified_base (374)..(374): a, c, t, g, unknown or other
  misc_feature (374)..(374): n is a, c, g, or t
  modified_base (445)..(445): a, c, t, g, unknown or other
  misc_feature (445)..(445): n is a, c, g, or t
  modified_base (448)..(448): a, c, t, g, unknown or other
  misc_feature (448)..(448): n is a, c, g, or t
  modified_base (458)..(458): a, c, t, g, unknown or other
  misc_feature (458)..(458): n is a, c, g, or t
  modified_base (471)..(471): a, c, t, g, unknown or other
  misc_feature (471)..(471): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagcttgggtttttcctcgttgcttctttttaagaggtgtccagtgtcaggtgcagcgtggtggagtcgtgggggaggcgtggtccgagccgtgggacggtccctgagtctctctgtgcagcctntggactcaccttcagtagctatggcatgcacgtggggtcccncgaggcctccgagggcgaagggggctgggaggtggggagacctaggttatatcagttaangaagtagggaaattaataaatctatgacagactcgtagacggctatcacatcacagacactaactacgaanacncgactgtacnagacaatcgaacncgcaagagagcgaggacggacacggttcttaggtaagttattcgtggtacggcggtaagggttcgtaag

SEQ ID NO: 320988 - DNA, 590 bp, Homo sapiens
  misc_feature: GZ8MTXP01B3NEE.19.13.B02.1.454.CMB.2.raw
  modified_base (259)..(259): a, c, t, g, unknown or other
  misc_feature (259)..(259): n is a, c, g, or t
  modified_base (267)..(267): a, c, t, g, unknown or other
  misc_feature (267)..(267): n is a, c, g, or t
  modified_base (311)..(311): a, c, t, g, unknown or other
  misc_feature (311)..(311): n is a, c, g, or t
  modified_base (366)..(366): a, c, t, g, unknown or other
  misc_feature (366)..(366): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctgggtggagtcgtgggggagcgtggtccagccgtggggagtccctgagctctcctgngcagcctntggatcaccttcagtagctatggctagtgcacgtcggggtcccnccgaggcctcgaggcgaagggggctgggagtggggtgctaggttatatcataagngaagtaggtaaagtaaataaatactatcgacagtactaccggtaggacgggccgtattaccacctatcctaccagtaacgaactaacttaccgaaacgtaaaccacgtactagttaactctagaactaaatacggaaactacgcctaaggaacgttagccgttaggaacggacgacggttcttagttaagttattaacgtggtggacggtaaggttcggttaag

SEQ ID NO: 320989 - DNA, 615 bp, Homo sapiens
  misc_feature: GZ8MTXP01A8QVQ.19.13.B02.1.454.CMB.2.raw
  modified_base (247)..(247): a, c, t, g, unknown or other
  misc_feature (247)..(247): n is a, c, g, or t
  modified_base (310)..(310): a, c, t, g, unknown or other
  misc_feature (310)..(310): n is a, c, g, or t
  modified_base (361)..(361): a, c, t, g, unknown or other
  misc_feature (361)..(361): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagtcttgggttttcctcgttgctcttttaagaggtgtccagtgtcaggtgcagctggtggagtcgtgggggagcgtggtccagccgtggggacgtcccngagctctcctgtgcagcctctggatccaccttcagtagctatggcatcgcacgtggggtcccncgaggcctaccgaggcgaagggggctagggaggtcggggtgcctaggttanatcataagtgaatacgggaaattaaataaatactagtgacagtacgtccggtagaacgggtcctaattaccgacctatccacaagagtaactaacttaccgaaagacctaacgtcttaagtactacgtacgaacaaagtaccgaaacgcgtacccgaaggaacgaggtccgttagggaacggtaaccgacgggttccgttaggtaagttaaccgttaacggtgggtcggaacgggtaacggttaacgggttaag

SEQ ID NO: 320990 - DNA, 754 bp, Homo sapiens
  misc_feature: GZ8MTXP01EH880.19.13.B02.1.454.CMB.2.raw
  modified_base (282)..(282): a, c, t, g, unknown or other
  misc_feature (282)..(282): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagcttgggtttttcctcgttgcttcttttaagaggtgtccagtgtcaggtgcagcgtggtggagtcgtgggggagcgtggtccagccgtgggacgtcctgagtctctcctgtgcagtcctcgtgactcaccttnagtagctagtggctagtcgctacgtcggcctccgaccagggcctacccggagggaccggaaagggggtccgtagggtaaggggttggggtacggaccttaaggtttaactagtacctaaaagttagttaaggaaagttaaaggggttaaaattaaaacctttaaattaactagttacgactaaacggtaccctaccgggtaaggaaaccgggtaccgtttaaacgttaccctaaaccctacgttcctaaacccgaaagggtaaacgtaaacccttaaaacgtttaaccctaaaaaacgggtaacccaaacgggttacccgttaattaccggttaacttaaaccgggtaaaactaaaacgtaaccgaaacgtacggtaaccggtaggaacggtacgttacgaagggtaacgacgttcggttagttaagtacgttaagttacggtacggttacggtaacgggttaacggtaacg

SEQ ID NO: 320991 - DNA, 573 bp, Homo sapiens
  misc_feature: GZ8MTXP01BUPV6.19.13.B02.1.454.CMB.2.raw
  modified_base (304)..(304): a, c, t, g, unknown or other
  misc_feature (304)..(304): n is a, c, g, or t
  modified_base (349)..(349): a, c, t, g, unknown or other
  misc_feature (349)..(349): n is a, c, g, or t
  modified_base (358)..(358): a, c, t, g, unknown or other
  misc_feature (358)..(358): n is a, c, g, or t
  modified_base (482)..(482): a, c, t, g, unknown or other
  misc_feature (482)..(482): n is a, c, g, or t
  modified_base (565)..(565): a, c, t, g, unknown or other
  misc_feature (565)..(565): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgacgctctcctgtacgcagcctctggatcaccttcagtagctatggcatgcacgtgggtccncaggcctcgagggcaagggggctgggagtggggtgcctaggttanagtcataangaagtagggaaactaataaatctatgacagacgtacgtagacggccgtatacgacatctaccgagacgaacaacttaccgaaagtaaccgacgacgtagtacgtctacgaacaaagtcgaaacncgccgtaaggagttacgcgttaggaacggacgacgggttcttaggttaacgttagttaaccgtgggtcggcggttaaacgggnggttaacg

SEQ ID NO: 320992 - DNA, 625 bp, Homo sapiens
  misc_feature: GZ8MTXP01AOYFC.19.13.B02.1.454.CMB.2.raw
  modified_base (272)..(272): a, c, t, g, unknown or other
  misc_feature (272)..(272): n is a, c, g, or t
  modified_base (317)..(317): a, c, t, g, unknown or other
  misc_feature (317)..(317): n is a, c, g, or t
  modified_base (363)..(363): a, c, t, g, unknown or other
  misc_feature (363)..(363): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccaggccgtggggacgtccctgacgtactctcctgtcgcagcctntggatccaccttcagtagctatggcatcgctacgtggggtccccncaggctccgagggacgaagggggctgggagtggggtgcctagttanatcataagtgaagtaggaaagtaaataaagtactatcgacagactccggtagaacgggcctattaccacctatacctaccgagtaacgaactaacttaccgaaacgaacacgtctagtactcgtagaactaaagtcgaaacgacgccgtaaggaacgttaggcgttacgggaacgggaaccgttaccggggttcgtttaggttaaggttaacgtttaaccggtagggtgggttaacccgggtaaggggttccgggttaaagg

SEQ ID NO: 320993 - DNA, 633 bp, Homo sapiens
  misc_feature: GZ8MTXP01C7Q5Q.19.13.B02.1.454.CMB.2.raw
  modified_base (311)..(311): a, c, t, g, unknown or other
  misc_feature (311)..(311): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagcgtggtggagtcgtgggggagcggtggtccagccgtggggagtccctgacgtctctccgtgtcgcagcctctggatcactcagtagctatggcatgcacgtggggtcccnccaggcctccgagggccgaagggggctgggaggtggggtgacctaggttatacgtacattaagtagtaagtaagggtaaaattaaagtaaaactctaagtgacagtacctccggtagaacgggcctattaccaacgtataccgaccagacgaactaactaccgaaagaacacgtactagtactcagaacaaatacgaacacgtcgtaaggaagacggacgttacgggaacggtaaccgttaccgggttactttcgggttaagttaaaccgtttaacggttggggaacggttccgggggtaagggttaacccgggtttaaaag

SEQ ID NO: 320994 - DNA, 700 bp, Homo sapiens
  misc_feature: GZ8MTXP01DBKV4.19.13.B02.1.454.CMB.2.raw
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtggggggagcgtggtccaggcccgtggggacgtccctgacgactctcctgtgcagcctctggatcaccttcagtagctagtggcatgcacgtgggtcccgccaggcctccgagggcgaaggggggtctggggacggtgggggtcggaccctaggtttactagtaccgtaattaaagtggtaagtaggggaaaactttaaattaaaacgttactaagttcggacctaacgaccgttacccggtaaggaacgggggtcctaaatttaccaacctacttcccgtaccaagaacgtaaacctaaacgtttaacccgaaaacgtaaacccgtaaccgtaccgttaggtaactaccgttacggaaaccctaaagtaaccggtaaacacggtacccgttaaggaacggagtccgttaggacgggtaaccgaaccgggttcttacgggttaagttaactttaaccggtgtcgggacggtaagggttccggtttaagg

SEQ ID NO: 320995 - DNA, 605 bp, Homo sapiens
  misc_feature: GZ8MTXP01AJ5BY.19.13.B02.1.454.CMB.2.raw
  modified_base (303)..(303): a, c, t, g, unknown or other
  misc_feature (303)..(303): n is a, c, g, or t
  modified_base (431)..(431): a, c, t, g, unknown or other
  misc_feature (431)..(431): n is a, c, g, or t
  modified_base (489)..(489): a, c, t, g, unknown or other
  misc_feature (489)..(489): n is a, c, g, or t
tcagtactctcgtgcacgaccggtgctcgatttagtctagcgactttgggttcggggagaggagcccagcactagaagtcggcggtgtttccattcggtgatcagcactgaacacagaggactcaccatggagtttgggctgagcttgggttttcctcgttgctcttttaagaggtgtccagtgtcaggtgcaccgtggtggagtcgtgggggagcgtggtccagccgtgggacgtccctgagactctcctgtgcagcctctgacttcaccttcagtagctttggctactccacgtcggtccnccaggcctccgaggcgaagggggctaaggaggtggggtcgctaagttatatcagttagtgaagtagggaaaggtaaaatagttaaattagtggaagtaccgtacgtagggaacggccgtatccacctntacctcgaagacgaactaactacaaagacacgagtagatactagacaaagtgaaaccngccgtgagacgcggtagggacacggtcttggtcttagttcgttggtcgacggaggacggccgggtaacgtggaacctaaccgtaccttacgtaacccgttaaggtttaacccgggg

SEQ ID NO: 320996 - DNA, 601 bp, Homo sapiens
  misc_feature: GZ8MTXP01A1A9D.19.13.B02.1.454.CMB.2.raw
  modified_base (247)..(247): a, c, t, g, unknown or other
  misc_feature (247)..(247): n is a, c, g, or t
  modified_base (320)..(320): a, c, t, g, unknown or other
  misc_feature (320)..(320): n is a, c, g, or t
  modified_base (364)..(364): a, c, t, g, unknown or other
  misc_feature (364)..(364): n is a, c, g, or t
  modified_base (373)..(373): a, c, t, g, unknown or other
  misc_feature (373)..(373): n is a, c, g, or t
tcagtactctcgtgcacgaccggtgctcgatttagtctagcgacttccgcggggagctctggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagcgtggtggagtcgtgggggagcgtggtccagccgtgggacgtccngacgactctcctgtgcagcctcgtggtactcaccttcaagtacgctagtggccagtgcctacgtggggtcccnccgaggctccgaggcgagggggctgggagtgggtgcctagttanatcataagngaagtaggaaactaataaatctatcgacagtacctacggtaggacgggaccgtattaccacctatcctaccgagtaacgaactaaactaccgaaacgtaacgactacgttagtactacgtagaacaaagtacgaaacacgccgaagaagaccggtagagggaacggccgttaacgggttcttacgttgtacgttaacgtagggtcggaccggtaaggttccgggtaag

SEQ ID NO: 320997 - DNA, 585 bp, Homo sapiens
  misc_feature: GZ8MTXP01AIN26.19.13.B02.1.454.CMB.2.raw
  modified_base (260)..(260): a, c, t, g, unknown or other
  misc_feature (260)..(260): n is a, c, g, or t
  modified_base (267)..(267): a, c, t, g, unknown or other
  misc_feature (267)..(267): n is a, c, g, or t
  modified_base (278)..(278): a, c, t, g, unknown or other
  misc_feature (278)..(278): n is a, c, g, or t
  modified_base (305)..(305): a, c, t, g, unknown or other
  misc_feature (305)..(305): n is a, c, g, or t
  modified_base (350)..(350): a, c, t, g, unknown or other
  misc_feature (350)..(350): n is a, c, g, or t
  modified_base (550)..(550): a, c, t, g, unknown or other
  misc_feature (550)..(550): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccagccgtggggagtccctgagactctcctgtncagcctntgatcaccttnagtgctatggcatgcacgtcgggcccncgaggcctcgagggcgaagggggctgggaggtgggtgctagttanatcataagtgaagtagggaaattaaataaagtactagtagactaagtacgtaccggtaggaacgggtccctagttacccaacctacgtcctaccgaagaactaactaaacttaacccggaaagtaaccgacgtacttagtactcctagaaaccaaatgaaaccgcgccgtaagacgttagcgttaggaacgtcgacgttnttagtaagtataacgtgtggacggtggttgtaacg

SEQ ID NO: 320998 - DNA, 618 bp, Homo sapiens
  misc_feature: GZ8MTXP01BH5BP.19.13.B02.1.454.CMB.2.raw
  modified_base (265)..(265): a, c, t, g, unknown or other
  misc_feature (265)..(265): n is a, c, g, or t
  modified_base (310)..(310): a, c, t, g, unknown or other
  misc_feature (310)..(310): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtggagtcgtgggggagcgtggtccagccgtgggacgtccctgagctctcctgtgcagcctntggactccaccttcagtagctagtggcatgctacgtggggtcccnccgaggcctacgagggcgaagggggctagggaggtggggtgacctagttatatcataagtgaatagggtaaaattaaataaacttctaatcgactaagtacgtaccggtaggaacgggccgtaattacccgactatcctacgacgaagaactaacttacgaaacgaactacgactagtactcgtacgaactaaagtacgaaacgacgtccgtaaggaacgttacggccgttaggaacggtaccgaccgggttctttcggtaagttaacgttaacgtgggtcggacgggtaacgggttaaccggttaag

SEQ ID NO: 320999 - DNA, 580 bp, Homo sapiens
  misc_feature: GZ8MTXP01D5Q22.19.13.B02.1.454.CMB.2.raw
  modified_base (259)..(259): a, c, t, g, unknown or other
  misc_feature (259)..(259): n is a, c, g, or t
  modified_base (306)..(306): a, c, t, g, unknown or other
  misc_feature (306)..(306): n is a, c, g, or t
  modified_base (532)..(532): a, c, t, g, unknown or other
  misc_feature (532)..(532): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagcttggggttttcctcgttgcttcttttaagaggtgtccagtgtcaggtgcagctggtggagtcgtgggggagcgtggtccagccgtgggagtccctgagactctcctgngcagcctctggatcacttcagtagctatggcatgcacgtgggtcccncgaggctccgagggcgaagggggctgggaggtggggtcgtcctaggttatatcaataagtgaagtaggaaagttaaaataaatactatgactagactcgtagaaggccgatacgacatctaccagacaactaacttaccgaaagtaacacgtactagtaactcgtagaactaaagtacgaaacacgccgtaaggaagacgtacgttaggaggtaacgaccgggttnttggttaagtacgttaacgtaggtcggacgggtaaggttccggttaag

SEQ ID NO: 321000 - DNA, 500 bp, Homo sapiens
  misc_feature: GZ8MTXP01EYAFR.19.13.B02.1.454.CMB.2.raw
  modified_base (300)..(300): a, c, t, g, unknown or other
  misc_feature (300)..(300): n is a, c, g, or t
  modified_base (338)..(338): a, c, t, g, unknown or other
  misc_feature (338)..(338): n is a, c, g, or t
  modified_base (447)..(447): a, c, t, g, unknown or other
  misc_feature (447)..(447): n is a, c, g, or t
tcagtactctcgtgcacgaccggtgctcgatttagtctagcgacttccgcgggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggatcaccttcagtagctatggcatgcactgggccncaggctccagggcaaggggctggagtgggtgcagttanatcataatgaatgggaaataaataaatactaatgacagactccgtagaagggccgattacaccatctcagagacaattccaaagaacacgctgtatctgacaatgaacngcctgagagcttgagggacacgggcttgtgattaacgtgtgcgtgggcggtaa

SEQ ID NO: 321001 - DNA, 668 bp, Homo sapiens
  misc_feature: GZ8MTXP01DI8FA.19.13.B02.1.454.CMB.2.raw
  modified_base (312)..(312): a, c, t, g, unknown or other
  misc_feature (312)..(312): n is a, c, g, or t
  modified_base (351)..(351): a, c, t, g, unknown or other
  misc_feature (351)..(351): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccagccgtgggagtccctgagctctcctgtgcagcctgtgactcaccttcagtgctagtcggctagtcgctacgtcggggtcccnccgaggcctccgagggcgaagggggctgggaggtggggngaccgtagttaatatcaagtaatgaagtagggtaaaacgttaaattaaatactaagtgaaccgaacgtaccgttaccggtaaggtaacgggacccgtaagttaccctaacctacttacccgaccgaaacgaacgtaaacctaaaccgtttaacccgaaacgtaaacctaacggttacctaggttactacgtagtaaactaaacgtacgaaacgtacgtccgaaggacgttaacggcgttaacggaacgggtaccaccggttcgttggttaagttacggttcgttaggcgggttaccggtaagggttaaccggttaag

SEQ ID NO: 321002 - DNA, 530 bp, Homo sapiens
  misc_feature: GZ8MTXP01C1T6C.19.13.B02.1.454.CMB.2.raw
  modified_base (178)..(178): a, c, t, g, unknown or other
  misc_feature (178)..(178): n is a, c, g, or t
  modified_base (264)..(264): a, c, t, g, unknown or other
  misc_feature (264)..(264): n is a, c, g, or t
  modified_base (276)..(276): a, c, t, g, unknown or other
  misc_feature (276)..(276): n is a, c, g, or t
  modified_base (305)..(305): a, c, t, g, unknown or other
  misc_feature (305)..(305): n is a, c, g, or t
  modified_base (423)..(423): a, c, t, g, unknown or other
  misc_feature (423)..(423): n is a, c, g, or t
  modified_base (426)..(426): a, c, t, g, unknown or other
  misc_feature (426)..(426): n is a, c, g, or t
  modified_base (428)..(428): a, c, t, g, unknown or other
  misc_feature (428)..(428): n is a, c, g, or t
  modified_base (439)..(440): a, c, t, g, unknown or other
  misc_feature (439)..(440): n is a, c, g, or t
  modified_base (448)..(448): a, c, t, g, unknown or other
  misc_feature (448)..(448): n is a, c, g, or t
  modified_base (459)..(459): a, c, t, g, unknown or other
  misc_feature (459)..(459): n is a, c, g, or t
  modified_base (486)..(486): a, c, t, g, unknown or other
  misc_feature (486)..(486): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagnggtgtccagtgtcaggtgcagctggtggagtcgtgggggagcgtggtccagccgtgggagtccctgagactctcctgtgcagcctntggatcaccttnagtagctatggcatgcacgtggggtcccnccagggcctccgagggcgaagggggctagggaggtggggtgccaggtttatatcgaattaagtgaagtagggtaaacttaaataaatactatgacagactcgagaggcatacacatcncananacatcaagacnnctgtatcngacaatgaacngcctgagagcgttaggacggacacggnttggtaagttaacttcgtggtcggttacggtaagggcggttaag

SEQ ID NO: 321003 - DNA, 504 bp, Homo sapiens
  misc_feature: GZ8MTXP01BPFRY.19.13.B02.1.454.CMB.2.raw
  modified_base (299)..(299): a, c, t, g, unknown or other
  misc_feature (299)..(299): n is a, c, g, or t
  modified_base (328)..(328): a, c, t, g, unknown or other
  misc_feature (328)..(328): n is a, c, g, or t
  modified_base (337)..(337): a, c, t, g, unknown or other
  misc_feature (337)..(337): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggagtccctgagactctcctgtgcagcctctggatcacttcagtagctatggcatgcactgggtccncaggctcaggcaagggggctggagtgggngccagttanatcataatgaatggaaagtaataatacatgacagactcgtgaggcgattcacatcaccagagacaattaccgaagaacacgctagtatctagacaaatgaacagcctgagagcgttgacgggaacacgggcttggttgtattaacgtggtggcggtaaggcggtaag

SEQ ID NO: 321004 - DNA, 711 bp, Homo sapiens
  misc_feature: GZ8MTXP01CTK0A.19.13.B02.1.454.CMB.2.raw
  modified_base (272)..(272): a, c, t, g, unknown or other
  misc_feature (272)..(272): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggaggtcgtgggggaggcgtggtccaggccgtggggacggtccctgacgacctctcctgtgcagcctntggactcaccttcagtagctagtggcatgcacgtgggcccgcaggcctccgagggcgaagggggctgggaggtgggtggcctaggttatatcgaattaagtgtaagtagggaaaacgttaaattaaaagtactaatgaccgtaacgtaaccgtcccgggtagggaacggggtaccctagttaccaacccgtatacccgtaccaagtaacgaactaaacgtttacccgaaaaggtaaacccaccggtaccttaggtaacttccgttaacggaaacctaaaagttcggaaaaccgaccggtccccgttaagggaacggttaacggacgttaacgggtaaaccgggaccgttaaacgggttccttaaggggtttaagtttaaacgtttaacccggttgggttaccgggaccgggttaagggggttaaccgggtttaaaaggg

SEQ ID NO: 321005 - DNA, 514 bp, Homo sapiens
  misc_feature: GZ8MTXP01AC7VI.19.13.B02.1.454.CMB.2.raw
  modified_base (301)..(301): a, c, t, g, unknown or other
  misc_feature (301)..(301): n is a, c, g, or t
  modified_base (339)..(339): a, c, t, g, unknown or other
  misc_feature (339)..(339): n is a, c, g, or t
  modified_base (347)..(347): a, c, t, g, unknown or other
  misc_feature (347)..(347): n is a, c, g, or t
  modified_base (473)..(473): a, c, t, g, unknown or other
  misc_feature (473)..(473): n is a, c, g, or t
  modified_base (487)..(487): a, c, t, g, unknown or other
  misc_feature (487)..(487): n is a, c, g, or t
  modified_base (499)..(499): a, c, t, g, unknown or other
  misc_feature (499)..(499): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcctctggatcaccttcagtagctatggcatgcactgggtccncaggctcaggcaaggggctggagtgggtgccaggttanatcataangaatgggaaagttaataaatactatgacagacgtccgtagaaacgggccgattccacattccgaccagagacaacttaccgaaagaacacgactagtatctagacaaatgaacacgcctgagagcnggaagacacggttnttgtaatatcgngtgacgtggcgtaag

SEQ ID NO: 321006 - DNA, 514 bp, Homo sapiens
  misc_feature: GZ8MTXP01AO7U1.19.13.B02.1.454.CMB.2.raw
  modified_base (304)..(304): a, c, t, g, unknown or other
  misc_feature (304)..(304): n is a, c, g, or t
  modified_base (345)..(345): a, c, t, g, unknown or other
  misc_feature (345)..(345): n is a, c, g, or t
  modified_base (354)..(354): a, c, t, g, unknown or other
  misc_feature (354)..(354): n is a, c, g, or t
  modified_base (409)..(409): a, c, t, g, unknown or other
  misc_feature (409)..(409): n is a, c, g, or t
  modified_base (414)..(414): a, c, t, g, unknown or other
  misc_feature (414)..(414): n is a, c, g, or t
  modified_base (470)..(470): a, c, t, g, unknown or other
  misc_feature (470)..(470): n is a, c, g, or t
  modified_base (506)..(506): a, c, t, g, unknown or other
  misc_feature (506)..(506): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctggggagtccctgagactctcctgtgcagcctctggatcacttcagtagctatggcatgcacgtggggtcccnccaggcctccgagggcaagggggctggagtggtgcagttanagtcataangaatgggaaactaaataaatctaatgacagactcgtagaacgggccatcacatcncaganacaataccgaaagtaacacgctagtatctagacaaatgaaacagcctaagaagagnttaggaagacaggcttgtgtattaacgtggcgacgnggcgtaag

SEQ ID NO: 321007 - DNA, 555 bp, Homo sapiens
  misc_feature: GZ8MTXP01AVN77.19.13.B02.1.454.CMB.2.raw
  modified_base (263)..(263): a, c, t, g, unknown or other
  misc_feature (263)..(263): n is a, c, g, or t
  modified_base (302)..(302): a, c, t, g, unknown or other
  misc_feature (302)..(302): n is a, c, g, or t
  modified_base (336)..(336): a, c, t, g, unknown or other
  misc_feature (336)..(336): n is a, c, g, or t
  modified_base (347)..(347): a, c, t, g, unknown or other
  misc_feature (347)..(347): n is a, c, g, or t
  modified_base (469)..(469): a, c, t, g, unknown or other
  misc_feature (469)..(469): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcctntggatcaccttcagtagctatggcatgcacgtgggcccncaggcctccgaggcgaagggggctggagtggggngcctaggttanatcagtaatgaatagggaaataaataagtactagtgacagactcggtaggaacgggtccattaccgactatccgtaccagaacgacaaacttacccgaaagtaaccgacgtacctagtaacncgttagaacctaaagtacgaactagcctaagacgagcttaggaaggacacggcttaggtgtatcgtggtcgcggtaaggcgggtaa

SEQ ID NO: 321008 - DNA, 741 bp, Homo sapiens
  misc_feature: GZ8MTXP01EFVFM.19.13.B02.1.454.CMB.2.raw
  modified_base (334)..(334): a, c, t, g, unknown or other
  misc_feature (334)..(334): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagtcttgggttttcctcgttgcttcttttaagaggtgtccagtgtcaggtgcagctggtggagtcgtgggggagcgtggtccagccgtggggaggtccctggacgtacttctcctggtcgcacggtcctcgtaggtactccaccttgagtacgctagtggctagtgccgtacgtcgggggtccccncgacggtcctaccggagggtacggaagggggtcgtagggggtagggttggggtacgtacgttaagtttagtatacgtaagttaaggtaggtaagttaaagggtaaaacgttaaattaaacgttacgtaggtacgtaccgtaacggtaccggttacgggtacgggtaaccggtacccgttaacgttaccccaaccgttaccgtacccgtaacgaaacgtaaaccgtaaaccttaaacgttaacccgggaaactaaccgtacgtacttagtaactacgtaagaacgtaaacgtaacgaaacgtacgacgtaacggtaacgacggtacgacggaacggtaacggttacggttcgttacggttaagttacgttaacggtggtacggttacggtaacgggttaacggtaacg

SEQ ID NO: 321009 - DNA, 756 bp, Homo sapiens
  misc_feature: GZ8MTXP01AZ7PJ.19.13.B02.1.454.CMB.2.raw
  modified_base (302)..(302): a, c, t, g, unknown or other
  misc_feature (302)..(302): n is a, c, g, or t
  modified_base (313)..(313): a, c, t, g, unknown or other
  misc_feature (313)..(313): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagtcttgggttttcctcgttgcttcttttaagaggtgtccagtgtcaggtgcaggcgtgggtggaggtcggtggggggaggtcggtggtccgaggccgtggggacggtccctggacgtcctctcctgtcgcacgtccctgtggattccaccttnagtagcttagnggacagtcgccgtaccggtcggggtccccgccgagggccctaccggagggccggtaaggggggtcgttagggggtacgggttgggggtacggtaccgttaggtttaatacgtacgtaagtttaagtaacgggtaagttaaagggtaaaaagtttaaaattaaaaacgttacgtaagtacggaaccgtaacggtacccgttaccgggtaacggggaaccgggtaccgtaacttaccgaacctacgtacccgtacccgaaagtaacgtaaccttaaacgttaacccgggaaacgtaaaccgtaccgtaccgttagtaaccttacgtacgaaactaacgtaccgaaactaccggctaagggacgacggcttaacggggacggtaaccgttacgggttcttaggttaacgttaatcggtgggtcgaggggtaacgggttcggttaag

SEQ ID NO: 321010 - DNA, 551 bp, Homo sapiens
  misc_feature: GZ8MTXP01EXK02.19.13.B02.1.454.CMB.2.raw
  modified_base (265)..(265): a, c, t, g, unknown or other
  misc_feature (265)..(265): n is a, c, g, or t
  modified_base (302)..(302): a, c, t, g, unknown or other
  misc_feature (302)..(302): n is a, c, g, or t
  modified_base (333)..(333): a, c, t, g, unknown or other
  misc_feature (333)..(333): n is a, c, g, or t
  modified_base (341)..(341): a, c, t, g, unknown or other
  misc_feature (341)..(341): n is a, c, g, or t
  modified_base (343)..(343): a, c, t, g, unknown or other
  misc_feature (343)..(343): n is a, c, g, or t
  modified_base (348)..(348): a, c, t, g, unknown or other
  misc_feature (348)..(348): n is a, c, g, or t
  modified_base (372)..(372): a, c, t, g, unknown or other
  misc_feature (372)..(372): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaggtccctgagactctcctgtgcagcctntggatcacttcagtagctatggcatgcatgggtcccncaggcctcgaggcagggggctggagtggggngcagttantnataangaatagggaaataataatactagngacagacgtccgtaggaacgggccgattaccactatccaccagactaactaaacgttacccgaaagtaaaccacggtctagtaactcgtagaacaaatcgaaaccagcctaagagaacgcgttagaacgggacacggcttggtaacgttattaacgtggtcgacggtaaggcggttaag

SEQ ID NO: 321011 - DNA, 607 bp, Homo sapiens
  misc_feature: GZ8MTXP01E0KR4.19.13.B02.1.454.CMB.2.raw
  modified_base (262)..(262): a, c, t, g, unknown or other
  misc_feature (262)..(262): n is a, c, g, or t
  modified_base (309)..(309): a, c, t, g, unknown or other
  misc_feature (309)..(309): n is a, c, g, or t
  modified_base (352)..(352): a, c, t, g, unknown or other
  misc_feature (352)..(352): n is a, c, g, or t
  modified_base (523)..(523): a, c, t, g, unknown or other
  misc_feature (523)..(523): n is a, c, g, or t
  modified_base (562)..(562): a, c, t, g, unknown or other
  misc_feature (562)..(562): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggcggagtcgtgggggagcgtggtccagccgtgggagtcctgagctctcctgtgcagcctntggatcaccttcagtagctagtggctatcgctacgtcgggggtcccnccaggccctacggagggccgaagggggcttagggaggtggggnggtaccaaggttatatcataataggtaatagggaaacttaaataaactactaatcggactagtaccgtacgtagggaacgggacctattaccgactacgtctaccaagacgtaaactaacttaccgaaagaacgaccgtacgtagtactactagaaaccaaagtcgaaacncgtccgtaaggaagagtccgaggaacggaacgcgggttnttagttcgtagttaacgtggtaggcggtaacgggttaaggtaacg

SEQ ID NO: 321012 - DNA, 711 bp, Homo sapiens
  misc_feature: GZ8MTXP01EQKPD.19.13.B02.1.454.CMB.2.raw
  modified_base (257)..(257): a, c, t, g, unknown or other
  misc_feature (257)..(257): n is a, c, g, or t
  modified_base (264)..(264): a, c, t, g, unknown or other
  misc_feature (264)..(264): n is a, c, g, or t
  modified_base (275)..(275): a, c, t, g, unknown or other
  misc_feature (275)..(275): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtggagtcgtgggggagcgtggtccagccgtgggacgtcctgagctctcctgtncagcctntggatcacttnagtagctagtggctagtcgcctacgtcgggggtccccgccgagggtcctaccggagggacggaagggggtctaggggaggtgggggtgacctaaggttatatctaagtaagtgaagttagggtaaaattaaataaactactagcgactaacgtaccgttacggtacgggaacgggtcctaactttacccaacctactaccctacccgaagtaaccgtaaactaaaccgttaacccggaaaacggtaaacccgtaaccggttaccttagttaaccttaccgttaaggaaacctaaaacgttacgaaaaccgacggtcccggtaaaggacggttaaacggtcgttaacgggaaacgggtaaccgacgggttcgttagggttaacgtttaagttaaccggttgggtacgggaccggggtaagggttaaccgggttaaag

SEQ ID NO: 321013 - DNA, 550 bp, Homo sapiens
  misc_feature: GZ8MTXP01CW3SV.19.13.B02.1.454.CMB.2.raw
  modified_base (264)..(264): a, c, t, g, unknown or other
  misc_feature (264)..(264): n is a, c, g, or t
  modified_base (268)..(268): a, c, t, g, unknown or other
  misc_feature (268)..(268): n is a, c, g, or t
  modified_base (270)..(270): a, c, t, g, unknown or other
  misc_feature (270)..(270): n is a, c, g, or t
  modified_base (274)..(274): a, c, t, g, unknown or other
  misc_feature (274)..(274): n is a, c, g, or t
  modified_base (276)..(278): a, c, t, g, unknown or other
  misc_feature (276)..(278): n is a, c, g, or t
  modified_base (280)..(282): a, c, t, g, unknown or other
  misc_feature (280)..(282): n is a, c, g, or t
  modified_base (284)..(284): a, c, t, g, unknown or other
  misc_feature (284)..(284): n is a, c, g, or t
  modified_base (293)..(293): a, c, t, g, unknown or other
  misc_feature (293)..(293): n is a, c, g, or t
  modified_base (296)..(296): a, c, t, g, unknown or other
  misc_feature (296)..(296): n is a, c, g, or t
  modified_base (299)..(299): a, c, t, g, unknown or other
  misc_feature (299)..(299): n is a, c, g, or t
  modified_base (301)..(301): a, c, t, g, unknown or other
  misc_feature (301)..(301): n is a, c, g, or t
  modified_base (306)..(306): a, c, t, g, unknown or other
  misc_feature (306)..(306): n is a, c, g, or t
  modified_base (308)..(308): a, c, t, g, unknown or other
  misc_feature (308)..(308): n is a, c, g, or t
  modified_base (311)..(311): a, c, t, g, unknown or other
  misc_feature (311)..(311): n is a, c, g, or t
  modified_base (317)..(317): a, c, t, g, unknown or other
  misc_feature (317)..(317): n is a, c, g, or t
  modified_base (328)..(328): a, c, t, g, unknown or other
  misc_feature (328)..(328): n is a, c, g, or t
  modified_base (336)..(336): a, c, t, g, unknown or other
  misc_feature (336)..(336): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctggggggagcgtggtccagcctgggaggtccctgagctctcctgtgcaagctcnggtncnctcntnnngnnncncgtcgcgcngcncgngngaggngnggnggtggngcgagtatatnataatagngtagtaaagtaaataaataatatagacacgacgtacgtaggacggacgtactacactactcacgagaacgaactaactaacgaaacgaacgacgacgtacgtactacgtacgaacaaacgtaacgaacgacgacgtaacgagagacgacggacggacgacggttcgttagtaagttacgttaacgtggtacggacggtaacggttaacggtaag

SEQ ID NO: 321014 - DNA, 666 bp, Homo sapiens
  misc_feature: GZ8MTXP01E25ZR.19.13.B02.1.454.CMB.2.raw
  modified_base (279)..(279): a, c, t, g, unknown or other
  misc_feature (279)..(279): n is a, c, g, or t
  modified_base (308)..(308): a, c, t, g, unknown or other
  misc_feature (308)..(308): n is a, c, g, or t
  modified_base (342)..(342): a, c, t, g, unknown or other
  misc_feature (342)..(342): n is a, c, g, or t
  modified_base (353)..(353): a, c, t, g, unknown or other
  misc_feature (353)..(353): n is a, c, g, or t
  modified_base (640)..(640): a, c, t, g, unknown or other
  misc_feature (640)..(640): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagcgtggtggagtcgtgggggagcgtggtccagccgtgggagtccctgagactctcctgtgcagcctcgtggactcaccttnagtagctagtggcatcgcacgtgggcccncgaggcctcgaggcgagggggctgggagtggggngcctagtttanagtcagttaacgtagaagttaagggaaaatttaaattaaaaataccgttaagtcggaaaccctaacggtaacgtttaccccggtaaagggtaaacggggtaccctaacggttttacccgaaaccctaacgtttcccgtaacccgaaacgtaacgtaaaactaaaccgtttaaccccgaaaaggtaaacccacggtactaggtaactacgtagaaactaaagtacgaacacggcctaaggacgaggcgttagggaacgacgaccggttgttagttaagtactttcggngtcggacggtaagggttaaccgtaag

SEQ ID NO: 321015 - DNA, 580 bp, Homo sapiens
  misc_feature: GZ8MTXP01B026B.19.13.B02.1.454.CMB.2.raw
  modified_base (306)..(306): a, c, t, g, unknown or other
  misc_feature (306)..(306): n is a, c, g, or t
  modified_base (343)..(343): a, c, t, g, unknown or other
  misc_feature (343)..(343): n is a, c, g, or t
  modified_base (354)..(354): a, c, t, g, unknown or other
  misc_feature (354)..(354): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagcctggggagtccctgagactctcctgtgcagcctcgtggatcaccttcagtagctatggcatgcacgtggggtccncgaggcctccgagggcaagggggctagggagtggggngcctaggttanagtcatatagaataggaaagtaaataaatactagtcgactagactccgtaggaacgggccattacgacctatctaccaagacgaaactaacttacccgaaaagaaccgacgtacctaggtaactcgtagaacaaagtgaaacacgcctaaggagacggtcttaggaacggtacgaacggttcttaggtaagtacttaacgtggtcgacgggtaacggttcggtaag

SEQ ID NO: 321016 - DNA, 610 bp, Homo sapiens
  misc_feature: GZ8MTXP01BYAJ8.19.13.B02.1.454.CMB.2.raw
  modified_base (262)..(262): a, c, t, g, unknown or other
  misc_feature (262)..(262): n is a, c, g, or t
  modified_base (267)..(267): a, c, t, g, unknown or other
  misc_feature (267)..(267): n is a, c, g, or t
  modified_base (278)..(278): a, c, t, g, unknown or other
  misc_feature (278)..(278): n is a, c, g, or t
  modified_base (283)..(283): a, c, t, g, unknown or other
  misc_feature (283)..(283): n is a, c, g, or t
  modified_base (307)..(307): a, c, t, g, unknown or other
  misc_feature (307)..(307): n is a, c, g, or t
  modified_base (362)..(362): a, c, t, g, unknown or other
  misc_feature (362)..(362): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccagccgtggggacgtccctgagctctcctgtgcngcctnggatcaccttnagtanctatggcatgcacgtggggtcccnccaggcctccgagggcgaaggggctgggagtggggtgcctaggttatatcataangaagtagggaaattaaataaatactatgacagtactaccggtaggacggccgtattaccacctatcctaccagtaacgaactaaacttaccgaaaacggtaaccaacgtaccgttaggtaaactccgaagaacctaaagtagaaccaagcccgtaagaacgaggtccgttagggaacggaccgttaaccggttcgttacggttaaggttaccttaaggtcggtaggaccggtaagggttaacgttaag

SEQ ID NO: 321017 - DNA, 588 bp, Homo sapiens
  misc_feature: GZ8MTXP01AWJN8.19.13.B02.1.454.CMB.2.raw
  modified_base (303)..(303): a, c, t, g, unknown or other
  misc_feature (303)..(303): n is a, c, g, or t
  modified_base (542)..(542): a, c, t, g, unknown or other
  misc_feature (542)..(542): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggacgtccctgagctctctgtgcagcctctggactcacttcagtagctatggcatgcacgtcgggtccnccaggctccgagggccgaagggggctgggaggtcggggtggtccgagtttatatcgaataagtgtaatagggtaaataaattaaatactatgacagtactccggtaggaacgggcctaattaccacctatccaccagaacaactaacttaccgaaacgaacgaacgtctacgtaactctaggaaccaaagtcgaaacacgtccgtaaggaacgagccgaaggaacggaacaccgggttnttaggttaagtagtaacggtggtacggacggtaacgggttcgtaag

SEQ ID NO: 321018 - DNA, 790 bp, Homo sapiens
  misc_feature: GZ8MTXP01CSR65.19.13.B02.1.454.CMB.2.raw
  modified_base (328)..(328): a, c, t, g, unknown or other
  misc_feature (328)..(328): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagcgtggtggagtcgtgggggagcgtggtccaggtccgtggggacgtccctggacgtacctctccgtgtcgcacgtcctgtggtactccaccttcagtagctatcggcagtcgccacgttcggggcccnccgagggtcctacccggagggtacggaacggggggtctagggggacggttgggggtcggaccttaaggtttatagtacaagttaaagtaggtaaggttaagggtaaaaattaaattaaaacgtacgtaagtacggactaaacgggtaccgtaccgggtaaggggaaccgggtacccgtaacttaaccgtaacccgtacttaccccgtaacccgtaaggtaaaccgtaaaccgttaaaaccgtttaaccccggggaaaaacggttaaaccccgtaaccggttacccgtttaaggttaaccttaccgtaaacgtaaaccctaaaaggttacccgaaacgtacggtacccgttaaggaacggttacggtcggttaacgggtaacggacgttacgggttcgttacgggtttcgttaacgtttaacggtacgggtcggttacgggtaacgggttaacccggttaagg

SEQ ID NO: 321019 - DNA, 598 bp, Homo sapiens
  misc_feature: GZ8MTXP01C0MYI.19.13.B02.1.454.CMB.2.raw
  modified_base (280)..(280): a, c, t, g, unknown or other
  misc_feature (280)..(280): n is a, c, g, or t
  modified_base (309)..(309): a, c, t, g, unknown or other
  misc_feature (309)..(309): n is a, c, g, or t
  modified_base (344)..(344): a, c, t, g, unknown or other
  misc_feature (344)..(344): n is a, c, g, or t
  modified_base (354)..(354): a, c, t, g, unknown or other
  misc_feature (354)..(354): n is a, c, g, or t
  modified_base (382)..(382): a, c, t, g, unknown or other
  misc_feature (382)..(382): n is a, c, g, or t
  modified_base (387)..(387): a, c, t, g, unknown or other
  misc_feature (387)..(387): n is a, c, g, or t
  modified_base (549)..(549): a, c, t, g, unknown or other
  misc_feature (549)..(549): n is a, c, g, or t
tcagtactctcgtgcacgaccggtgctcgatttagtctagcgacttccgcgggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagcgtggtggagtcgtgggggagcgtggtccagccgtgggagtcctgacgctctctgtgcagcctcgtggactcaccttnagtagctatcggcatgcacgtgggtcccncgaggcctccgaggcgaagggggctgggagtgggngcctaggttnatcataatagaataggaaataaataaanactangacagtacctcggtaggaacggccgtattaccgacctagtcctaccgaagacgtaaaccaaacttaccgaaacgtaaaccgtacacgtttacgtacttaccgaagtaaccaaaagtcgaaacacgccgtaaggacgacgtcgaagggaacgcgaaccggttnttaggttaacgtaattcggtggtacggacgggtaagggttccggttaag

SEQ ID NO: 321020 - DNA, 660 bp, Homo sapiens
  misc_feature: GZ8MTXP01CG1M1.19.13.B02.1.454.CMB.2.raw
  modified_base (551)..(551): a, c, t, g, unknown or other
  misc_feature (551)..(551): n is a, c, g, or t
  modified_base (588)..(588): a, c, t, g, unknown or other
  misc_feature (588)..(588): n is a, c, g, or t
  modified_base (622)..(622): a, c, t, g, unknown or other
  misc_feature (622)..(622): n is a, c, g, or t
  modified_base (654)..(654): a, c, t, g, unknown or other
  misc_feature (654)..(654): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagcgtggtggaggtcggtgggggagcggttggtccaggccgtggggacgtccctgacgctctcctgtgcagcctctggactcaccttcagtagctagtggcatgccacgtcggggtccaccgaggtcctacggagggaccggaagggggctagggggaggtgggggtagacccgttaaggtttatagttagaaattaagtaggtaagtaaaggggtaaaacttaaaagttaaaatacgtagtaggacctaaacgggtaccgttacccgggtaagggaaccggaccccgttaattaccgaaacccctataccccgtaccgaagaaactaaccaaattaccggaaacggtaaacnccgtacttagtacttcgacgaaataaagtacgaaacncgcgtaagaagcgacggagacggacttcgggttnttagtaacgtagttcgtggcgttacgggcggngttaag

SEQ ID NO: 321021 - DNA, 585 bp, Homo sapiens
  misc_feature: GZ8MTXP01AHXN3.19.13.B02.1.454.CMB.2.raw
  modified_base (311)..(311): a, c, t, g, unknown or other
  misc_feature (311)..(311): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagcgtggtggagtcgtgggggagcgtggtccagccgtgggacgtccctgacgactctcctgtgcagcctctggatcaccttcagtagctatggcatgcacgtcggggtcccnccgaggcctccgagggcgaagggggctagggaggtggggtggacctaggttatatcataatgaatagggtaaagttaaataaatactatcgacacgactcggtagaacgggtcccgtattaccaaccgtatcctaccgaagaacgaactaactaccgaaacgaaccacgtactagtactctagaacaaagtacgaaacacgacctgaagagcgagggaacgacgacggttcttggttaacgttagttaacgtggtggacggtaaggcggttaag

SEQ ID NO: 321022 - DNA, 793 bp, Homo sapiens
  misc_feature: GZ8MTXP01CJHI4.19.13.B02.1.454.CMB.2.raw
  modified_base (198)..(198): a, c, t, g, unknown or other
  misc_feature (198)..(198): n is a, c, g, or t
  modified_base (259)..(259): a, c, t, g, unknown or other
  misc_feature (259)..(259): n is a, c, g, or t
  modified_base (264)..(264): a, c, t, g, unknown or other
  misc_feature (264)..(264): n is a, c, g, or t
  modified_base (307)..(307): a, c, t, g, unknown or other
  misc_feature (307)..(307): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtncagctggtggagtcgtgggggagcgtggtccagccgtgggacgtcctgagctctctgtgcngcctntggtatcacttcagtcgctagtggcatcgcacgtcgggtcccnccaggcctaccgagggacgaagggggtctgggacggtgggtcggcctaggtttactatctaagttaagttacggaagtaagggtaaaagtaaattaaaatacgtaatacggaccgtaacgtaccgtacccggttaagggaaaccggggtcccttaatttaccccgaaaccctaacgtttaccccgaaccgaaacggtaaaccgtaaaccgtaaaaccgtttaaccccggaaaaacggttaaaaccccgtaccgggttaacctttaacggttaaaccgttaccgttaacggtaaaacctaaaacgttaccggtaaaaccgaacgggtaccccggttaagggaaacggttaacccgggtacggttaaacgggtaaaccgggggaaccgttaaccccgggggttcgttttaaggggtttaacggtttaacgttttaaccgggtggggtttacgggacccggggtaaggggttaacccgggtttaacggg

SEQ ID NO: 321023 - DNA, 546 bp, Homo sapiens
  misc_feature: GZ8MTXP01C4VZ4.19.13.B02.1.454.CMB.2.raw
  modified_base (266)..(266): a, c, t, g, unknown or other
  misc_feature (266)..(266): n is a, c, g, or t
  modified_base (278)..(278): a, c, t, g, unknown or other
  misc_feature (278)..(278): n is a, c, g, or t
  modified_base (306)..(306): a, c, t, g, unknown or other
  misc_feature (306)..(306): n is a, c, g, or t
  modified_base (480)..(480): a, c, t, g, unknown or other
  misc_feature (480)..(480): n is a, c, g, or t
  modified_base (540)..(540): a, c, t, g, unknown or other
  misc_feature (540)..(540): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtggagtcgtgggggaggcgtggtccagcctggggagtccctgagactctcctgtgcagcctntggatcaccttnagtagctatggcatgcacgtgggtcccnccaggctccgagggcgaagggggctgggagtgggtcgccagttatatcaataatgaatagggaaataaataaatcatgacagacgtaccgtaggaacgggcctaattacaacctatccaccagaagaaacaattaccgaaagaaaccacgctagtaactctagaacaaagtaanaacacgacaagagagacgagaggacgacgcgttagttaagttagttaagtgtggagtggnggtaag

SEQ ID NO: 321024 - DNA, 546 bp, Homo sapiens
  misc_feature: GZ8MTXP01DJ8YD.19.13.B02.1.454.CMB.2.raw
  modified_base (266)..(266): a, c, t, g, unknown or other
  misc_feature (266)..(266): n is a, c, g, or t
  modified_base (305)..(305): a, c, t, g, unknown or other
  misc_feature (305)..(305): n is a, c, g, or t
  modified_base (529)..(529): a, c, t, g, unknown or other
  misc_feature (529)..(529): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctggggttttcctcgttgctctttttaagaggtgtccagtgtcaggtgcagctggtggagtctgggggaggcgtggtccagcctgggaggtccctgagactctcctgtgcagcctntggatcaccttcagtagctatggcatgcactggggtccncaggctcgaggcgaagggggctgggagtggggtcgtccaggttatatcaataatgaatgggaaagtaaattaaagtactatgacagactcgtggaaggccgattcacctatctcagacgaacaacttaccgaaagaaccacgactgtaatcgtcgaacaaagtgaaacacgcctaagaacgagcgttaggaggaccacggttcttggtaacttattaacgtggngacggcgggttcgtaag

SEQ ID NO: 321025 - DNA, 629 bp, Homo sapiens
  misc_feature: GZ8MTXP01B0CBE.19.13.B02.1.454.CMB.2.raw
  modified_base (281)..(281): a, c, t, g, unknown or other
  misc_feature (281)..(281): n is a, c, g, or t
  modified_base (286)..(286): a, c, t, g, unknown or other
  misc_feature (286)..(286): n is a, c, g, or t
  modified_base (290)..(290): a, c, t, g, unknown or other
  misc_feature (290)..(290): n is a, c, g, or t
  modified_base (356)..(356): a, c, t, g, unknown or other
  misc_feature (356)..(356): n is a, c, g, or t
  modified_base (378)..(378): a, c, t, g, unknown or other
  misc_feature (378)..(378): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcacatggagtttgggctgagcttgggttttcctcgttgcttcttttaagaggtgtccagtgtcaggtgcagcgtggtggagtcgtgggggagcgtggtccaggccgtgggacgtcctgacgactctcctgtgcagcctctggactcaccttnagtanctanggcatcgacctacgtgggtcccgcctagggcctacccgagggccgaagggggctagggaggtgggngacctaggttacatcataacgngaagtagaaaagttaaataaaacgtcttagacgactagaccgttaccggtaggaacgggtccgtaattaccgaacctattccaccgaaagtactaaaccgtaacttaaccggaaaagaccgtactacgttataaactcctaaggaaccaaaagtcgaaaacctcggaccgtaaggagacggtcgttaggaacggtcttacgggttcttagttaacgtagttaacgtggacgagggtaacgttccggttaag

SEQ ID NO: 321026 - DNA, 549 bp, Homo sapiens
  misc_feature: GZ8MTXP01D96NP.19.13.B02.1.454.CMB.2.raw
  modified_base (306)..(306): a, c, t, g, unknown or other
  misc_feature (306)..(306): n is a, c, g, or t
  modified_base (348)..(348): a, c, t, g, unknown or other
  misc_feature (348)..(348): n is a, c, g, or t
  modified_base (357)..(357): a, c, t, g, unknown or other
  misc_feature (357)..(357): n is a, c, g, or t
  modified_base (419)..(419): a, c, t, g, unknown or other
  misc_feature (419)..(419): n is a, c, g, or t
  modified_base (474)..(474): a, c, t, g, unknown or other
  misc_feature (474)..(474): n is a, c, g, or t
tcagtactctcgtgcacgaccggtgctcgattttagtctagcgacttccgcgggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtggggggagcgtggtccagcctggggagtccctgagactctcctgtgcagcctctggatcaccttcagtagctatggcatgcacgtgggtccncaggctcgaggcaagggggctgggagtggggtgcctagttanatcaataanagaagtagggaaattaaactaaatactatgacagactcggagaaggccatcacatcacaganacaatacaaagaacacgctagtatctagaacaaatcgaaacaggcctaaggaagngtacgttagaacggaaccgaacgggttcttaggtaagttaatttaacgtggtggaccggaagggttaacggtaag

SEQ ID NO: 321027 - DNA, 608 bp, Homo sapiens
  misc_feature: GZ8MTXP02I3LEM.19.13.B02.1.454.CMB.2.raw
  modified_base (205)..(205): a, c, t, g, unknown or other
  misc_feature (205)..(205): n is a, c, g, or t
  modified_base (251)..(251): a, c, t, g, unknown or other
  misc_feature (251)..(251): n is a, c, g, or t
  modified_base (283)..(283): a, c, t, g, unknown or other
  misc_feature (283)..(283): n is a, c, g, or t
tcagtactctcgtgcacgaccggtgctcgatttagtctagcgacttccgcgggagctctgggagaggagcccagcactagaagtcggcggtgttccattcggtgatcagcactgaacacagaggactcaccatggagtttggctgagccgtggtttcgcgtaggctctttaagaggtgtccagtgtcaggtgcagctggtgagtntgggaggcgtggtccagcctggaggtcccgtgagctctcctgtgcncgctcgtgtatctacctctagtagctagtgcntgcgtacgtcggtccgccgacggccgtccgacggacggacgggtcggtggtaggtgggtggtcgtagttagtagtactatagtagtagtagtaaagtaaagtaaagtaatagtagacgacgtacgtacgtacgaacggtaccgtacgtactacctactacgtaccgacgaacgaactaactaaccgaaacgaacgacgtacgtacgtactacgtacgtaacgtaacgtaacgtaacgacgtacgtacgtacgtacgtacgtacggaacggacgtacgtacgtacgtaagtacgttacgtacgtacggtacggtacggtacgtacg

SEQ ID NO: 321028 - DNA, 519 bp, Homo sapiens
  misc_feature: GZ8MTXP02FUB4W.19.13.B02.1.454.CMB.2.raw
  modified_base (303)..(303): a, c, t, g, unknown or other
  misc_feature (303)..(303): n is a, c, g, or t
  modified_base (348)..(348): a, c, t, g, unknown or other
  misc_feature (348)..(348): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggagtccctgagactctcctgtgcagcctctggattcaccttcagtagctatggcatgcacgtggggtccnccaggcctccgagggcaaggggctgggagtggggtgcctagttanatcatatgatgggaaataataaatactatgcagactccgtagagggccatcaccatctccagagacaataccaagaacacgctagtactctgactaaatgaactacgctagagagctaggacggacacggcttgtaagttacttacgtggtcgacggacgggtacggtaag

SEQ ID NO: 321029 - DNA, 499 bp, Homo sapiens
  misc_feature: GZ8MTXP02JXZYG.19.13.B02.1.454.CMB.2.raw
  modified_base (302)..(302): a, c, t, g, unknown or other
  misc_feature (302)..(302): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggaggtccctgagactctcctgtgcagcctctggattcaccttcagtagctatggcatgcactgggtccnccaggctccagggcaaggggctgggagtggggtggccagttatatcatatgatgggaaagtaataaatactatgcagactccgtgaaggccatcaccatctcagagacaattaccaagaacacgctagtatcgtagacaaatgaacagcctagagagctaggacgacgacgctgtgtatacgtgtgcgaggtcgtag

SEQ ID NO: 321030 - DNA, 508 bp, Homo sapiens
  misc_feature: GZ8MTXP02HFQ62.19.13.B02.1.454.CMB.2.raw
  modified_base (304)..(304): a, c, t, g, unknown or other
  misc_feature (304)..(304): n is a, c, g, or t
  modified_base (346)..(346): a, c, t, g, unknown or other
  misc_feature (346)..(346): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctggggagtccctgagactctcctgtgcagcctctggattcaccttcagtagctatggcatgcacgtgggtccncaggctccgagggcaaggggctgggagtggggtgccagttanatcatatgataggaaataaataaatactatgacagactccgtagagggcgatcacatctacagagacaattaccaagacacgctagtactctagacaaatgaacagcctagacgagctaggacggacgacggctagtgtattacgtgtgacggaggacgtag

SEQ ID NO: 321031 - DNA, 548 bp, Homo sapiens
  misc_feature: GZ8MTXP02HY1GM.19.13.B02.1.454.CMB.2.raw
  modified_base (306)..(306): a, c, t, g, unknown or other
  misc_feature (306)..(306): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaggtccctgagactctcctgtgcagcctctggattcaccttcagtagctatggcatgcacgtgggtcccnccaggcctcccgagggcgaaggggctgggagtggggtgccagttatagtcatatgatgggaaataaataaatactatgacagactccgtagaagggccattacaccatctaccagacgaacaacttaccaaagaacacgactagtatctagacaaatagaaacacgacctagagagacgtaggacggacgacggcttaggtgttaacgtttaacgtggtacggacggtagggtacggttaag

SEQ ID NO: 321032 - DNA, 690 bp, Homo sapiens
  misc_feature: GZ8MTXP02JTQ9E.19.13.B02.1.454.CMB.2.raw
  modified_base (261)..(261): a, c, t, g, unknown or other
  misc_feature (261)..(261): n is a, c, g, or t
  modified_base (275)..(275): a, c, t, g, unknown or other
  misc_feature (275)..(275): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagcgtggtttcgcgtaggctctttaagaggtgtccagtgtcaggtgcagctggtggagtcgtgggggagcgtggtccagcctgggaggtccctgagctctcctgtgcagcctntggattcacccttnagtacgctagtggactagtcgccgtacggtcggggtcccgccgacggtccgtaccggagggacggaaggggtcgtaggggagggtggggtcggtaccgtaagttatacgtacgtaagttagtaggtagttaagggtaaaagttaaaattaaacgtattaagtacgtaacgaacgtaccgtaccggtaggaacgggtaccgtaacgttacccgacctacgtaccgtaccgaagtaacgaaacgtaaacgttaaaccgtaaacgaaaccgtaaccgtacgttacgttacgttacgtacgtaacgtaaacgtaacgtaacgaacgtacgtacggagacggacgtacggaacggaccgtaccggtacgtacgttaacgttacgttacgttacggtacggtacggtacgggtacggtacg

SEQ ID NO: 321033 - DNA, 505 bp, Homo sapiens
  misc_feature: GZ8MTXP02JA9DO.19.13.B02.1.454.CMB.2.raw
  modified_base (303)..(303): a, c, t, g, unknown or other
  misc_feature (303)..(303): n is a, c, g, or t
  modified_base (343)..(343): a, c, t, g, unknown or other
  misc_feature (343)..(343): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggagtccctgagactctcctgtgcagcctctggattcaccttcagtagctatggcatgcactggggtccnccaggctccaggcaaggggctggagtgggtggccagttanatcatatgatggaaagtaaataaatactatgacagactccgtgaagggccgatcaccatctccagagacaattaccaagaacacgctagtatctgacaaatgaaacagacctagagagcgtagacggacgacggctgtgtattacgtgtagcgaggcgtaag

SEQ ID NO: 321034 - DNA, 539 bp, Homo sapiens
  misc_feature: GZ8MTXP02HDM9K.19.13.B02.1.454.CMB.2.raw
  modified_base (307)..(307): a, c, t, g, unknown or other
  misc_feature (307)..(307): n is a, c, g, or t
  modified_base (357)..(357): a, c, t, g, unknown or other
  misc_feature (357)..(357): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaggtccctgagactctcctgtgcagcctctggattcaccttcagtagctatggcatgcacgtggggtcccnccaggctccgagggcgaaggggctgggagtggggtgcagttatatcatangatggaaagtaaataaatactatgacagacgtaccgtagaacgggccgtagttacaaccattacctaccagagaactaaacttaccaacgaacacgacttagtactactagacaaatagaacacgcctagagagcgtagacggacgacgctagtgtattacgtgtcgacggaggacggtaag

SEQ ID NO: 321035 - DNA, 651 bp, Homo sapiens
  misc_feature: GZ8MTXP02H5SPR.19.13.B02.1.454.CMB.2.raw
  modified_base (306)..(306): a, c, t, g, unknown or other
  misc_feature (306)..(306): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggaggtccctgagactctcctgtgcagcctctggattcaccttcagtagctatggcatgcacgtgggtcccncaggcctccgagggcgaaggggctggggaggtggggtgcctagtttatatcatatgatagggtaaaataaattaaaatactaagtgacaacgtactccggtaggaacgggtaccaatttaccgaacctatacccgtaccgagaacgaacctaaacgtttacccgaaaagtaacccacggtacttacggttaactccgttacggaaccaaaagttaccgaaactacggacccgttaggaaaaccggtggaccgtaaagggaacgggtaaccgaacccgggtcgttacgggttaaggttaactttaaccggtcgggttaggaccgggtaagggttaccgggttaaag

SEQ ID NO: 321036 - DNA, 620 bp, Homo sapiens
  misc_feature: GZ8MTXP02INFJ0.19.13.B02.1.454.CMB.2.raw
  modified_base (305)..(305): a, c, t, g, unknown or other
  misc_feature (305)..(305): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggaggtccctgagactctcctgtgcagcctctggattcaccttcagtagctatggcatgcacgtgggtccnccaggctccgagggcaaggggctggggagtggggtgcctagttatatcatagtgagtaggaaaagttaaactaaaattactaatcggacagtacgtccgtagaaacggggccaagtttcaacctaatccctaccgagaacgaacctaaactttaccgaaaacggtaaacaccggacttagtaactccgttagaacaaaattacgaaacacgaccctagaacggagaccgtaggaaacgggaccgaaaccgggtcgttaggttaacggttaatttaaccgttcggttaggaccggtaacggggttacggttaaagg

SEQ ID NO: 321037 - DNA, 587 bp, Homo sapiens
  misc_feature: GZ8MTXP02H291A.19.13.B02.1.454.CMB.2.raw
  modified_base (264)..(264): a, c, t, g, unknown or other
  misc_feature (264)..(264): n is a, c, g, or t
  modified_base (307)..(307): a, c, t, g, unknown or other
  misc_feature (307)..(307): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggaggtccctgagactctcctgtgcagcctntggattcaccttcagtagctatggcatcgcacgtggggtcccnccaggctccgagggcgaaggggctgggaggtggggtgacctagttatatcaatagtgagtaggaaagtaaataaatactatgacagactccggtaggaacgggcccgtaattaccaaccatcctacccagaacgaaactaaacttacccaaagtaacctacgttagtaatacctagaactaaaagtacgaaaaccagacctaggaacgaggtctaggacggaacgtacgggtcttagtacgttaattacgtaggtcggacggaagggtcgttaacgacgg

SEQ ID NO: 321038 - DNA, 522 bp, Homo sapiens
  misc_feature: GZ8MTXP02HQEOM.19.13.B02.1.454.CMB.2.raw
  modified_base (349)..(349): a, c, t, g, unknown or other
  misc_feature (349)..(349): n is a, c, g, or t
  modified_base (356)..(356): a, c, t, g, unknown or other
  misc_feature (356)..(356): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggagtccctgagactctcctgtgcagcctctggattcaccttcagtagctatggcatgcacgtggggtcccgccaggcctccgagggcgaaggggctgggagtggggtgccagttanatcatangatgggaaataaataaatactatgcagactccgtagaacgggaccgagttacaccattcaccagagaacaaattaccaaagaacacgactagtatctagacaaatacgaacagcctagagagcagacggacacggctgtaagtatacgtgtacgcgaggtacgtag

SEQ ID NO: 321039 - DNA, 688 bp, Homo sapiens
  misc_feature: GZ8MTXP02JXLA7.19.13.B02.1.454.CMB.2.raw
  modified_base (308)..(308): a, c, t, g, unknown or other
  misc_feature (308)..(308): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgagctctcctgtgcagcctctggattccaccttcagtagctatggcagtcgcacgtggggtcccnccaggcctccgagggcgaaggggctgggagtggggtgcctagttatatcatagtgagtagggaaaacttaaataaatactaagtcgacgaacgtaccgtacccggtagggaaacggggtcccgtaatttacccgaaccctacttacccgtaccgaacgaacgtaaacctaaacgttacccgaaaacgtaaccgaaccggtaccgttaacgtaacttaccgttaacgaacctaaaagttaccggaaaaccgacgtacccgttaagggaaacggacggaccggttaaggaaaccggggtaaccgaccgggtaccgtttagggtaacggtttaacgttaaccggtgggttacggaccggggtaacggggtaccggtttaacgg

SEQ ID NO: 321040 - DNA, 554 bp, Homo sapiens
  misc_feature: GZ8MTXP02JIFWK.19.13.B02.1.454.CMB.2.raw
  modified_base (304)..(304): a, c, t, g, unknown or other
  misc_feature (304)..(304): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggaggtccctgagctctcctgtgcagcctctggattcaccttcagtagctatggcatgcacgtgggtccncaggctccgagggcgaaggggctgggagtggggtgcctagttatatcatatgagtagggaaataaataaatactatgacagactccggtaggaacgggcctattacacctatcctaccagagaacaacttaccaaagaaccacgactagtactctagacaaatacgaaacacgccgtaggacgaggacgtaggaacggaccgacggtcttaggtaagttattacgtggtacggacggtagggtacgtaag

SEQ ID NO: 321041 - DNA, 525 bp, Homo sapiens
  misc_feature: GZ8MTXP02JAC3T.19.13.B02.1.454.CMB.2.raw
  modified_base (305)..(305): a, c, t, g, unknown or other
  misc_feature (305)..(305): n is a, c, g, or t
  modified_base (350)..(350): a, c, t, g, unknown or other
  misc_feature (350)..(350): n is a, c, g, or t
  modified_base (357)..(357): a, c, t, g, unknown or other
  misc_feature (357)..(357): n is a, c, g, or t
  modified_base (505)..(505): a, c, t, g, unknown or other
  misc_feature (505)..(505): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagctctcctgtgcagcctctggattccaccttcagtagctatggcatgcacgtcggggtccnccaggcctccgagggcaaggggctgggaggtggggtgctagttanatcatangatggaaataactaaatctaatgacagactcgtagaacgggccattcaccatctaccagacgacaataccaaagacacgctagactctagacaaatcgaaacagcctagacgagacgtaggaacggacgacggatgtaagtattacgngtacgcggtaggtacgtaag

SEQ ID NO: 321042 - DNA, 535 bp, Homo sapiens
  misc_feature: GZ8MTXP02G6CD0.19.13.B02.1.454.CMB.2.raw
  modified_base (304)..(304): a, c, t, g, unknown or other
  misc_feature (304)..(304): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggaggtccctgagactctcctgtgcagcctctggattcaccttcagtagctatggcatgcacgtgggtcccnccaggctccgaggcgaaggggctgggagtggggtgccgtagttatagtcatagtgatagggaaagtaaataaatacgtatgacagactccgtagaacgggcctagttacaccatcctaccagacgaacaattaccaaagaacacgtactagtactctagacaaatgaaacagcctagagagacgtagacggacgacggctagtgttattacgtggtgacggtaggacgtag

SEQ ID NO: 321043 - DNA, 505 bp, Homo sapiens
  misc_feature: GZ8MTXP02I3JTW.19.13.B02.1.454.CMB.2.raw
  modified_base (303)..(303): a, c, t, g, unknown or other
  misc_feature (303)..(303): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggaggtccctgagactctcctgtgcagcctctggattcaccttcagtagctatggcatgcactgggtccnccaggctccgagggcgaggggctgggagtggggtgccagttatatcatatgatgggaaagtaaataaatactatgcagactccgtagaagggccattcaccatctcagagacaattccaagacacgctagtatctagacaaaatgaaacagcctagagagctagacgacacggctagtgtattacgtgtagcgaggcgtaag

SEQ ID NO: 321044 - DNA, 508 bp, Homo sapiens
  misc_feature: GZ8MTXP02JVJ8G.19.13.B02.1.454.CMB.2.raw
  modified_base (302)..(302): a, c, t, g, unknown or other
  misc_feature (302)..(302): n is a, c, g, or t
  modified_base (341)..(341): a, c, t, g, unknown or other
  misc_feature (341)..(341): n is a, c, g, or t
  modified_base (346)..(346): a, c, t, g, unknown or other
  misc_feature (346)..(346): n is a, c, g, or t
  modified_base (399)..(399): a, c, t, g, unknown or other
  misc_feature (399)..(399): n is a, c, g, or t
  modified_base (427)..(427): a, c, t, g, unknown or other
  misc_feature (427)..(427): n is a, c, g, or t
  modified_base (432)..(432): a, c, t, g, unknown or other
  misc_feature (432)..(432): n is a, c, g, or t
  modified_base (437)..(437): a, c, t, g, unknown or other
  misc_feature (437)..(437): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggaggtccctgagactctcctgtgcagcctctggattcaccttcagtagctatggcatgcactgggtccncaggctccaggcaaggggctgggagtgggtgccagttanatcanatgatgggaaattaagtaaatactatgcagactccgtgaaggccgattcacanctccagagacaatccaagacagctgtancgtanacaangaacagctagacgagcgtaggacggacgacggtctagtgttagttacgtggtcgacggacggtacggtacg

SEQ ID NO: 321045 - DNA, 536 bp, Homo sapiens
  misc_feature: GZ8MTXP02HF3YR.19.13.B02.1.454.CMB.2.raw
  modified_base (310)..(310): a, c, t, g, unknown or other
  misc_feature (310)..(310): n is a, c, g, or t
  modified_base (359)..(359): a, c, t, g, unknown or other
  misc_feature (359)..(359): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtggggaggtccctgagactctcctgtgcagcctctggactccaccttcagtagctatggcatgcacgtggggtcccncaggcctccgaggcaaggggctgggagtggggtgctagttatatcatangatagggaaataaataaatactatgcagactccgtagaacgggccgattcaccatcctaccagagaacaacttaccaaagaacacgactagtatctagacaaatagaacagacctagacgagcgtaggacgacgacggcttaggtaagttattacgtggtagcggaggtacggtaag

SEQ ID NO: 321046 - DNA, 524 bp, Homo sapiens
  misc_feature: GZ8MTXP02ISZHV.19.13.B02.1.454.CMB.2.raw
  modified_base (304)..(304): a, c, t, g, unknown or other
  misc_feature (304)..(304): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggaggtccctgagactctcctgtgcagcctctggattcaccttcagtagctatggcatgcacgtgggtccnccaggctccgaggcaaggggctgggagtgggtgcagttatatcatatgagtaggaaataataaatctatgcagactccgtagaacgggcgtaattcacctatcctaccgagacgacaaattaccaaagaacacgactagtatctagacaaatcgaaacagcctagagagcgtagaacgacgacggctggtaagtattacgtggtgacggaggtacgtaag

SEQ ID NO: 321047 - DNA, 501 bp, Homo sapiens
  misc_feature: GZ8MTXP02I9GNS.19.13.B02.1.454.CMB.2.raw
  modified_base (302)..(302): a, c, t, g, unknown or other
  misc_feature (302)..(302): n is a, c, g, or t
  modified_base (346)..(346): a, c, t, g, unknown or other
  misc_feature (346)..(346): n is a, c, g, or t
  modified_base (353)..(353): a, c, t, g, unknown or other
  misc_feature (353)..(353): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggagtccctgagactctcctgtgcagcctctggattcaccttcagtagctatggcatgcactggggtccnccaggcctccgagggcaaggggctgggagtggggtgccagttanatcatangatggaaagtaataaatactatgcagactcgtgaaggccatcaccatctcagagacaattccaagaacacgctagtatctagacaaatgaacagcctagagagctagacggacacggctagtgtagttactgtgacggaggcggtaag

SEQ ID NO: 321048 - DNA, 558 bp, Homo sapiens
  misc_feature: GZ8MTXP02F6E2P.19.13.B02.1.454.CMB.2.raw
  modified_base (263)..(263): a, c, t, g, unknown or other
  misc_feature (263)..(263): n is a, c, g, or t
  modified_base (305)..(305): a, c, t, g, unknown or other
  misc_feature (305)..(305): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcctntggattcaccttcagtagctatggcatgcacgtcgggtcccnccaggcctccgagggcgaagggggctggggagtggggtgcctagttatatcatatgatagggaaattaaataaaatactatgacagactccggtaggaacgggccgaattaccaccctatcctaccaagacgaaacaacttaccaaagaacacgtactagtaactctagactaaaatcgaaacacgacctaggagagcgtaggacggacgacggtctagtaagttattacgtggtcggacggaggacggtaag

SEQ ID NO: 321049 - DNA, 606 bp, Homo sapiens
  misc_feature: GZ8MTXP02G6G5D.19.13.B02.1.454.CMB.2.raw
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtagctatggcatgcacgtgggtccgccagggcctccgagggcgaaggggctgggaggtggggtggcctagttatatcatatgatagggtaaagtaaacttaaaataactagtgacaagtacctaccggtaggaaacggggcctaacgtttccaaccctactaccgtacccagaacgaaacctaaacttaccgaaaacgtaaacgaccggtacctaggtacttacctagaaccaaaatacgaaacgacgacctagaagacgacaggaacggacgaacggggtcctagtaacggttaattacgtacggtgaccggacggtacggttaag

SEQ ID NO: 321050 - DNA, 515 bp, Homo sapiens
  misc_feature: GZ8MTXP02JK8DY.19.13.B02.1.454.CMB.2.raw
  modified_base (303)..(303): a, c, t, g, unknown or other
  misc_feature (303)..(303): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcctctggattcaccttcagtagctatggcatgcactggggtccnccaggctccgaggcaaggggctgggagtggggtgcctagttatatcatatgatgggaaagtaaataaatactatgacagactccgtagaagggccgattcaccatctccagagacattaccaagaacacgctagtactctagacaaatgaacagcctagagagctagacggacacggctgtaacgtattacgtggtagcggaggacggtaag

SEQ ID NO: 321051 - DNA, 508 bp, Homo sapiens
  misc_feature: GZ8MTXP02FYPQ0.19.13.B02.1.454.CMB.2.raw
  modified_base (304)..(304): a, c, t, g, unknown or other
  misc_feature (304)..(304): n is a, c, g, or t
  modified_base (352)..(352): a, c, t, g, unknown or other
  misc_feature (352)..(352): n is a, c, g, or t
  modified_base (416)..(416): a, c, t, g, unknown or other
  misc_feature (416)..(416): n is a, c, g, or t
  modified_base (425)..(425): a, c, t, g, unknown or other
  misc_feature (425)..(425): n is a, c, g, or t
  modified_base (454)..(454): a, c, t, g, unknown or other
  misc_feature (454)..(454): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcctctggattcaccttcagtagctatggcatgcacgtggggtccnccgaggcctccgagggcgaaggggctggggagtggggtgcctagttanatcatatgataggaaagtaaataaatctaatgacagactccgtagaacggcatcacatctcagnacaatcaanacacgactagtactcagacaaatgaaacngctagagagctagacgacgacggctagtgtactacgtggtgacgaggtcgtaag

SEQ ID NO: 321052 - DNA, 602 bp, Homo sapiens
  misc_feature: GZ8MTXP02JPY74.19.13.B02.1.454.CMB.2.raw
  modified_base (309)..(309): a, c, t, g, unknown or other
  misc_feature (309)..(309): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggacgtccctgagactctcctgtgcagcctcgtggacttcaccttcagtagctatggcatgctacgtcgggtcccncgaggcctcgagggcaaggggctgggagtgggtgctagttatagctatagtgagttaggaaacgttaataaagtactatggacacgtacgtaccgtaggaacggtccgtaacttacgaacctactacctacgaacgaacgtaaactaacttaccgaaacgtaaccaacgtacgtacgtacttaccgtagtaactaaatacgaaacgacggtacctaggagtagcgtaggacggacgtaccgtcggtagttaacggtacttacgttcggtagaccgggtacggtaggttaacgg

SEQ ID NO: 321053 - DNA, 690 bp, Homo sapiens
  misc_feature: GZ8MTXP02G6P9N.19.13.B02.1.454.CMB.2.raw
  modified_base (305)..(305): a, c, t, g, unknown or other
  misc_feature (305)..(305): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaggtccctgagactctcctgtgcagcctctggattcaccttcagtagctatggcatgcactggggtccnccaggcctccgagggcgaaggggctgggaggtggggtggcctagttatatcaatatgagtagggaaagttaaataaaatactaagtcgactaagacgttacccggtaggaaacgggggcccgtaagttaccgaaccctacgttacctacccgagtaacggaaacctaaactttacccgaaaacggtaaacccacgggtaccttacggtaaccttacgttacggaacctaaaagttaccggaaaaccaacggtaccccgttagggaaacggacggtaccggttaagggaacgggtaaccgaaaccggggtccgtttaacggttaaggtttaaacgtttaaccggtggttacgggaaccggggttaacggggaccgggtttaaacgg

SEQ ID NO: 321054 - DNA, 521 bp, Homo sapiens
  misc_feature: GZ8MTXP02GP1HA.19.13.B02.1.454.CMB.2.raw
  modified_base (308)..(308): a, c, t, g, unknown or other
  misc_feature (308)..(308): n is a, c, g, or t
  modified_base (350)..(350): a, c, t, g, unknown or other
  misc_feature (350)..(350): n is a, c, g, or t
  modified_base (490)..(490): a, c, t, g, unknown or other
  misc_feature (490)..(490): n is a, c, g, or t
  modified_base (506)..(506): a, c, t, g, unknown or other
  misc_feature (506)..(506): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagcgtggttttcctcgttgctcttttaagaggtgtccagtgtcaggtgcagctggtggagtcgtgggggaggcgtggtccagccgtggggaggtccctgagactctcctgtgcagcctctggattcaccttcagtagctatggcatgcacgtggggtccnccaggctccgaggcaaggggctgggagtggggtgccagttanatcatatgatgggaaagtaataaatactatgacagactccgtgaacgggccgattacaccatcctaccagacgaacaacttaccaagaacacgactgtatctgacaaatgaacagcctagagagctagacggacacggtntgtaagtactacgtgnggacggaggacgtag

SEQ ID NO: 321055 - DNA, 514 bp, Homo sapiens
  misc_feature: GZ8MTXP02JC32G.19.13.B02.1.454.CMB.2.raw
  modified_base (306)..(306): a, c, t, g, unknown or other
  misc_feature (306)..(306): n is a, c, g, or t
  modified_base (347)..(347): a, c, t, g, unknown or other
  misc_feature (347)..(347): n is a, c, g, or t
  modified_base (496)..(496): a, c, t, g, unknown or other
  misc_feature (496)..(496): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtagctatggcatgcacgtggggtcccnccaggctccgagggcaaggggctggagtgggtgccagttanatcatatgagtgggaaataaataaatactatgcagactccgtgaaggcgatcaccatctcagagacaattccaagacacgctagtatctagacaaatgaacagcctagagagctaggacggacgacggtctgtaagtacttacgtcggngtacggaggtacggtaag

SEQ ID NO: 321056 - DNA, 561 bp, Homo sapiens
  misc_feature: GZ8MTXP02GCFS6.19.13.B02.1.454.CMB.2.raw
  modified_base (306)..(306): a, c, t, g, unknown or other
  misc_feature (306)..(306): n is a, c, g, or t
  modified_base (353)..(353): a, c, t, g, unknown or other
  misc_feature (353)..(353): n is a, c, g, or t
  modified_base (360)..(360): a, c, t, g, unknown or other
  misc_feature (360)..(360): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggaggtccctgagactctcctgtgcagcctctggattcaccttcagtagctatggcatgcacgtggggtcccnccgaggcctccgagggcgaaggggctgggagtggggtgcctagttanatcatangatggaaataaataaatactatgcagactccgtagaacgggccattcacctatcctaccagacgaactaattaccaaagaaccacgtactagtaactcgtagactaaaagtcgaaacacgtacctaggaagacggcgtaaggacggacgaaccggtcttaggtaagttaacttacgtggtcggacggagggtacggttaag

SEQ ID NO: 321057 - DNA, 656 bp, Homo sapiens
  misc_feature: GZ8MTXP02JIO3E.19.13.B02.1.454.CMB.2.raw
  modified_base (306)..(306): a, c, t, g, unknown or other
  misc_feature (306)..(306): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagcgtgggttttcctcgttgctcttttaagaggtgtccagtgtcaggtgcagctggtggagtcgtgggggaggcgtggtccagccgtgggaggtccctgagactctcctgtgcagcctctggattcaccttcagtagctatggcatgcacgtcggccnccaggctccgagggcgaaggggctggggagtggggtgcctaggttatagtacatagtgagttagggaaaattaaataaaatacttagacgactaaacggtaccttacccggtagggaaaccggggtaccgtaacgtttaccaacccgtactaccgtacccgaaagaacgtaaacctaaactttaacccgaaaacgaaccgtaaccggtactaacgttactaccgttaacgaaacgtaaaactacgaaacgacgtaccgtaaggacgtaacgacgtagggaacggaccgtaccggtacgttaggtaacgttaacgttacggtacggtacggacggtacgggtacggtaacg

SEQ ID NO: 321058 - DNA, 548 bp, Homo sapiens
  misc_feature: GZ8MTXP02FWRIG.19.13.B02.1.454.CMB.2.raw
  modified_base (304)..(304): a, c, t, g, unknown or other
  misc_feature (304)..(304): n is a, c, g, or t
  modified_base (348)..(348): a, c, t, g, unknown or other
  misc_feature (348)..(348): n is a, c, g, or t
  modified_base (509)..(509): a, c, t, g, unknown or other
  misc_feature (509)..(509): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcctctggattcaccttcagtagctatggcatgcacgtgggtcccnccgaggcctccgagggcaaggggctgggagtgggtgctagttanagtcatatgatagggaaataaataaatctatgacagactccgtagaacgggccgtattacacctatcctccgaagacgaaactaacttaccaaagaaccacgactagtactctacgactaaatcgaaacacgacctagagagcgtaggacggacgacggtntagtaagttattacgtggtcggacggtaggtacggtaag

SEQ ID NO: 321059 - DNA, 542 bp, Homo sapiens
  misc_feature: GZ8MTXP02HNTPX.19.13.B02.1.454.CMB.2.raw
  modified_base (306)..(306): a, c, t, g, unknown or other
  misc_feature (306)..(306): n is a, c, g, or t
  modified_base (428)..(428): a, c, t, g, unknown or other
  misc_feature (428)..(428): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggaggtccctgagactctcctgtgcagcctctggattcaccttcagtagctatggcatgcacgtggggtcccnccaggcctccgagggcaaggggctgggagtggggtgcctagttatatcatatgagtagggaaagtaaataaaagtactatggacagtactccggtagaacgggccgtattcacatctcaganacaattaccaaagaacacgctagtatctagacaaatagaacagcctagacgagcgtaggaacggacgacgggtctggtaagtagttacgtcggtggacggtagggacggttaag

SEQ ID NO: 321060 - DNA, 538 bp, Homo sapiens
  misc_feature: GZ8MTXP02G4MVP.19.13.B02.1.454.CMB.2.raw
  modified_base (304)..(304): a, c, t, g, unknown or other
  misc_feature (304)..(304): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagcctgggagtccctgagctctcctgtgcagcctctggattccaccttcagtagctatggcatgcacgtgggtccnccgaggcctccgaggcgaaggggctgggaggtggggtgccgtagttatatcatatgatagggaaagtaaataaatactatgacaagactccgtaggaacgggccgattcaccatcctaccagagaacaaacttaccaaacgaacacgctagtactctagacaaatgaaacagacctagacgagctaggaacggaccacggctggtaagtacgtacgtgagtacgaggtcgtaag

SEQ ID NO: 321061 - DNA, 681 bp, Homo sapiens
  misc_feature: GZ8MTXP02HZQAT.19.13.B02.1.454.CMB.2.raw
  modified_base (196)..(196): a, c, t, g, unknown or other
  misc_feature (196)..(196): n is a, c, g, or t
  modified_base (318)..(318): a, c, t, g, unknown or other
  misc_feature (318)..(318): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtncagctggtggagtcgtgggggagcgtggtccagccgtgggaggtccctgagactctcctgtcgcagcctcgtggacttccaccttcaagtagctatggctatcgcctacgtcggggtccccncgacggcctcccgagggtccgaaagggggtcctaggggagggtggggtggacccgtaaggtttactagtacgaattagtagagttaggggaaaatttaaaacttaaagtaactatacgactaagtaccgtaccggtaggaaacgggtcccgtaattaccgaacctacttaccctaccaagaacgtaaacctaaacttaccaaaacgtaaccaacgtcttacgtataccgtagaaacgtaaagtacgaaaccgacgtacccgtaggaaaggtacgaccgtaagggaacggaaccgtacgggtaacgttggttaaggttaacgtttaaccgtgggtacggtaccgggtaaggggttaccggtaag

SEQ ID NO: 321062 - DNA, 579 bp, Homo sapiens
  misc_feature: GZ8MTXP02FU37V.19.13.B02.1.454.CMB.2.raw
  modified_base (304)..(304): a, c, t, g, unknown or other
  misc_feature (304)..(304): n is a, c, g, or t
  modified_base (350)..(350): a, c, t, g, unknown or other
  misc_feature (350)..(350): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctccctgtgcagcctctggattcaccttcagtagctatggcatgcacgtgggtccnccaggcctccgaggcgaaggggctggggagtggggtgcctagttanagtcatatgagtagggaaattaaataaatactaagtgaccaagtacctccggtaggaacgggtccgtaattccaccgtatccgtaccgaaagacgaaacctaaacttaccgaaacgtaacacgtacctagtactcgtagacaaatcgaacacgcctagagagccgtaggaacggacgacggcttaggtaacgtttattacgttggtacggacggtacgggtcggttaag

SEQ ID NO: 321063 - DNA, 580 bp, Homo sapiens
  misc_feature: GZ8MTXP02HM5NF.19.13.B02.1.454.CMB.2.raw
  modified_base (244)..(244): a, c, t, g, unknown or other
  misc_feature (244)..(244): n is a, c, g, or t
  modified_base (266)..(266): a, c, t, g, unknown or other
  misc_feature (266)..(266): n is a, c, g, or t
  modified_base (307)..(307): a, c, t, g, unknown or other
  misc_feature (307)..(307): n is a, c, g, or t
  modified_base (353)..(353): a, c, t, g, unknown or other
  misc_feature (353)..(353): n is a, c, g, or t
  modified_base (356)..(356): a, c, t, g, unknown or other
  misc_feature (356)..(356): n is a, c, g, or t
  modified_base (361)..(361): a, c, t, g, unknown or other
  misc_feature (361)..(361): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccagcctgggagtcccngagactctcctgtgcagccctnggacttcaccttcagtagctatggcatgcacgtggggcccnccaggcctccgagggcgaaggggctgggagtgggtgcctagtttanatnatagngtagtaggtaaaattaaactaaatactagtacgacaagtaccgtacggtaggaacgggcctaattaccaacctactccaccgagaacgaaactaaacttaccgaaacgaacacgactagtactacgacgaacaaataacgaacgaacgacgtacgagacgacgacgacgacgacgtacgtagtaagttacgtacgtacgtacgacggacggacggtacg

SEQ ID NO: 321064 - DNA, 637 bp, Homo sapiens
  misc_feature: GZ8MTXP02HV5ZT.19.13.B02.1.454.CMB.2.raw
  modified_base (310)..(310): a, c, t, g, unknown or other
  misc_feature (310)..(310): n is a, c, g, or t
  modified_base (368)..(368): a, c, t, g, unknown or other
  misc_feature (368)..(368): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagcgtgggtttcctcgttgctcttttaagaggtgtccagtgtcaggtgcagctggtggagtcgtgggggagcgtggtccagccgtgggaggtccctgagactctcctgtgcagcctctggtacttcaccttcagtagctatggcatgcacgtcggggtcccnccgaggcctccgagggcgtaaggggctgggaggtggggtgcctagttatatcattagngtagtaggaaattaaactaaattatagtagacacgtacgtacggtagaacgggtacctattaccacctactcctaccgaagtaacgtaaactaacttaaccgaaacgtaaaccacgtacgtacgtaactacgtaacgaacgtaaacgtaacgaacgtaacgtaccgtacgaacggaacggtacgtaacggaacggaaccggtaccggtacgttacggttaacggttaacgtttacggttacggtacggtacggtacgggtacggtaacg

SEQ ID NO: 321065 - DNA, 540 bp, Homo sapiens
  misc_feature: GZ8MTXP02H6UGB.19.13.B02.1.454.CMB.2.raw
  modified_base (196)..(196): a, c, t, g, unknown or other
  misc_feature (196)..(196): n is a, c, g, or t
  modified_base (266)..(266): a, c, t, g, unknown or other
  misc_feature (266)..(266): n is a, c, g, or t
  modified_base (305)..(305): a, c, t, g, unknown or other
  misc_feature (305)..(305): n is a, c, g, or t
  modified_base (348)..(348): a, c, t, g, unknown or other
  misc_feature (348)..(348): n is a, c, g, or t
  modified_base (355)..(355): a, c, t, g, unknown or other
  misc_feature (355)..(355): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggcncagctggtggagtcgtgggggaggcgtggtccagccgtgggaggtccctgagactctcctgtgcagcctntggattcaccttcagtagctatggcatgcacgtggcccncgaggcctccgagggcaaggggctagggagtgggtgcagttanatcatangatagggaaataaattaaatactatagacagtactcgtagaacgggccgattccaactactctaccagacgaacctaattaccaaagtaacacgactagtactctagacaaatacgaacacgacctagagtagctaggacgacgacggctaggttaagtattacgtgtgacggtaaggtcgtaag

SEQ ID NO: 321066 - DNA, 543 bp, Homo sapiens
  misc_feature: GZ8MTXP02HNH0A.19.13.B02.1.454.CMB.2.raw
  modified_base (306)..(306): a, c, t, g, unknown or other
  misc_feature (306)..(306): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtgtagtcgtgggggagcgtggtccagcctgggaggtccctgagactctcctgtgcagcctctggacttcaccttcagtagctatggcatgcacgtgggtcccnccaggctccgaggcaaggggctgggagtggggtgcctagttatatcatatgatgggaaataaataaactactaatgacagactccggtgaagggccgattcacctatctaccagacgaacaacttaccaaagtaacaacgctagtatctgacaatagaacagccctagagagacctaggaacggaacgtacgggcttaggtcgttaattacgtggttaggaccggaggtacggtaag

SEQ ID NO: 321067 - DNA, 544 bp, Homo sapiens
  misc_feature: GZ8MTXP02IORNG.19.13.B02.1.454.CMB.2.raw
  modified_base (309)..(309): a, c, t, g, unknown or other
  misc_feature (309)..(309): n is a, c, g, or t
  modified_base (484)..(484): a, c, t, g, unknown or other
  misc_feature (484)..(484): n is a, c, g, or t
  modified_base (494)..(494): a, c, t, g, unknown or other
  misc_feature (494)..(494): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggacgtccctgacgactctcctgtgcagcctctggattcaccttcagtagctatggcatgctacgtcgggtcccnccaggcctccgagggccgaaggggctggaggtggggtcgcctagttatatcattagtgagttagaaagtaaactaaagtctatgacagactccggtagaacgggctattcacctatcctacagacgaactaacttaccaaagtacacgtctagtactcgtagacaaatcgaaacncgctagacgngcgtaggacgacgacgtcgtgtgtactacgtggtgacggaggtacgtaag

SEQ ID NO: 321068 - DNA, 507 bp, Homo sapiens
  misc_feature: GZ8MTXP02J0ZNV.19.13.B02.1.454.CMB.2.raw
  modified_base (302)..(302): a, c, t, g, unknown or other
  misc_feature (302)..(302): n is a, c, g, or t
  modified_base (342)..(342): a, c, t, g, unknown or other
  misc_feature (342)..(342): n is a, c, g, or t
  modified_base (424)..(424): a, c, t, g, unknown or other
  misc_feature (424)..(424): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggagtccctgagactctcctgtgcagcctctggattcaccttcagtagctatggcatgcacgtgggtccncaggctccgaggcaaggggctgggagtgggtgccagttanatcatatgatgggaaattaaacaaatactatgacagactccgtagaagggccgattcaccatctccagagacaattaccaanaacacgctagtatctagacaaatgaacagacctagacgagcgtagacggacgacggctgtgtattacgtgtgcgaggacgtag

SEQ ID NO: 321069 - DNA, 541 bp, Homo sapiens
  misc_feature: GZ8MTXP02IOGCH.19.13.B02.1.454.CMB.2.raw
  modified_base (163)..(163): a, c, t, g, unknown or other
  misc_feature (163)..(163): n is a, c, g, or t
  modified_base (305)..(305): a, c, t, g, unknown or other
  misc_feature (305)..(305): n is a, c, g, or t
  modified_base (350)..(350): a, c, t, g, unknown or other
  misc_feature (350)..(350): n is a, c, g, or t
  modified_base (357)..(357): a, c, t, g, unknown or other
  misc_feature (357)..(357): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagcgtgggttttccncgttgctcttttaagaggtgtccagtgtcaggtgcagctggtggagtcgtgggggagcgtggtccagcctgggagtccctgagactctcctgtgcagcctctggattcaccttcagtagctatggcatgcacgtgggtcccnccaggcctccgagggcaaggggctgggagtggggtgcctagttanatcatangatggaaataaataaatctatgacagactccggtagaacggggccagttcacctatcctccgagagaacaacttaccaaagacacgctagtactctagacaaatcgaaacagcctagagagccgtaggacggacgacggtcttaggtaagttacgttacgtggtacgacggtaggacggttaag

SEQ ID NO: 321070 - DNA, 545 bp, Homo sapiens
  misc_feature: GZ8MTXP02JAMTW.19.13.B02.1.454.CMB.2.raw
  modified_base (266)..(266): a, c, t, g, unknown or other
  misc_feature (266)..(266): n is a, c, g, or t
  modified_base (304)..(304): a, c, t, g, unknown or other
  misc_feature (304)..(304): n is a, c, g, or t
  modified_base (420)..(420): a, c, t, g, unknown or other
  misc_feature (420)..(420): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggacgtccctgacgctctcctgtcgcagcctntggattcaccttcagtagctatggcatgcacgtggccnccgaggcctccagggcgaaggggctgggagtgggtgctagttatatcatagtgagtaggaaataaataaatctaatgactagacgtccgtagacggcgtatccgacatctcagtanaactactacaagacacgtctagtatctagactaaatcgaaacacgtaccgagagtagcgtaaggacggtacgacggtcgttagtaagttacgttacgtagggtacgtacggtagggtacgttaag

SEQ ID NO: 321071 - DNA, 554 bp, Homo sapiens
  misc_feature: GZ8MTXP02G88MT.19.13.B02.1.454.CMB.2.raw
  modified_base (305)..(305): a, c, t, g, unknown or other
  misc_feature (305)..(305): n is a, c, g, or t
  modified_base (350)..(350): a, c, t, g, unknown or other
  misc_feature (350)..(350): n is a, c, g, or t
  modified_base (357)..(357): a, c, t, g, unknown or other
  misc_feature (357)..(357): n is a, c, g, or t
  modified_base (359)..(359): a, c, t, g, unknown or other
  misc_feature (359)..(359): n is a, c, g, or t
  modified_base (451)..(451): a, c, t, g, unknown or other
  misc_feature (451)..(451): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggagtccctgagactctcctgtgcagcctctggattccaccttcagtagctatggcatgcacgtcgggtcccnccaggcctccgagggcgaaggggctgggagtggggtgctagttanatcatangntaggaaagtaataaatctatgacagtactaccggtagaacggggccattccaacctattccgtaccaagacaactaacttaccaaagaaccncggactagtaactcgtagacaaatagaactagcctaggagagtcgaggaacggaccgacgggtcttagtaacgttattacgtggtaggacggaggacggtaag

SEQ ID NO: 321072 - DNA, 587 bp, Homo sapiens
  misc_feature: GZ8MTXP02G2N4Q.19.13.B02.1.454.CMB.2.raw
  modified_base (312)..(312): a, c, t, g, unknown or other
  misc_feature (312)..(312): n is a, c, g, or t
  modified_base (367)..(367): a, c, t, g, unknown or other
  misc_feature (367)..(367): n is a, c, g, or t
  modified_base (550)..(550): a, c, t, g, unknown or other
  misc_feature (550)..(550): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgagactctcctgtgcagcctctggacttcaccttcagtacgctagtggccagtcgcacgtcgggtcccnccaggcctccgagggcgaaggggctgggaggtggggtgacctagttatatcatangacgtgggaaattaaataaatactagtgacaagtactacggagaacggggcctaagttaccaacctattacccgtaccgaagaaccgtaaactaaacttacccgaaaggtaaccaccgtactagtactacgtagaaccaaatacgaaacacgtccaggacgaagcgaggaacgcgaaccggtntagtaagttactacgtggcgacggtacggacggtacg

SEQ ID NO: 321073 - DNA, 643 bp, Homo sapiens
  misc_feature: GZ8MTXP02I9XOV.19.13.B02.1.454.CMB.2.raw
  modified_base (178)..(178): a, c, t, g, unknown or other
  misc_feature (178)..(178): n is a, c, g, or t
  modified_base (263)..(263): a, c, t, g, unknown or other
  misc_feature (263)..(263): n is a, c, g, or t
  modified_base (276)..(276): a, c, t, g, unknown or other
  misc_feature (276)..(276): n is a, c, g, or t
  modified_base (305)..(305): a, c, t, g, unknown or other
  misc_feature (305)..(305): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagnggtgtccagtgtcaggtgcagctggtggagtcgtgggggagcgtggtccagccgtgggagtccctgagctctcctgtgcagcctntggattcaccttnagtagctatggcatgcacgtcggggcccncgaggcctccgagggcgaaggggtctggggagtggggtcgcctaaggttatactcaattagtggagttagggaaaattaaataaaacttacgtaagtcggaccaacgtaccttacccggtaggtaaacggggcccgtaacgttacaaccctataccctaccgaacgaacgtaaacctaaactttaaccaaacggtaaaccacgtacgttacgtaactaccgtacgaactaaaagtacggaaacacgtacccgtaaggacggacgtaccgtaggaacggacgtaccgggtctaggttaagttacgttaacgtggtacggacggtacggtacggttaacg

SEQ ID NO: 321074 - DNA, 540 bp, Homo sapiens
  misc_feature: GZ8MTXP02JFGM1.19.13.B02.1.454.CMB.2.raw
  modified_base (305)..(305): a, c, t, g, unknown or other
  misc_feature (305)..(305): n is a, c, g, or t
  modified_base (351)..(351): a, c, t, g, unknown or other
  misc_feature (351)..(351): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcctctggattcaccttcagtagctatggcatgcacgtggggtcccnccaggctccgagggcgaaggggctgggaggtggggtgcctagttanatcgatatgagtggaaagtaaataaatactaatcgacagactccggtagaacgggcgtattcacctatcctaccagacgacaacttaccaaagaacacgactagtactctagacaaatgaaacacgccgtagagacgacgtaggaacggacgacggtctgtaagtattacgtgtgacggtaggcgtaag

SEQ ID NO: 321075 - DNA, 539 bp, Homo sapiens
  misc_feature: GZ8MTXP02H3VSP.19.13.B02.1.454.CMB.2.raw
  modified_base (285)..(285): a, c, t, g, unknown or other
  misc_feature (285)..(285): n is a, c, g, or t
  modified_base (305)..(305): a, c, t, g, unknown or other
  misc_feature (305)..(305): n is a, c, g, or t
  modified_base (519)..(519): a, c, t, g, unknown or other
  misc_feature (519)..(519): n is a, c, g, or t
tcagtactctcgtgcacgaccggtgctcgatttagtctagcgacttccgcggggagctctgggagaggagccccagcactagaagtcggcggtgtttccattcggtgatcagcaatgaacacagaggactcaccatggagtttgggctgagctgggttttcctcgttgctcttttaagaggtgtccagtgtcaggtgcagctggtggagtcgtgggggagcgtggtccagcctgggagtccctgagctctcctgtgcagcctctggattcaccttcagtagctanggcatgcacgtggggtcccncaggcctccgaggcgaaggggctgggagtggggtgcagttatatcatatgagtagggaaattaaataaaagtctaatgaccagactcccggtgaacgggccattacacccgatccaccagacgaacaaattaccaaagaacacgctagtatcagacaaatcgaacagcctagagacgctacggaacggacacgggtctaggttaagtattacgnggtagccggtaggcggtaag

SEQ ID NO: 321076 - DNA, 503 bp, Homo sapiens
  misc_feature: GZ8MTXP02GC8CW.19.13.B02.1.454.CMB.2.raw
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctggggaggtccctgagactctcctgtgcagcctctggattcaccttcagtagctatggcatgcactgggtccgccaggctccgagggcaaggggctggagtggggtggccagttatatcatatgatggaaagtaataaaatactaatgcagactccgtagaagggcattcaccatctcagagacaaattccaagaacacgactgtatctgacaaatgaacagacctgagagctaggacgacacggctgtgtactacgtgtgcggaggcgtaag

SEQ ID NO: 321077 - DNA, 582 bp, Homo sapiens
  misc_feature: GZ8MTXP02G676C.19.13.B02.1.454.CMB.2.raw
  modified_base (304)..(304): a, c, t, g, unknown or other
  misc_feature (304)..(304): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcctctggattcaccttcagtagctatggcatgcacgtgggtcccnccaggctccgagggcgaaggggctagggagtggggtgccgtaggttactatctaatatagagttagggaaaagttaaattaaaatacttatagacaacgtacgtcccggtaggaaacggggccctaagtttaccacctattcctacccgaagaacgaaactaaacttaaccgaaaggaaaccacggtacttagtactacgtagacaaatcgaaacagcctagacgtagcgtaggacgacgacggtctagtgtatacgtggtagcggtaggtacgtaag

SEQ ID NO: 321078 - DNA, 555 bp, Homo sapiens
  misc_feature: GZ8MTXP02HFHK7.19.13.B02.1.454.CMB.2.raw
  modified_base (305)..(305): a, c, t, g, unknown or other
  misc_feature (305)..(305): n is a, c, g, or t
  modified_base (354)..(354): a, c, t, g, unknown or other
  misc_feature (354)..(354): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtggggagtccctgagactctcctgtgcagcctcgtggattcaccttcagtagctatggcatgcacgtgggccncaggctccgaggcaaggggctgggagtggggtgcctagttatatcatangatagggtaaataaactaaagtactatgacagtacgtaccggtagaacgggccgaattccaacctatcctaccgagacgaacaaacttaccaaagaaccacgctagtactctagaacaaagtacgaaacacgaccgtagaacgagcgtaggacggaccgacggtcgtagtaagtaagttacgtggtaggcgaggtcgtaag

SEQ ID NO: 321079 - DNA, 617 bp, Homo sapiens
  misc_feature: GZ8MTXP02JLU0M.19.13.B02.1.454.CMB.2.raw
  modified_base (306)..(306): a, c, t, g, unknown or other
  misc_feature (306)..(306): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgagctctcctgtgcagcctctggattcaccttcagtagctatggcatgcacgtcggggtcccnccgaggcctccgagggcgaaggggctgggaggtggggtgccgtagttatatcatagtgagtagggaaattaaataaatactagtcgacagtaccgtaccggtagacgggccgtattaccgacctatcctaccagaacgtaacgtaaacttacccgaaacgaacctaaccggtaccttagttactaccgtacgaactaaaataccggaaacctacgcccgtaaggacggacgtaccgtagggaacggtaccgaaccgggtcttagggtaagtaacgtttacgtggtacggaccggtaacggggtacgttaag

SEQ ID NO: 321080 - DNA, 591 bp, Homo sapiens
  misc_feature: GZ8MTXP02J2PU3.19.13.B02.1.454.CMB.2.raw
  modified_base (162)..(162): a, c, t, g, unknown or other
  misc_feature (162)..(162): n is a, c, g, or t
  modified_base (250)..(250): a, c, t, g, unknown or other
  misc_feature (250)..(250): n is a, c, g, or t
  modified_base (276)..(276): a, c, t, g, unknown or other
  misc_feature (276)..(276): n is a, c, g, or t
  modified_base (308)..(308): a, c, t, g, unknown or other
  misc_feature (308)..(308): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttccncgttgctcttttaagaggtgtccagtgtcaggtgcagctggtggagtcgtgggggagcgtggtccagcctgggagtccctgagactcncctgtgcagcctctggattcaccttnagtagctagtggcagtgcacgttggggacccncgaggcctccgaggcgaggggctgggaggtgggtacgactagttatactactatagtagagtaaggtaaaattaaataaactatagacgacacgtaccgtcggtaggacggacctactcacctatccaccgagaacgaactaacgtaaccgaaagaccgacgtactagtactacgtaacgaactaaagaacgaacgaacgacgtacggacgacgacggacgaacggacgacggtacgtacgtaacgttacgtacgtacggtaggtacggtacggtacggtacg

SEQ ID NO: 321081 - DNA, 512 bp, Homo sapiens
  misc_feature: GZ8MTXP02GK7P4.19.13.B02.1.454.CMB.2.raw
  modified_base (302)..(302): a, c, t, g, unknown or other
  misc_feature (302)..(302): n is a, c, g, or t
  modified_base (344)..(344): a, c, t, g, unknown or other
  misc_feature (344)..(344): n is a, c, g, or t
  modified_base (483)..(483): a, c, t, g, unknown or other
  misc_feature (483)..(483): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcctctggattcaccttcagtagctatggcatgcactgggtccnccaggctccagggcaaggggctgggagtggggtgccagttanatcatatgatgggaaataataaatactatgacagactccgtagaagggccgattcaccatctaccagagaacaattaccaaagaacacgactagtatctagacaaaatgaaacagcctagagagctagacggacacggntgtgttatactggtgcgacggacggtaag

SEQ ID NO: 321082 - DNA, 643 bp, Homo sapiens
  misc_feature: GZ8MTXP02J2CRZ.19.13.B02.1.454.CMB.2.raw
  modified_base (351)..(351): a, c, t, g, unknown or other
  misc_feature (351)..(351): n is a, c, g, or t
  modified_base (358)..(358): a, c, t, g, unknown or other
  misc_feature (358)..(358): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggacgtccctgagactctcctgtgcagcctctggattcaccttcagtagctatggcatgcacgtgggtccgccgaggctcccgagggcaaggggctgggagtggggtgccagtttanatcatangagtagggaaagtaataaagtactatcggcaagaccgtaccggtaggaaacggggccctaagttccaacctactcctacccgaagaacgaaacctaaactttaccccgaaaaggaaaccaaccggtacttaacggtaacttcccgttaaggaaccgtaaaattacggaaaacctaacggacccgtaggaacggacggaccgtaaggaacgggaaccgacgggtaccgttaggttaaccgttaacgtttaacggtggttacggtacggacgggggtacgttaacgg

SEQ ID NO: 321083 - DNA, 516 bp, Homo sapiens
  misc_feature: GZ8MTXP02GVJ7W.19.13.B02.1.454.CMB.2.raw
  modified_base (305)..(305): a, c, t, g, unknown or other
  misc_feature (305)..(305): n is a, c, g, or t
  modified_base (486)..(486): a, c, t, g, unknown or other
  misc_feature (486)..(486): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtagctatggcatgcacgtgggtcccncaggctccagggcaaggggctgggagtggggtggccagttatagtcatatggatgggaaagttaaataaaatactaatgcagactccgtagaacgggcgattcaccatctccagagaacattaccaagaacacgctagtatctagacaaatgaacagcctagagagctagacggacacggntagtgttacttacgtgtgcggaggacgtag

SEQ ID NO: 321084 - DNA, 537 bp, Homo sapiens
  misc_feature: GZ8MTXP02GBF6N.19.13.B02.1.454.CMB.2.raw
  modified_base (303)..(303): a, c, t, g, unknown or other
  misc_feature (303)..(303): n is a, c, g, or t
  modified_base (375)..(375): a, c, t, g, unknown or other
  misc_feature (375)..(375): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcctctggattcaccttcagtagctatggcatgcactggggtccnccaggctccgagggcaaggggctgggagtggggtgccagttatatcatatgatgggaaataataatatatgnagactccgtgaacggcgatacaccatctacagacgaacaacttaccaacgaacacgactagtatactacgacaaatagaacacgaccgtacgagagacgtaggacggacgacggcgtaggtaagttacgttaacgttcggtggtacggacggtacggtaagg

SEQ ID NO: 321085 - DNA, 497 bp, Homo sapiens
  misc_feature: GZ8MTXP02I9X6X.19.13.B02.1.454.CMB.2.raw
  modified_base (302)..(302): a, c, t, g, unknown or other
  misc_feature (302)..(302): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggaggtccctgagactctcctgtgcagcctctggattcaccttcagtagctatggcatgcactgggtccnccaggctccaggcaaggggctggagtgggtggccagttatatcatatgatggaaagtaaataaaatactaatgcagactccgtagaagggccgattcaccatctcagagacaattccaagaacacgctagtatctgacaaatgaacagcctagagagctagacggacacggctgtgtatactgtgcgaggcgtag

SEQ ID NO: 321086 - DNA, 532 bp, Homo sapiens
  misc_feature: GZ8MTXP02IHHRF.19.13.B02.1.454.CMB.2.raw
  modified_base (398)..(398): a, c, t, g, unknown or other
  misc_feature (398)..(398): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctctgtgcagcctctggattcaccttcagtagctatggcatgcactggggtcccgccaggcctccgagggcgaaagggggctaggggacgtggggtggcctaggtttatagtcatatgagtggaaagtaaataaagtactatgcagtacnccgtagaagggcgattcaccatctcagagacaaattaccaaagaacacgtactgtaactcgtacgataaaatgaacagacctagagagctagacgacgacggtctagtgtattacgtgtgcggtaggcgtaagg

SEQ ID NO: 321087 - DNA, 621 bp, Homo sapiens
  misc_feature: GZ8MTXP02H34NJ.19.13.B02.1.454.CMB.2.raw
  modified_base (162)..(162): a, c, t, g, unknown or other
  misc_feature (162)..(162): n is a, c, g, or t
  modified_base (266)..(266): a, c, t, g, unknown or other
  misc_feature (266)..(266): n is a, c, g, or t
  modified_base (306)..(306): a, c, t, g, unknown or other
  misc_feature (306)..(306): n is a, c, g, or t
  modified_base (354)..(354): a, c, t, g, unknown or other
  misc_feature (354)..(354): n is a, c, g, or t
  modified_base (364)..(364): a, c, t, g, unknown or other
  misc_feature (364)..(364): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttccncgttgctcttttaagaggtgtccagtgtcaggtgcagctgggtggagtcgtgggggagcgtggtccagccgtgggaggtccctgagactctctgtgcagcctcnggattcaccttcagtagctatggcatgcacgtgggtcccncaggcctccgagggcaaggggctaggggagtggggtgacctaggttanagtcattagngagtgggaaaattaaacttaaaatacttagagacagaactccgtaggaaggcccgattacgaacccattaccaccgagaacactaaaattcccgaaaagtaacacggtacctagtaatccgttaacggaaactaaacgtaacgaacgaacgtaacgtacggaacggacggtacgtaacggaacggaacggtacgggtacggttacggttaacgttaacgttacgttacggtacggtacgggtacgggtacggtaacg

SEQ ID NO: 321088 - DNA, 534 bp, Homo sapiens
  misc_feature: GZ8MTXP02FT344.19.13.B02.1.454.CMB.2.raw
  modified_base (302)..(302): a, c, t, g, unknown or other
  misc_feature (302)..(302): n is a, c, g, or t
  modified_base (348)..(348): a, c, t, g, unknown or other
  misc_feature (348)..(348): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcctctggattcaccttcagtagctatggcatgcacgtgggccnccaggcctccgagggcgaaggggctgggagtggggtgcctagttanatcatatgatagggaaattaaactaaatactatgacagactccgtagaagggccattaccacctatcctaccagacgaacaaacttaccaaagaacacgactagtactctagacaaatgaaacagacctagagagctaggaacgacgacggctagtaagtattacgtggtcgcggacggtcgtaag

SEQ ID NO: 321089 - DNA, 516 bp, Homo sapiens
  misc_feature: GZ8MTXP02HOK3W.19.13.B02.1.454.CMB.2.raw
  modified_base (306)..(306): a, c, t, g, unknown or other
  misc_feature (306)..(306): n is a, c, g, or t
  modified_base (357)..(357): a, c, t, g, unknown or other
  misc_feature (357)..(357): n is a, c, g, or t
  modified_base (415)..(415): a, c, t, g, unknown or other
  misc_feature (415)..(415): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggcggagtcgtgggggaggcgtggtccagcctgggaggtccctgagactctcctgtgcagcctctggattcaccttcagtagctatggcatgcactggggtcccnccaggcctccgagggcgaaggggctgggagtggggtgcagttatatcatangataggaaataaataaatactatgacagactcgtagaacggcattcaccatctcaganaactaactacaagaacacgctagtatctagacaatagaacagactacgagagacgtagagacgacgacgtagtgtattactacgtggacgacggtacgtag

SEQ ID NO: 321090 - DNA, 571 bp, Homo sapiens
  misc_feature: GZ8MTXP02HTD9N.19.13.B02.1.454.CMB.2.raw
  modified_base (307)..(307): a, c, t, g, unknown or other
  misc_feature (307)..(307): n is a, c, g, or t
  modified_base (351)..(351): a, c, t, g, unknown or other
  misc_feature (351)..(351): n is a, c, g, or t
  modified_base (354)..(354): a, c, t, g, unknown or other
  misc_feature (354)..(354): n is a, c, g, or t
  modified_base (358)..(358): a, c, t, g, unknown or other
  misc_feature (358)..(358): n is a, c, g, or t
  modified_base (539)..(539): a, c, t, g, unknown or other
  misc_feature (539)..(539): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaggtccctgagactctcctgtgcagcctctggattcaccttcagtagctatggcatcgcacgtgggtcccncgaggctccgagggcgaaggggctgggagtggggtgccagttanatnatangatagggaaataaattaaatactagtgacaagtacgtccgtaggaacgggcccgaattaccaacctacttcctacccgaagaacgaaaggtaaacttacccgaaaagaaaccgaccgtacgtagttataccgtagaacaaaagtagaaacagaccgtagagacgcgaggacggacacggtntggtaagtactactggagacggaggtacgtag

SEQ ID NO: 321091 - DNA, 500 bp, Homo sapiens
  misc_feature: GZ8MTXP02GN7K3.19.13.B02.1.454.CMB.2.raw
  modified_base (302)..(302): a, c, t, g, unknown or other
  misc_feature (302)..(302): n is a, c, g, or t
  modified_base (343)..(343): a, c, t, g, unknown or other
  misc_feature (343)..(343): n is a, c, g, or t
  modified_base (431)..(431): a, c, t, g, unknown or other
  misc_feature (431)..(431): n is a, c, g, or t
  modified_base (433)..(433): a, c, t, g, unknown or other
  misc_feature (433)..(433): n is a, c, g, or t
  modified_base (437)..(437): a, c, t, g, unknown or other
  misc_feature (437)..(437): n is a, c, g, or t
  modified_base (442)..(442): a, c, t, g, unknown or other
  misc_feature (442)..(442): n is a, c, g, or t
  modified_base (444)..(444): a, c, t, g, unknown or other
  misc_feature (444)..(444): n is a, c, g, or t
tcagtactctcgtgcacgaccggtgctcgattagtctagcgacttccgcgggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtagctatggcatgcactggggtccnccaggctccagggcaaggggctggagtgggtggccagttanatcatatgatgggaaataataaatctatgcagactcgtgaagggcgattcaccatctccagagacaattccaagaacagctgtatctnanaaanagaanancagagagcgagacggacgacgcgtgtaagtagttacgtgtgacggacggacggtag

SEQ ID NO: 321092 - DNA, 561 bp, Homo sapiens
  misc_feature: GZ8MTXP02FPOES.19.13.B02.1.454.CMB.2.raw
  modified_base (304)..(304): a, c, t, g, unknown or other
  misc_feature (304)..(304): n is a, c, g, or t
  modified_base (344)..(344): a, c, t, g, unknown or other
  misc_feature (344)..(344): n is a, c, g, or t
  modified_base (353)..(353): a, c, t, g, unknown or other
  misc_feature (353)..(353): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagccgtgggaggtccctgagactctcctgtgcagcctctggattcaccttcagtagctatggcatgcactgggtccnccaggctccgaggcaaggggctggagtggggtgctagtanatcatatgntgggaaataataaatactagtgacagactccgtggaagggccgtattccacccgatcctaccagacgaacaaattaccaaagaaacacgactagtaatctagacaaaatcgaaacacgaccctaggaaggagacgtaggaacggacgacggggtcttaggtaaggttaactttacgtggttacggaccggtaagggtcgggttaaacg

SEQ ID NO: 321093 - DNA, 583 bp, Homo sapiens
  misc_feature: GZ8MTXP02IC7EH.19.13.B02.1.454.CMB.2.raw
  modified_base (196)..(196): a, c, t, g, unknown or other
  misc_feature (196)..(196): n is a, c, g, or t
  modified_base (265)..(265): a, c, t, g, unknown or other
  misc_feature (265)..(265): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtncagctgggtggagtcgtgggggagcgtggtccagccgtgggagtccctgagctctcctgtgcagccttntggattcaccttcagtagctatggcatgcacgtggtcccgcaggcctccgagggcgaaggggctggggaggtggggtgcctaggtttatatcgaattatggagtagggtaaaattaaattaaaatactaatgacaacgtactaccggtaggaacggtaccgattaccgacctatcctaccagacgaactaacttaccaaagaaccacgtctagtactactagacaaaatacgaacgacgacccgtaggagacggcgtaggaacggtaccgacggtactggttaagtacttacgtcggtgaccggtaggtacggtaacg

SEQ ID NO: 321094 - DNA, 522 bp, Homo sapiens
  misc_feature: GZ8MTXP02G9ZIW.19.13.B02.1.454.CMB.2.raw
  modified_base (304)..(304): a, c, t, g, unknown or other
  misc_feature (304)..(304): n is a, c, g, or t
  modified_base (356)..(356): a, c, t, g, unknown or other
  misc_feature (356)..(356): n is a, c, g, or t
  modified_base (413)..(413): a, c, t, g, unknown or other
  misc_feature (413)..(413): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagcctgggagtccctgagctctcctgtgcagcctctggattccaccttcagtagctatggcatgcacgtgggcccnccaggcctccgagggcaaggggctgggagtggggtgcctagttatatcatangatgggaaataaataaatactatgcagactccgagaaggcatcaccatctaccaganaactaataccaaagaacacgactagtatctagacaaataagaacaacgaccgtacgagagacgagaagacgacgacgtagtgtattacgtgtgacggacggacggtaag

SEQ ID NO: 321095 - DNA, 557 bp, Homo sapiens
  misc_feature: GZ8MTXP02I5PB4.19.13.B02.1.454.CMB.2.raw
  modified_base (262)..(262): a, c, t, g, unknown or other
  misc_feature (262)..(262): n is a, c, g, or t
  modified_base (304)..(304): a, c, t, g, unknown or other
  misc_feature (304)..(304): n is a, c, g, or t
  modified_base (348)..(348): a, c, t, g, unknown or other
  misc_feature (348)..(348): n is a, c, g, or t
  modified_base (515)..(515): a, c, t, g, unknown or other
  misc_feature (515)..(515): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagctctcctgtgcagcctntggattcaccttcagtagctatggcatgcacgtggggtcccncgaggctccgagggcaaggggctgggagtggggtgcctagttanatcatatgatggaaagtaaataaatactatgcagactccggtagaacgggaccgattaccacctatctaccgagacgaacaacttaccaaagtaaccacgtctagtactctacgactaaagtcgaacgaacgcctaggacgaacgtcgtaggacggaccgaccggtnttacggtaagttagtacgtggtacgcggtaggtacggttaag

SEQ ID NO: 321096 - DNA, 725 bp, Homo sapiens
  misc_feature: GZ8MTXP02H3SFZ.19.13.B02.1.454.CMB.2.raw
  modified_base (307)..(307): a, c, t, g, unknown or other
  misc_feature (307)..(307): n is a, c, g, or t
tcagtactctcgtgcacgaccggtgctcgatttagtctagcgacttccgcggggagctctgggagaggagccccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggaggtccctgagactctcctgtgcagcctctggattcaccttcagtgctatggcatgcacgtggggtcccncgaggcctccgagggcgaaggggctaggggaggtggggtcgccgtaaggtttactagtcattagttaggagttagggtaaaattaaacttaaaagttacttaagtacgaccaagtaaccgttacccggttagggaaacggggtacccggtaacgttttacccgaaacccgatttacccacccgtaaggtaaacgaaaccttaaaactttaccccgaaaaacgggaaaacctacccgggtacttacggttaaacttaccttaacggaacctaaaaagttacggaaaaccacgggtaacccgttacgggaaacggtaaggaccgttaaggggaaacggaaccggaacccggggtcttagggttaacgttaaacgtttaacggtacggtgggttacccgggaaggggttaccggtaaacgg

SEQ ID NO: 321097 - DNA, 568 bp, Homo sapiens
  misc_feature: GZ8MTXP02ILTA3.19.13.B02.1.454.CMB.2.raw
  modified_base (308)..(308): a, c, t, g, unknown or other
  misc_feature (308)..(308): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccaggcctgggaggtccctgagactctcctgtgcagcctctggattcaccttcagtagctatggcatgcacgtggggtcccnccaggcctccgagggcgaaggggctgggagtggggtgccagttatatcatatgagtaggaaagtaaataaatactatgacagactccggtagaagggccgattcaaccatctaccagagacaaacttaccaaagaaccacgactagtactacgtacgaactaaagtacgaaacgacgaccgtaggagacgacgtaggacggaccgacggtcgtagttaagttacgttacgttggtacggtacggtacgggtacggtaacg

SEQ ID NO: 321098 - DNA, 572 bp, Homo sapiens
  misc_feature: GZ8MTXP02JWD6E.19.13.B02.1.454.CMB.2.raw
  modified_base (306)..(306): a, c, t, g, unknown or other
  misc_feature (306)..(306): n is a, c, g, or t
  modified_base (352)..(352): a, c, t, g, unknown or other
  misc_feature (352)..(352): n is a, c, g, or t
  modified_base (359)..(359): a, c, t, g, unknown or other
  misc_feature (359)..(359): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggacgtccctgagactctcctgtgcagcctctggattcaccttcagtagctatggcatgcactggggtcccncaggctccgagggcgaaggggctggggagtggggtgccgtagttanatcatanggatagggaaataaataaatctagtgacagactccgagaacggccgatcacatcaccagacgaactaattaccaaagtaaccacgtacgttacgtaactcgtacgaactaaatacgaacgacgtaccctacggaagacgacgtagggaacgaccgacggtaccgttggttaagttacgtttacgcggttaggaccggtagggtacggtaacgg

SEQ ID NO: 321099 - DNA, 553 bp, Homo sapiens
  misc_feature: GZ8MTXP02FRSLH.19.13.B02.1.454.CMB.2.raw
  modified_base (307)..(307): a, c, t, g, unknown or other
  misc_feature (307)..(307): n is a, c, g, or t
  modified_base (352)..(352): a, c, t, g, unknown or other
  misc_feature (352)..(352): n is a, c, g, or t
  modified_base (359)..(359): a, c, t, g, unknown or other
  misc_feature (359)..(359): n is a, c, g, or t
  modified_base (430)..(430): a, c, t, g, unknown or other
  misc_feature (430)..(430): n is a, c, g, or t
  modified_base (473)..(473): a, c, t, g, unknown or other
  misc_feature (473)..(473): n is a, c, g, or t
  modified_base (476)..(476): a, c, t, g, unknown or other
  misc_feature (476)..(476): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctggggaggtccctgagactctcctgtgcagcctctggattcaccttcagtagctatggcatgcacgtggggtccnccaggcctccgagggcaaggggctgggagtggggtgcctagttanatcatangagtaggaaagtaaataaactatatgacagactaccgtagaacgggccgtattacacctatcctaccaganaactaaattacccaaagaacaacgctagtactctagacaaaanaanaacgacgacgtacgagagacgtaggacggacgacgacgtagtaagttagttacgtacgtaggacggacggacggtag

SEQ ID NO: 321100 - DNA, 553 bp, Homo sapiens
  misc_feature: GZ8MTXP02IH3EB.19.13.B02.1.454.CMB.2.raw
  modified_base (163)..(163): a, c, t, g, unknown or other
  misc_feature (163)..(163): n is a, c, g, or t
  modified_base (265)..(265): a, c, t, g, unknown or other
  misc_feature (265)..(265): n is a, c, g, or t
  modified_base (277)..(277): a, c, t, g, unknown or other
  misc_feature (277)..(277): n is a, c, g, or t
  modified_base (305)..(305): a, c, t, g, unknown or other
  misc_feature (305)..(305): n is a, c, g, or t
  modified_base (359)..(359): a, c, t, g, unknown or other
  misc_feature (359)..(359): n is a, c, g, or t
  modified_base (433)..(433): a, c, t, g, unknown or other
  misc_feature (433)..(433): n is a, c, g, or t
  modified_base (472)..(472): a, c, t, g, unknown or other
  misc_feature (472)..(472): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagcgtgggttttccncgttgctcttttaagaggtgtccagtgtcaggtgcagctggtggagtcgtgggggagcgtggtccagcctgggaggtccctgagactctcctgtgcagcctnggattcaccttnagtagctatggcatgcacgtgggtcccncgaggctccgagggcgaaggggctggggagtggggtgccagttatatcgattangagtagggaaattaaactaaaatctatgacagtactccgtagaagggcctaattcaaccctattccaccgaganaactaaacttcaaagtaaccacgtctagtaactcgtaanacaactagaacgacgacgtacgagagacgagacgacgacgtacgtagtaagtacgtacgtacgtagacggacggtacgtag

SEQ ID NO: 321101 - DNA, 564 bp, Homo sapiens
  misc_feature: GZ8MTXP02IBTC0.19.13.B02.1.454.CMB.2.raw
  modified_base (307)..(307): a, c, t, g, unknown or other
  misc_feature (307)..(307): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggaggtccctgagctctcctgtgcagcctctggattccaccttcagtagctatggcatgctacgtggggtcccnccgaggcctccgagggcgaaggggctgggaggtggggtggcctagttatatcattatgagtagggaaagtaaattaaatacttaatggacagacgtccggtagaacgggcctattcgacctatcctaccagacgaacaacttaccaagaacacgactagtactctagacaaagtagaacagacctagagagacgtacggacggacgacggtcttaggtaagttacgttacgtggtacggacggtagggtacggtaag

SEQ ID NO: 321102 - DNA, 587 bp, Homo sapiens
  misc_feature: GZ8MTXP02J1KYG.19.13.B02.1.454.CMB.2.raw
  modified_base (307)..(307): a, c, t, g, unknown or other
  misc_feature (307)..(307): n is a, c, g, or t
  modified_base (354)..(354): a, c, t, g, unknown or other
  misc_feature (354)..(354): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgagactctcctgtgcagcctctggattcaccttcagtagctatggcatgctacgtggggtcccncgaggcctaccgaggcgaaggggctgggaggtggggtgcctagttanatcatatgagtagggaaaattaataaatactagtagacaacgtaccgtccggtaggaacgggtacccgtattccacctacgtcctaccgagaacgaaacctaaacttacccaaagaaccacgacttagtactccgtagaacaaatacgaaacgtacgaccgtaggaagagcgtaaggacggacgacggtacgtagtaagttacttacgtggtacggcggtaggtacggtaacg

SEQ ID NO: 321103 - DNA, 565 bp, Homo sapiens
  misc_feature: GZ8MTXP02H4LBC.19.13.B02.1.454.CMB.2.raw
  modified_base (303)..(303): a, c, t, g, unknown or other
  misc_feature (303)..(303): n is a, c, g, or t
  modified_base (349)..(349): a, c, t, g, unknown or other
  misc_feature (349)..(349): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggagtccctgagactctcctgtgcagcctctggattcaccttcagtagctatggcatgctacgtggtcccncaggcctccgaggcgaaggggctggggagtggggtgcctagtttanatcgatagttgagttaggaaacgttaataaagtctagtgacagactccggtagaacgggccgtaattaccgaacctatacctacccgagacgtaactaaacttaccaaagtaacacgacttagtactctagacaaatacgaacacgacctagagagcgtaggaacggacacggtctagttaagtacgttaacgtggtacgacggtaggtacgtaag

SEQ ID NO: 321104 - DNA, 584 bp, Homo sapiens
  misc_feature: GZ8MTXP02GEO6H.19.13.B02.1.454.CMB.2.raw
  modified_base (308)..(308): a, c, t, g, unknown or other
  misc_feature (308)..(308): n is a, c, g, or t
  modified_base (356)..(356): a, c, t, g, unknown or other
  misc_feature (356)..(356): n is a, c, g, or t
  modified_base (363)..(363): a, c, t, g, unknown or other
  misc_feature (363)..(363): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagccgtgggacgtccctgagactctcctgtgcagcctctggattcaccttcagtagctatggcatgctacgtcgggtccnccaggcctccgagggcgaaggggctgggagtggggtgacctagttatntacatangagtagggaaaactaaataaagtactagtcgactaagaccgttaccggtaggaacgggtccgtattaccgaacctatcctaccgagacgaaactaacttaccaacgaacacgactagtactcgtagaactaaagtacgaaacacgacctaggaagacgaccgtaggacggacgacgggtctaggtaagttacgttacgtcggtagacggagggtacgtaag

SEQ ID NO: 321105 - DNA, 618 bp, Homo sapiens
  misc_feature: GZ8MTXP02IR0IB.19.13.B02.1.454.CMB.2.raw
  modified_base (307)..(307): a, c, t, g, unknown or other
  misc_feature (307)..(307): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggagtccctgagactctcctgtgcagcctcgtgattcaccttcagtagctatggcatgcacgtcggggtcccnccaggcctccgagggacgaaggggctaggggagtggggtgcctagttatatacgatagtgagttaggaaagttaaataaatactagtgacagtactaccggagaacgggccgtaattaccaacctctacctaccaagaacgaactaaacttaaccaaacgaaacaccgtactaagtactaccgttaagaacaaacgtaacgaaacgaacgacgtacgaacggacggacgtaacggaacggaaccgacggtacgttacgttaagttaacgttaacggttacggtacggtacgggtaacgggtaacggtaacg

SEQ ID NO: 321106 - DNA, 613 bp, Homo sapiens
  misc_feature: GZ8MTXP02IEENJ.19.13.B02.1.454.CMB.2.raw
  modified_base (308)..(308): a, c, t, g, unknown or other
  misc_feature (308)..(308): n is a, c, g, or t
tcagtactctcgtgcacgaccggtgctcgatttagtctagcgacttccgcggggagctctgggagaggagccccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgagactctcctgtgcagcctctggattccaccttcagtgctagtggcatgctacgtgggtcccnccgaggcctccgaggacgaaggggctgggagtggggtgccgtaggttatagtcaagttagtgtagtagggaaaattaaaacttaaaattactagtagacaagtaccgtaccggtaggaacggggaccctattaccaacctacgtcctaccgaagaacaaacctaaattaccccgaaaagaaccaccgtatacgtaactccgtagaacctaaaagtcgaaacgacgtcctaagacgaggcttaagggacggacctagggtccttaggtgttaagtttacggtggtacggacggtacggtacggtag

SEQ ID NO: 321107 - DNA, 569 bp, Homo sapiens
  misc_feature: GZ8MTXP02GG8HA.19.13.B02.1.454.CMB.2.raw
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccccctgagactctcctgtgcagcctctggatcacctcagtagctatggcatgcacgtgggtccgccaggctccgagggcgaaggggctgggaggtgggtggccaggttatatcatatgatggaaagtaaataaatactatgacagactccgtagaaacgggccgattccgacatcctccagaacgaactaaacttaccaaacgaaccaccggtaccttagtaacttaccgtagaacctaaaatcggaaacacgtaccctaggacgagtcgtaggaacggtacgacggtctagtaacgttatacgtggtaggacggtaggtacggttaag

SEQ ID NO: 321108 - DNA, 536 bp, Homo sapiens
  misc_feature: GZ8MTXP02HMRMU.19.13.B02.1.454.CMB.2.raw
  modified_base (305)..(305): a, c, t, g, unknown or other
  misc_feature (305)..(305): n is a, c, g, or t
  modified_base (415)..(415): a, c, t, g, unknown or other
  misc_feature (415)..(415): n is a, c, g, or t
  modified_base (423)..(423): a, c, t, g, unknown or other
  misc_feature (423)..(423): n is a, c, g, or t
  modified_base (432)..(432): a, c, t, g, unknown or other
  misc_feature (432)..(432): n is a, c, g, or t
  modified_base (435)..(435): a, c, t, g, unknown or other
  misc_feature (435)..(435): n is a, c, g, or t
  modified_base (454)..(454): a, c, t, g, unknown or other
  misc_feature (454)..(454): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcctctggattcaccttcagtagctatggcatgctacgtggggtccnccaggctccgagggccaaggggctaggggaggtggggtgccctagttatagtctaatatggatgggaaaataaataaatctatgacagactcggtgaacgggctatcacntctcaganacatccaanacncgactgatctagcaaatanacagacgtacgagagacgacggacggacgtacggtacgtacgtaagtacgttacgtcggtacggacggtacggtacggtacg

SEQ ID NO: 321109 - DNA, 595 bp, Homo sapiens
  misc_feature: GZ8MTXP02FOXDN.19.13.B02.1.454.CMB.2.raw
  modified_base (264)..(264): a, c, t, g, unknown or other
  misc_feature (264)..(264): n is a, c, g, or t
  modified_base (311)..(311): a, c, t, g, unknown or other
  misc_feature (311)..(311): n is a, c, g, or t
  modified_base (372)..(372): a, c, t, g, unknown or other
  misc_feature (372)..(372): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgagactctcctgtgcagcctntggacttcaccttcagtagctagtggcatcgctacgtcggggtcccnccgagggcctaccggagggaccgaagggggtcctggggaggtggggtggacctaggtttanatctatagtgagtaggaaattaaataaatctatgacagactccgtagaacgggcgtattacacctagtacctaccaagacgaacaaacttaccaaacgaacacgtactagtactacgtagaacaaagtacgaaacacgtacctaggacgagtacgtaggacggaccgtaacggtcgttaggtaagttaagttacgtggtacggacggtacgggtacggttaag

SEQ ID NO: 321110 - DNA, 582 bp, Homo sapiens
  misc_feature: GZ8MTXP02GJ126.19.13.B02.1.454.CMB.2.raw
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcctctggcttcaccttcagtagctatggcatgcacgtgggtcccgccaggcctccgagggcgaaggggctgggagtggggtgccgagttatatcatatggagtagggaaagttaaactaaattactataggacagtaccgttaccggtaggaacggggccgtaattacccgacctactacctaccagaacgaactaaacttaccgaaacgtaacacgacttagtactctacgacaaatacgaacacgtactaggagacgacgtaggacggtacgacggtcgtagtaagttacgttacgtcgtaggtaccgagggtacgtaagg

SEQ ID NO: 321111 - DNA, 569 bp, Homo sapiens
  misc_feature: GZ8MTXP02GJMNW.19.13.B02.1.454.CMB.2.raw
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggaggtccctgagactctcctgtgcagcctctggacttcaccttcagtagctatggcatgcacgtggggtccgccaggcctccgagggccgaagggggtctggggaggtggggtggcccgtagtttatatcaagttagtgagtaggaaaattaaataaaatctaatgacagactccggtagacgggcattacaccatcctacagagacaactaccaagaacacgctagtactctagactaaatacgaaacacgaccgtagacggagacgtagggacggacgaccggtcgttaggttaacgttagttacgtggtacggacggtaaggtcggttaag

SEQ ID NO: 321112 - DNA, 874 bp, Homo sapiens
  misc_feature: GZ8MTXP02IZC4M.19.13.B02.1.454.CMB.2.raw
  modified_base (288)..(288): a, c, t, g, unknown or other
  misc_feature (288)..(288): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagcgtggtggagtcggtgggggaggtcggtggtccgaggccgtggggacggtccctaggacgtactcctccgtggtcgcacggtcccttgnggtacttccaacctttcgaagttacgacctagtcggactagttcgacctacggttccgggggtccccaccccgaaggggtcccctaccccggaagggaccgggtaaacgggggtcctagggggtagggttgggggtacggaccgttaaaggtttacttaacgtactaaattaacgttggtaaggttagggggtaaaaaagtttaaaattaaaaaccgttaactaagttacggaacccgaaagtaacccgttacccgggttaaaggggaaccggggtaacccggtaagtttacccaaacccccgtaagtttccctaaacccgtaaagggaaaaccgttaaaactaaaaccctttaaacccaaaaacgggtaaaacccacccgggttacgttaacgttaaacgttccgtaaacgtaaacgtaaaacgtaaacgtaaaccgtaaacgtaaccgtaacggtaaacggtaaacggtaacggtaacgggtaaacgggtaaccggtaaaccgggtaaccggttacggtttaacggtttaaacgtttaacggttacgggttacgggtacgggtaacgggggtaacgggtaacgg

SEQ ID NO: 321113 - DNA, 553 bp, Homo sapiens
  misc_feature: GZ8MTXP02GZN1Z.19.13.B02.1.454.CMB.2.raw
  modified_base (305)..(305): a, c, t, g, unknown or other
  misc_feature (305)..(305): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcctctggattcaccttcagtagctatggcatgcacgtggggtcccnccaggctccgagggcaaggggctgggagtggggtgccagttatatcatagtgagtagggaaataaactaaatactatgacagactccgtagaacggcgattcaccatctacagagacattaccaaagtaacacgctagtactactagacaaatacgaaacacgtaccgtagacggacgtccgtaggaacggaacgacggtacgttgtaagttacgtttaacgtggtacggacggtagggacggttaag

SEQ ID NO: 321114 - DNA, 620 bp, Homo sapiens
  misc_feature: GZ8MTXP02H4R70.19.13.B02.1.454.CMB.2.raw
  modified_base (319)..(319): a, c, t, g, unknown or other
  misc_feature (319)..(319): n is a, c, g, or t
  modified_base (432)..(432): a, c, t, g, unknown or other
  misc_feature (432)..(432): n is a, c, g, or t
  modified_base (443)..(443): a, c, t, g, unknown or other
  misc_feature (443)..(443): n is a, c, g, or t
  modified_base (509)..(509): a, c, t, g, unknown or other
  misc_feature (509)..(509): n is a, c, g, or t
  modified_base (588)..(588): a, c, t, g, unknown or other
  misc_feature (588)..(588): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggaggcggtggtccagccgtggggacggtccctggacgacttctccgtgtgcagccctgtggacttccaccttcagtagctatggcatgcacgtgggccccncaggcctccgaggcgaaggggctgggaggtggggtgcctagttatagtcatagtgagtagggaaattaaataaactactatgacagtacctcgtagaacgggcagttacaccntccaccaaganaactaacttaccgaaaagtaccgaactccttagtactccgttagaaacgaaaattacggaaaaccncggtaaccgtacggaacggtacggtcgaacgggaaccgtaaccggtacggttcgtaggttaacgttaacgtttaccggngggtacggtacggggtacgggtaacggttaag

SEQ ID NO: 321115 - DNA, 537 bp, Homo sapiens
  misc_feature: GZ8MTXP02GGUVS.19.13.B02.1.454.CMB.2.raw
  modified_base (301)..(301): a, c, t, g, unknown or other
  misc_feature (301)..(301): n is a, c, g, or t
  modified_base (343)..(343): a, c, t, g, unknown or other
  misc_feature (343)..(343): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggagtccctgagctctcctgtgcagcctctggattcaccttcagtagctatggcatgcacgtgggtccnccaggcctccgaggcaaggggctggagtggggtgccagttanatcatatgatggaaagtaaataaatactagtgacaagactccggtagaaacgggcccgtaattaccacctatcctaccgaagacgaaactaaacttaccaaagtaacacgtactagtactctagacaaatgaaacagcctagagagctaggacggacacggtctagtgttagtactggtgcggaaggtcgtaag

SEQ ID NO: 321116 - DNA, 506 bp, Homo sapiens
  misc_feature: GZ8MTXP02FP6VD.19.13.B02.1.454.CMB.2.raw
  modified_base (303)..(303): a, c, t, g, unknown or other
  misc_feature (303)..(303): n is a, c, g, or t
  modified_base (346)..(346): a, c, t, g, unknown or other
  misc_feature (346)..(346): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggaggtccctgagactctcctgtgcagcctctggattcaccttcagtagctatggcatgcactgggtcccnccaggctccgagggcaaggggctggagtggggtggccagttanatcatatgagtggaaagtaaataaatactaatgacaagactcccggtgaagggccgaattcaccatctccagagacaatccaagaacagctagtatctgacaaatgaacagcctagagagctggacggacacggctgtgtatactgcgtcgaggcggtaa

SEQ ID NO: 321117 - DNA, 596 bp, Homo sapiens
  misc_feature: GZ8MTXP02I1Z6G.19.13.B02.1.454.CMB.2.raw
  modified_base (264)..(264): a, c, t, g, unknown or other
  misc_feature (264)..(264): n is a, c, g, or t
  modified_base (306)..(306): a, c, t, g, unknown or other
  misc_feature (306)..(306): n is a, c, g, or t
  modified_base (484)..(484): a, c, t, g, unknown or other
  misc_feature (484)..(484): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcctcnggattccaccttcagtagctatggcatgcacgtcggggtccnccgagggtcctccgagggccgtaaagggggcctaggggacggtggggtggacccgtaggtttatagtcatagtgagtggtaaacgtaaattaaaatactatgacagtacgtccgtgaacggccgaattacaccatcctaccagacgaacaaattaccaaagtaacacgtactagtacncgttagactaaaatcgaaacgacgaccgtagaacggagtaccgtaggacgaaccgaacggtccgtaggttaacgttagttacgtaggtacggacggtagggacggttaacgg

SEQ ID NO: 321118 - DNA, 546 bp, Homo sapiens
  misc_feature: GZ8MTXP02G58GB.19.13.B02.1.454.CMB.2.raw
  modified_base (310)..(310): a, c, t, g, unknown or other
  misc_feature (310)..(310): n is a, c, g, or t
  modified_base (356)..(356): a, c, t, g, unknown or other
  misc_feature (356)..(356): n is a, c, g, or t
  modified_base (389)..(389): a, c, t, g, unknown or other
  misc_feature (389)..(389): n is a, c, g, or t
  modified_base (469)..(469): a, c, t, g, unknown or other
  misc_feature (469)..(469): n is a, c, g, or t
  modified_base (475)..(475): a, c, t, g, unknown or other
  misc_feature (475)..(475): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggacgtccctgagactctcctgtcgcagcctctggacttccaccttcagtagctatggcatgctacgtgggtcccncgaggcctccgagggcgaaggggctggaggtggggtcgctagttanatcataatgatagggaaataaataaactactancgtcagacgtcgtagaacgggcaagttcaccactctaccagacgaactaaattaccaaacgaacacgctagtactcgtanaacaanagaacacgacacgagagacgagacgacgacgtacgtagtaagtacgtacgtcgtagacgacggtacgtacg

SEQ ID NO: 321119 - DNA, 611 bp, Homo sapiens
  misc_feature: GZ8MTXP02JDYLB.19.13.B02.1.454.CMB.2.raw
  modified_base (258)..(258): a, c, t, g, unknown or other
  misc_feature (258)..(258): n is a, c, g, or t
  modified_base (267)..(267): a, c, t, g, unknown or other
  misc_feature (267)..(267): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgagctctcctgtgcngcctctggnttccaccttcagtagctatggcatcgcacgtcgggtcccgccgaggccgtccgagggccgaaagggggcgtggggagtggggtggcctagttatatcatatgagtaggtaaagtaaataaaatactatgacaagtacgtaccggtagtaacgggacctacgttaccacctaactccgtacccaaggaacgaaacgtaaacttaccaaacgaaacacgtactagtactcgtacgaactaaaatacggaaaccagaccgttagaacggacgaccgtacggaggaccgaaccggtcgttaggtaacgttaacttacgttgggtacgaccggtaggggtacgtaacgg

SEQ ID NO: 321120 - DNA, 504 bp, Homo sapiens
  misc_feature: GZ8MTXP02FKN1A.19.13.B02.1.454.CMB.2.raw
  modified_base (304)..(304): a, c, t, g, unknown or other
  misc_feature (304)..(304): n is a, c, g, or t
  modified_base (342)..(342): a, c, t, g, unknown or other
  misc_feature (342)..(342): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtagctatggcatgcactgggtcccncaggctccaggcaaggggctggagtgggtgccagttanatcatatgatgggaaataaataaatactatgacagactccgtgaagggcatcaccatctcagagacaattccaaagacacgctagtatctagacaaatgaaacagacctagagagctagacggacgacggctgtaagtattacgtggtgcggaggcggtaag

SEQ ID NO: 321121 - DNA, 633 bp, Homo sapiens
  misc_feature: GZ8MTXP02JMV1I.19.13.B02.1.454.CMB.2.raw
  modified_base (266)..(266): a, c, t, g, unknown or other
  misc_feature (266)..(266): n is a, c, g, or t
  modified_base (309)..(309): a, c, t, g, unknown or other
  misc_feature (309)..(309): n is a, c, g, or t
  modified_base (346)..(346): a, c, t, g, unknown or other
  misc_feature (346)..(346): n is a, c, g, or t
  modified_base (364)..(364): a, c, t, g, unknown or other
  misc_feature (364)..(364): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagccgtgggacgtccctgagactctcctgtgcagcctntggattcaccttcagtagctatggcagtgcacgtggggtcccnccgaggcctcgaggccgaaggggctagggaggtgggngcctagttatatcatagngagtaggaaattaaataaatactagtgacgaagtaccgtaccggtaggaacgggcccgtaataccacccgtaatccctaccgagaacaccgtaaacttaccaaaacgaccacgtcgtaacgtaccctagaactaaacgtacgaaccgtaagtcccgaaggagaaccggcgtaacgggaaacggtaaccgccgggtacttaggtttaacgttaagtttaaccggttggttacccgggaggtaacgggggttaccggtaaagttacccggg

SEQ ID NO: 321122 - DNA, 551 bp, Homo sapiens
  misc_feature: GZ8MTXP02I53F7.19.13.B02.1.454.CMB.2.raw
  modified_base (301)..(301): a, c, t, g, unknown or other
  misc_feature (301)..(301): n is a, c, g, or t
  modified_base (351)..(351): a, c, t, g, unknown or other
  misc_feature (351)..(351): n is a, c, g, or t
  modified_base (442)..(442): a, c, t, g, unknown or other
  misc_feature (442)..(442): n is a, c, g, or t
  modified_base (506)..(506): a, c, t, g, unknown or other
  misc_feature (506)..(506): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggttcagcctgggagtccctgagctctcctgtgcagcctctggattcacttcagtagctatgcatgcacgtgggtcccnccaggcctccagggcaaggggctgggagtggggtgccagttatatcatangagtggaaagtaaataaatctaatgacagactccgtagaagggcattcaccatcctaccagacgaactaacttaccaaacgtaacaccgtntagtactctagacaaaagtcgaaacacgcctaaggacgacgtacgtaggaacggacgaaccggnttaggtaagttagttaacgtcggtagacggtagggacggttaaag

SEQ ID NO: 321123 - DNA, 571 bp, Homo sapiens
  misc_feature: GZ8MTXP02HBRYZ.19.13.B02.1.454.CMB.2.raw
  modified_base (264)..(264): a, c, t, g, unknown or other
  misc_feature (264)..(264): n is a, c, g, or t
  modified_base (307)..(307): a, c, t, g, unknown or other
  misc_feature (307)..(307): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgagactctcctgtgcagcctnggattccaccttcagtagctatggcatgctacgtggggtcccnccaggcctccgagggcgaaggggctggggagtggggtgcctagttatatcattagtgagtagggaaaattaaactaaagttactatagacagaccgtccggtagaacgggcctattaccgacctactcctaccgagaacgaactaacttaaccaaacgaacaccgtctagtactactagactaaagtagaacagcctagacgagcgtaggacggacgacggtctagtaagttacttacgtggtcggacggtacggtacgtaacg

SEQ ID NO: 321124 - DNA, 709 bp, Homo sapiens
  misc_feature: GZ8MTXP02HSE5A.19.13.B02.1.454.CMB.2.raw
  modified_base (291)..(291): a, c, t, g, unknown or other
  misc_feature (291)..(291): n is a, c, g, or t
  modified_base (313)..(313): a, c, t, g, unknown or other
  misc_feature (313)..(313): n is a, c, g, or t
  modified_base (371)..(371): a, c, t, g, unknown or other
  misc_feature (371)..(371): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcggtgggggagcggtggtccaggccgtgggacgtccctgacacttctcctgtcgcagcctcgtgattccaccttcagtanctagtgcatgcacgtcggcccncgaggcctaccgagggcgaaggggcgtagggaggtggggtcggcctaagtttaatatnaattagtaggataagggtaaaataaacttaaaatacgtaagtgacccgaaagtaccgtaccggtaaggaaccggggtacccgtaacttaccaaacccctaattcccgtaacccgtaaaggaaacgaaaaccctaaaacgtttaacccaaaaacgggaaaacccttaaacggcccttaaggttaaaccgttaacgtaacgtaaaacgtaaaacgtacgaaaaccgaacggtaccgtaaggaaacggacggaccggtaacgggaaacggaccggtacggtacgttaggttaacgtttaacgttacggtacgggacggtacggtaacgggtaacggtaacg

SEQ ID NO: 321125 - DNA, 583 bp, Homo sapiens
  misc_feature: GZ8MTXP02JTDLM.19.13.B02.1.454.CMB.2.raw
  modified_base (279)..(279): a, c, t, g, unknown or other
  misc_feature (279)..(279): n is a, c, g, or t
  modified_base (309)..(309): a, c, t, g, unknown or other
  misc_feature (309)..(309): n is a, c, g, or t
  modified_base (359)..(359): a, c, t, g, unknown or other
  misc_feature (359)..(359): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggacgtccctgagactctcctgtgcagcctctggacttcaccttnagtagctatggcatgcacgtcggggtcccnccaggcctccgagggcgaaggggctggggaggtggggtgaccgtagttanatcatagtgatagggaaagttaaataaatactaatcgacaagtaccgtaccggtaggaaacggggtccctaagttacccaaccgtacttccgtaccgaagacgaaactaacttacccgaaaagaccaacgtccttagtatcgtacgaactaaactgaaacagacctagacgtagcgtaggacggacgacggctgtaacgttatacgtgtgacggacggcgtaag

SEQ ID NO: 321126 - DNA, 534 bp, Homo sapiens
  misc_feature: GZ8MTXP02I1VPD.19.13.B02.1.454.CMB.2.raw
  modified_base (304)..(304): a, c, t, g, unknown or other
  misc_feature (304)..(304): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggaggtccctgagactctcctgtgcagcctctggattcaccttcagtagctatggcatgcacgtgggtccnccaggctccgagggcaaggggctgggagtggggtgcctagttatatcatatgatggaaataataaatctatgcagactcgtgaagggcgatcaccatctaccagacgacaaacttaccaaagaacacgtctagtactctagacaaaatgaaacacgccgtagagagcgtaggaacggacgaacggcttaggtaagttacttacgtagtacggacggtagggacggttaag

SEQ ID NO: 321127 - DNA, 600 bp, Homo sapiens
  misc_feature: GZ8MTXP02ISD6V.19.13.B02.1.454.CMB.2.raw
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcggtggtccagccgtgggacgtccctgagctctcctgtgcagcctctggattcaccttcagtagctatggcatgcacgtggcccgcaggctccgaggcgaaggggctgggaggtggggtgacctagttatatcatatgagtaggaaagttaaataaatactagtgacagactcgtagaacgggcagttacacctatctaccagacgaataaacttaccaaaacgtaacaccgtacttacgttactacttacggaaccaaaagttacgaaaccgacgtaaccgttacggaagacggtacgttacggaacggtaccgaacggtccgttaggttaagttaacgtttacgtagggtacggtaccggagggttacgggttaaacgg

SEQ ID NO: 321128 - DNA, 564 bp, Homo sapiens
  misc_feature: GZ8MTXP02IDFDI.19.13.B02.1.454.CMB.2.raw
  modified_base (269)..(269): a, c, t, g, unknown or other
  misc_feature (269)..(269): n is a, c, g, or t
  modified_base (308)..(308): a, c, t, g, unknown or other
  misc_feature (308)..(308): n is a, c, g, or t
  modified_base (352)..(352): a, c, t, g, unknown or other
  misc_feature (352)..(352): n is a, c, g, or t
  modified_base (354)..(354): a, c, t, g, unknown or other
  misc_feature (354)..(354): n is a, c, g, or t
  modified_base (359)..(359): a, c, t, g, unknown or other
  misc_feature (359)..(359): n is a, c, g, or t
  modified_base (383)..(383): a, c, t, g, unknown or other
  misc_feature (383)..(383): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggaggtccctgacgactctcctgtgcagccctcnggattcaccttcagtagctatggcatgcacgtggtcccnccaggcctcgagggcaaggggctgggagtggggtgcctagttanancatangatgggaaataataaaatactatnacagtactccgtagaacgggccctaagttaccaactataccctaccgagaacgaaacctaacttacccaaagtaacacgtactagtatactagaactaaagtagaacacgacctagagagactagggacgaccgacgggtctaggtaagttacttacgttggcgacggtaggtacggtaag

SEQ ID NO: 321129 - DNA, 548 bp, Homo sapiens
  misc_feature: GZ8MTXP02GJM5H.19.13.B02.1.454.CMB.2.raw
  modified_base (471)..(471): a, c, t, g, unknown or other
  misc_feature (471)..(471): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtgggtccagcctggggaggtccctgagactctcctgtgcagcctctggattcaccttcagtagctatggcatgcacgtggggtcccgcaggctccgaggcaaggggctgggagtggggtgcctagttatatcgatatgataggaaagtaaataaaatactatgacagactccgtagaagggccgattccacctatcctacagagaacaaattaccaaagacacgctagtactctagactaaatcgaaanacgcctagagagcgtaggagaaccgacggtacttaggtaagttaattacgtggtgggacgtaacggggtcgttaagg

SEQ ID NO: 321130 - DNA, 605 bp, Homo sapiens
  misc_feature: GZ8MTXP02J2P07.19.13.B02.1.454.CMB.2.raw
  modified_base (280)..(280): a, c, t, g, unknown or other
  misc_feature (280)..(280): n is a, c, g, or t
  modified_base (306)..(306): a, c, t, g, unknown or other
  misc_feature (306)..(306): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccagccgtgggacgtccctgacgctctcctgtgcagcctctggattcaccttnagtagctatggcatgcactgggtccnccgaggctcccgagggcaaggggctgggaggtggggtgcctaggttactagtcagtatgatagggaaattaaataaagtactatgacagtacgtccgtaggaacgggccgtaatccaacactctacccgagacgaactaaactaccaaagaacccacgtaccgtagtacttacgtacgaaacctaaatacggaaacacggtacctaggacggagaccggtaggaacggacgtaccggtacgttaggtaaggttaaacttaccggttggtacggacgggtaacgggtaccggtttaacgg

SEQ ID NO: 321131 - DNA, 613 bp, Homo sapiens
  misc_feature: GZ8MTXP02HH7CE.19.13.B02.1.454.CMB.2.raw
  modified_base (264)..(264): a, c, t, g, unknown or other
  misc_feature (264)..(264): n is a, c, g, or t
  modified_base (277)..(277): a, c, t, g, unknown or other
  misc_feature (277)..(277): n is a, c, g, or t
  modified_base (308)..(308): a, c, t, g, unknown or other
  misc_feature (308)..(308): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggacgtccctgagctctcctgtgcagcctntggattcaccttnagtagctagtggcatgctacgtggggtcccnccaggcctaccgagggcaaggggctggggagtggggtgacctagttatagtcatagtgagtgggtaaaataataaatactatcgacaagtacgtccggtagaacggggtcctaattccaccgtataccgtaccgaagaacgaaactaaacttaccgaaaacgtaaccacggtacctagtactaccgtagaacctaaaagttcgaaacgtacgacccgtaaggacgacgtacgtacggaacggaacgtacggtcgttaggtaagtttaacgttaccgtggtacggaccggtagggtacgttaacgg

SEQ ID NO: 321132 - DNA, 594 bp, Homo sapiens
  misc_feature: GZ8MTXP02IFLVM.19.13.B02.1.454.CMB.2.raw
  modified_base (196)..(196): a, c, t, g, unknown or other
  misc_feature (196)..(196): n is a, c, g, or t
  modified_base (262)..(262): a, c, t, g, unknown or other
  misc_feature (262)..(262): n is a, c, g, or t
  modified_base (305)..(305): a, c, t, g, unknown or other
  misc_feature (305)..(305): n is a, c, g, or t
  modified_base (354)..(354): a, c, t, g, unknown or other
  misc_feature (354)..(354): n is a, c, g, or t
  modified_base (570)..(570): a, c, t, g, unknown or other
  misc_feature (570)..(570): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtncagctggtggagtcgtgggggagcgtggtccagccgtgggagtccctgagctctctgtgcagcctntggattcaccttcagtagctatggcatgcacgtcggggtcccnccgaggcctccgagggcgaaggggctggggagtggggtgcctagtttanatcaattagtgatagggaaattaaataaaatactatcgacagtactccggtaggaacgggccgtaattaccgaacctatacctaccgagaacgaacctaaacttaccaaaaggtaaccacgtctagtatactagaactaaaatacgaaacacgacctaggaaacgtacgaccgtagggaacggtaccacggtctagggttaacttaacgtttacgnggtaggaccggtaggtacggtaag

SEQ ID NO: 321133 - DNA, 646 bp, Homo sapiens
  misc_feature: GZ8MTXP02IUSP6.19.13.B02.1.454.CMB.2.raw
  modified_base (252)..(252): a, c, t, g, unknown or other
  misc_feature (252)..(252): n is a, c, g, or t
  modified_base (262)..(262): a, c, t, g, unknown or other
  misc_feature (262)..(262): n is a, c, g, or t
  modified_base (266)..(266): a, c, t, g, unknown or other
  misc_feature (266)..(266): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtcctgagctctccngtgcagcctntggnttcaccttcagtagctagtggcatcgctacgtcggggtcccgccagggcctccgagggcgaaggggctgggaggtggggcgctagttatagtcagtatgatagggaaaattaaagtaaaatctaagtgactaaagtactaccggtaggaaacgggcctaagttccaaacctgtacctacccgaaagaacgtaaacctaaacgttaacccgaaaacgtaaaccgtacggtcttaacgtaagttacccgtaagtaaccaaaaagttcgaaaaccgcgtaccctagggaacgacggtacgtagggaaacgggtaccgaaccgggtcttaggtaacgttaagttacgttacgggtaggaccggtacggggtaccggtttaaagg

SEQ ID NO: 321134 - DNA, 612 bp, Homo sapiens
  misc_feature: GZ8MTXP02GNCJJ.19.13.B02.1.454.CMB.2.raw
  modified_base (306)..(306): a, c, t, g, unknown or other
  misc_feature (306)..(306): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgagactctcctgtgcagcctcgtggattcaccttcagtagctatggcatgcacgtgggtcccnccaggcctccgagggcgaaggggctagggaggtggggtgccagtttactatcgattagtgtagtaggaaaagttaaaactaaaagttctaagtcgacaagaaccgttacccggtaggaacggggtaccctaattccaaccctactccgtacccgaagacgaactaaacttacccgaaagaaccacggtactagtactcgagtaacaaaatcgaaaccgagtacctaggagagccgtaggaaccggtaacgacccggtgttaggtaagttaacgttacgtaggtcggaccggtagggtacggttaag

SEQ ID NO: 321135 - DNA, 608 bp, Homo sapiens
  misc_feature: GZ8MTXP02GTLRN.19.13.B02.1.454.CMB.2.raw
  modified_base (266)..(266): a, c, t, g, unknown or other
  misc_feature (266)..(266): n is a, c, g, or t
  modified_base (310)..(310): a, c, t, g, unknown or other
  misc_feature (310)..(310): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggaggtccctgagactctcctgtgcagcctntggattccaccttcagtagctagtggcatgcacgtggggtcccnccgaggcctccgagggcgaaggggctgggaggtggggtgcctaggttatatcatagtgtagtaggaaagttaaataaactacgtagcgactacgtaccttaccggtagggaacgggtccgtaacttaccgacctaactcctacgaacgaacgtaaactaacttaaccgaaacgtaacacgtacgtatactctagaactaaagacgaaacgacgacgtaggaacgaggtacaacgggaacgaccgaacggtcgttaggtaacgttaagttacgtggacggtacggtacgggtagtaacg

SEQ ID NO: 321136 - DNA, 625 bp, Homo sapiens
  misc_feature: GZ8MTXP02FWCEP.19.13.B02.1.454.CMB.2.raw
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggacgtccctgagactctcctgtgcagcctctggacttcaccttcagtagctagtggacatgctacgtggggtcccgccgaggtcctaccgagggaccgaagggggctaggggaggtggggtggccctaaggttatatcaatagtagtagtagggaaaagttaaattaaaacgtacttagtcgacgtaagacgttacccggtaggaaacgggccgtaattaccaccgtatcctacgaagaagaactaactaaccgaaagtaaccacggtactagtactactacgaactaaagtacgaaacgtacgcctaggacgaacgtccgtaagggacggtaccgaccggtcgttaggtaagttaacgttacgtggtacggacggtaggtacggtaacg

SEQ ID NO: 321137 - DNA, 544 bp, Homo sapiens
  misc_feature: GZ8MTXP02GRKKV.19.13.B02.1.454.CMB.2.raw
  modified_base (196)..(196): a, c, t, g, unknown or other
  misc_feature (196)..(196): n is a, c, g, or t
  modified_base (262)..(262): a, c, t, g, unknown or other
  misc_feature (262)..(262): n is a, c, g, or t
  modified_base (302)..(302): a, c, t, g, unknown or other
  misc_feature (302)..(302): n is a, c, g, or t
  modified_base (511)..(511): a, c, t, g, unknown or other
  misc_feature (511)..(511): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtncagctggtggagtcgtgggggagcgtggtccagcctgggagtccctgagctctcctgtgcagcctntggattcaccttcagtagctatggcatgcacgtgggtccnccaggcctccgagggccaaggggctgggaggtggggtggcctaggttatatcatatgatagggaaagttaaataaaatactatcgacagtactccggtagaacgggccgattcgacctatctaccagacgaactaattaccaaagaacaccgactagtaactctacgaacaaagtacaacgagcctagagagctaggacgacgacggtntgtaagtacgtacgtgcgacggacggtacgtag

SEQ ID NO: 321138 - DNA, 596 bp, Homo sapiens
  misc_feature: GZ8MTXP02FQD8N.19.13.B02.1.454.CMB.2.raw
  modified_base (178)..(178): a, c, t, g, unknown or other
  misc_feature (178)..(178): n is a, c, g, or t
  modified_base (307)..(307): a, c, t, g, unknown or other
  misc_feature (307)..(307): n is a, c, g, or t
  modified_base (342)..(342): a, c, t, g, unknown or other
  misc_feature (342)..(342): n is a, c, g, or t
  modified_base (353)..(353): a, c, t, g, unknown or other
  misc_feature (353)..(353): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagnggtgtccagtgtcaggtgcagctggtggagtcgtgggggagcgtggtccagcctgggacgtccctgacgctctctgtgcagcctctggtattcaccttcagtagctatggcagtgcacgtcgggtcccncgaggcctccgagggcgaaggggctgggagtgggngacctagttanatcgatagtgagtaggaaattaaataaatcgtaatcgacaagtaccgtccggtaggaacgggtacctattaccacctatcctacgagaacgtaaacctaacgtaccgaaacgaacaaccgtcgttagtacttacgtagaacctaaaagtacgaaacgacgtacctaaggacgagacgtaggacggacgtaccggtgttacgtaagttactacgttaggtacggacggtacgggtacggtaacg

SEQ ID NO: 321139 - DNA, 585 bp, Homo sapiens
  misc_feature: GZ8MTXP02FYHZL.19.13.B02.1.454.CMB.2.raw
  modified_base (264)..(264): a, c, t, g, unknown or other
  misc_feature (264)..(264): n is a, c, g, or t
  modified_base (306)..(306): a, c, t, g, unknown or other
  misc_feature (306)..(306): n is a, c, g, or t
  modified_base (363)..(363): a, c, t, g, unknown or other
  misc_feature (363)..(363): n is a, c, g, or t
  modified_base (499)..(499): a, c, t, g, unknown or other
  misc_feature (499)..(499): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctggggagtccctgagctctcctgtgcagcctcnggattcaccttcagtagctatggcatgcacgtcggggtcccnccgaggcctccgagggcgaaggggctggggaggtggggtgcctagttacagtcatangagtagggaaattaaaataaactactaatcgactagacgtccggtaggaacgggtacccgattaccacctactcctaccgaagagaaacctaaacttaccaaacggaaccacgtactagtacttcacgactaaaanacgaaacacgacgtagagacgcgtaggacgacgacgtacgttagtaagttacttacgtacggtacggacggtacggtacggtaacg

SEQ ID NO: 321140 - DNA, 596 bp, Homo sapiens
  misc_feature: GZ8MTXP02HV0EY.19.13.B02.1.454.CMB.2.raw
  modified_base (260)..(260): a, c, t, g, unknown or other
  misc_feature (260)..(260): n is a, c, g, or t
  modified_base (268)..(268): a, c, t, g, unknown or other
  misc_feature (268)..(268): n is a, c, g, or t
  modified_base (278)..(278): a, c, t, g, unknown or other
  misc_feature (278)..(278): n is a, c, g, or t
  modified_base (548)..(548): a, c, t, g, unknown or other
  misc_feature (548)..(548): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtggagtcgtgggggaggcgtggtccagccgtgggacggtccctgagactctcctgngcagcctnggatcacctnagtagctagtggcatgctacgtcggggtcccgccgaggcctacgagggcggaaggggcgtagggaggtggggtggaccgtaggtttatatcaatatagagtagggtaaataaataatatatgacagtactcggtagagggaccagttacaccactccaccgagaacgactaattacccgaagtaacgacgtctagtactcgtactacgaaacgtacgaacgtaacgccgtaggaacggtaacgtcgacgggaacggacgaacgggtccgnggttaacgttacgttaacgtggttacggaccggaggggtacggtaacg

SEQ ID NO: 321141 - DNA, 585 bp, Homo sapiens
  misc_feature: GZ8MTXP02HYGEM.19.13.B02.1.454.CMB.2.raw
  modified_base (307)..(307): a, c, t, g, unknown or other
  misc_feature (307)..(307): n is a, c, g, or t
  modified_base (350)..(350): a, c, t, g, unknown or other
  misc_feature (350)..(350): n is a, c, g, or t
  modified_base (358)..(358): a, c, t, g, unknown or other
  misc_feature (358)..(358): n is a, c, g, or t
  modified_base (360)..(360): a, c, t, g, unknown or other
  misc_feature (360)..(360): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcacgcctctggacttcaccttcagtagctatggcatgcacgtcgggtcccncaggcctcgaggcgaaggggctgggaggtgggtgcctagttanatcatagngntagggaaataaataaatactatgacgagactccggtaggaacgggaccgtattacacctactcctaccagaacgaactaaacgttaccaaacggaaacaccggtacttacgtaactctagaacaaaagttacgaaacacgtaccgtaggaacggacgacgtaggaacggaccgacgggtctaggttaagtactttaacgtggtacggacgggtaggtacggtaag

SEQ ID NO: 321142 - DNA, 659 bp, Homo sapiens
  misc_feature: GZ8MTXP02GW2FH.19.13.B02.1.454.CMB.2.raw
  modified_base (316)..(316): a, c, t, g, unknown or other
  misc_feature (316)..(316): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctgggtggagtcgtgggggaggcgtggtccagcctggggacgtccctgacgactctcctgtcgcacgcctgtggacttcaccttcagtagctagtggcatgctacgtcggggtcccnccgaggcctaccgaggccggaagggggcttaggggagtggggtggacccgtagttactatctaattagtagtagtagggaaaattaaactaaatactaatgacaagtacgtccggtagaacgggtccgtaacttaccgacctactacctaccgaaggtaaccaaactaaacttacccgaaaacgtaaccaacggtacttaacgtacttaccgtaggaacctaaaagtacggaaacaacgacccgtaggaacgtaggaccgtaagggaacggtaccgaacggtcgtttaggaagttttaaccgttaacgtcgggtaggaccgggtacgggtacggtttaaacgg

SEQ ID NO: 321143 - DNA, 577 bp, Homo sapiens
  misc_feature: GZ8MTXP02FMLH9.19.13.B02.1.454.CMB.2.raw
  modified_base (308)..(308): a, c, t, g, unknown or other
  misc_feature (308)..(308): n is a, c, g, or t
  modified_base (353)..(353): a, c, t, g, unknown or other
  misc_feature (353)..(353): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggaggtccctgagactctcctgtgcagcctctggattcaccttcagtagctatggcatgcacgtcggggtcccnccaggcctccgaggcgaaggggctgggagtggggtgcctagttanatcatatgagtggaaagttaaataaatactatgacagtactccggtagaacgggccgattcgacctagtcctaccgagacgaactaaacttaccaaaggaaccacgtacttagtactacgtacgaactaaaagtgaaaccagtaccctaggaggacgcgtaaggacggaacgtacggcttaggtaagttacttacgtaggtacggacgggtaggtacggttaag

SEQ ID NO: 321144 - DNA, 563 bp, Homo sapiens
  misc_feature: GZ8MTXP02IYKQQ.19.13.B02.1.454.CMB.2.raw
  modified_base (306)..(306): a, c, t, g, unknown or other
  misc_feature (306)..(306): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgagactctcctgtgcagcctctggattcaccttcagtagctatggcatgctacgtgggtcccnccaggcctccgagggccgaaggggctggggagtcggggtgccgtagttatatcaattagtgagtgggaaactaaataaatctaagtgacagactaccgtaggaacggccgtattaccaccatctaccgagacgaacaacttaccgaaagaacacgtacttagtactcgtagactaaacgtacgaaacgacgtaccagagacgacgtaggacggtacaacggtctagtaacgtatacgtgtacgacggaggacgtaag

SEQ ID NO: 321145 - DNA, 622 bp, Homo sapiens
  misc_feature: GZ8MTXP02HGWQO.19.13.B02.1.454.CMB.2.raw
  modified_base (308)..(308): a, c, t, g, unknown or other
  misc_feature (308)..(308): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggaggtccctgacgactctcctgtgcagcctctggattcaccttcagtagctatggcatgcacgtcgggtcccncaggcctccgagggcgaaggggctgggagtgggtgcctagtatatcatatgagtagggtaaaacgttaaattaaaagtactaagtcgactaacgacgtccggtaggaacgggtccgtaattccaacctaactcctaccgaagacgtaaacctaaacttaacccgaaagaaaccgtaccgtacgttagtactcgtagaacctaaaagtacgaaacgtacgtcccgtaaggaacgacggtaccgtagggaaacggaacgacggtccgttaggttaagttaacgttaccgtggtacggcggtaagggtacgttaagg

SEQ ID NO: 321146 - DNA, 568 bp, Homo sapiens
  misc_feature: GZ8MTXP02F73RY.19.13.B02.1.454.CMB.2.raw
  modified_base (178)..(178): a, c, t, g, unknown or other
  misc_feature (178)..(178): n is a, c, g, or t
  modified_base (355)..(355): a, c, t, g, unknown or other
  misc_feature (355)..(355): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagnggtgtccagtgtcaggtgcagctggtggagtcgtgggggagcgtggtccagcctgggagtccctgagctctcctgtgcagcctctggacttcaccttcagtagctatggcatgcacgtcgggtcccgccaggcctacgagggccgaaggggctggggaggtggggtgccgtagttanatcatatgatagggaaataaataaatctatgacaagtacgtaccggtaggaacgggccgtaattaccacctatacctaccgagtacaaactaacgttaccaaagtaaccacgtactagtaactcgtagaactaaagtgaacacgctagagagcgtaggacggaccgacgtcttaggtaagttacttacggtggtacggacggtagggcgtaag

SEQ ID NO: 321147 - DNA, 541 bp, Homo sapiens
  misc_feature: GZ8MTXP02G6LMN.19.13.B02.1.454.CMB.2.raw
  modified_base (305)..(305): a, c, t, g, unknown or other
  misc_feature (305)..(305): n is a, c, g, or t
  modified_base (423)..(423): a, c, t, g, unknown or other
  misc_feature (423)..(423): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcctctggattcaccttcagtagctatggcatgcacgtggggtcccnccaggcctccgagggccaagggggctgggagtggggtggcctagttatatcattatgagttagggaaagtaaataaatactaatgacagactccggtagaagggccgattcaccatcnccagacgacaattaccaagaacacgctagtatctagacaaatcgaaacacgacctaggacgagcgtaggacggacgacggtctagtaagtacttacgtggtcgacggacggtacgtag

SEQ ID NO: 321148 - DNA, 642 bp, Homo sapiens
  misc_feature: GZ8MTXP02IEF0S.19.13.B02.1.454.CMB.2.raw
  modified_base (307)..(307): a, c, t, g, unknown or other
  misc_feature (307)..(307): n is a, c, g, or t
  modified_base (369)..(369): a, c, t, g, unknown or other
  misc_feature (369)..(369): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaggctggtggagtcgtgggggaggcgtggtccagcctgggacgtccctgagactctcctgtgcagcctctggattcaccttcagtagctatggcatgcacgtgggtcccnccgaggcctccgagggcgaaggggctaggggaggtggggtgccctagtttatagtcattagngtagttagggaaagttaaaataaattacgtaatcggacaacggtactacccggtagaacggggtacctacttacgaccctagtccctaccgaacgaagtaaacctaaacgttaacccaaacggaacctaccggtacgttaacgtactaccttaggaactaaaacgttcggaaaccaacggcccgtaaggaagacgtacggtaggaacggtaacgaaccggtcgttaggtaacgttaacgttacggttggtacggaccggtaggtacggttaag

SEQ ID NO: 321149 - DNA, 563 bp, Homo sapiens
  misc_feature: GZ8MTXP02GK81N.19.13.B02.1.454.CMB.2.raw
  modified_base (264)..(264): a, c, t, g, unknown or other
  misc_feature (264)..(264): n is a, c, g, or t
  modified_base (302)..(302): a, c, t, g, unknown or other
  misc_feature (302)..(302): n is a, c, g, or t
  modified_base (459)..(459): a, c, t, g, unknown or other
  misc_feature (459)..(459): n is a, c, g, or t
  modified_base (466)..(466): a, c, t, g, unknown or other
  misc_feature (466)..(466): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggaggtccctgagactctcctgtgcagcctnggattcaccttcagtagctatggcatgcactgggtccnccaggctccaggcaaggggctggagtgggtgccagttatatcatatgatggaaagtaaataaatactatgacagactaccggtgaaacgggccgattcacctatcctaccagaacgaaccaaattaccgaaagtaaaccacgtactagtatacgtanactaaanacgaaacacgaccgtaggacgagacgtacggaacggaaccgaacgtacgttagtaagttaacgttacgtcggtacggacggtacggggtacggtaag

SEQ ID NO: 321150 - DNA, 589 bp, Homo sapiens
  misc_feature: GZ8MTXP02I4E4E.19.13.B02.1.454.CMB.2.raw
  modified_base (178)..(178): a, c, t, g, unknown or other
  misc_feature (178)..(178): n is a, c, g, or t
  modified_base (264)..(264): a, c, t, g, unknown or other
  misc_feature (264)..(264): n is a, c, g, or t
  modified_base (303)..(303): a, c, t, g, unknown or other
  misc_feature (303)..(303): n is a, c, g, or t
  modified_base (347)..(347): a, c, t, g, unknown or other
  misc_feature (347)..(347): n is a, c, g, or t
  modified_base (354)..(354): a, c, t, g, unknown or other
  misc_feature (354)..(354): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagnggtgtccagtgtcaggtgcagctggtggagtcgtgggggagcgtggtccagcctgggacgtccctgagactctcctgtgcagcctntggattcaccttcagtgctatggcatgcacgtggtcccncaggcctcgagggcgaaggggctgggagtgggtcgactagttanatcatangagtaggaaagttaaataaatacgtatcgacaagacgtacccgtaggaaacgggccgtagttaccaccctatcctaccgaagtacgaaactaacttaccaaaacgaacctaccgtacgtacgttacttcgtacgaactaaaagtcgaaacacgtacctaggagacgaccgtaggaacggacgacggtacgttagttaagtagttacggtcggtaggaccggtagggtacgttaag

SEQ ID NO: 321151 - DNA, 616 bp, Homo sapiens
  misc_feature: GZ8MTXP02ITKJ8.19.13.B02.1.454.CMB.2.raw
  modified_base (257)..(257): a, c, t, g, unknown or other
  misc_feature (257)..(257): n is a, c, g, or t
  modified_base (264)..(264): a, c, t, g, unknown or other
  misc_feature (264)..(264): n is a, c, g, or t
  modified_base (308)..(308): a, c, t, g, unknown or other
  misc_feature (308)..(308): n is a, c, g, or t
  modified_base (344)..(344): a, c, t, g, unknown or other
  misc_feature (344)..(344): n is a, c, g, or t
  modified_base (354)..(354): a, c, t, g, unknown or other
  misc_feature (354)..(354): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgagactctcctgtncagcctntggattcaccttcagtagctatggacatgcacgtcggggtcccnccaggcctaccgaggcgaaggggctgggaggtgggngcctagttantcatagtgagtaggaaataaagtaaatactatgacaagtacctccggtaggaacgggtcctaagttccaacctacttcctaccgaagtaacgaaactaaacttaccgaaaacgtaaccacgtcttagtactccgtagaacaaaagtacgaaacgtacgaccgtagaagacgcgtacggaaacggaccgtaacggggtcttaggttaacgttaacgtttaaccggtgggtacggtaccggggtaagggtaccgggtttaaagg

SEQ ID NO: 321152 - DNA, 564 bp, Homo sapiens
  misc_feature: GZ8MTXP02HYM9W.19.13.B02.1.454.CMB.2.raw
  modified_base (263)..(263): a, c, t, g, unknown or other
  misc_feature (263)..(263): n is a, c, g, or t
  modified_base (293)..(293): a, c, t, g, unknown or other
  misc_feature (293)..(293): n is a, c, g, or t
  modified_base (302)..(302): a, c, t, g, unknown or other
  misc_feature (302)..(302): n is a, c, g, or t
  modified_base (341)..(341): a, c, t, g, unknown or other
  misc_feature (341)..(341): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagctctcctgtgcagccctntggattcaccttcagtagctatggcatgcnctgggcccncaggctcgaggcgaaggggctggaggtgggtgcagttanatcatatgatggaaaataataaatactatgacagactcggtagaacgggcattaccactatcctaccagacgaactaacttaccaaaagaaccacgtctacgttaactctagaactaaaagtacgaaacacgaccctaggaacgaggaccgtaggaaggaccgaaccgggtcgttaggttaacgttacgttacgtacggtacggacgggtacggtacggtaag

SEQ ID NO: 321153 - DNA, 601 bp, Homo sapiens
  misc_feature: GZ8MTXP02IJY00.19.13.B02.1.454.CMB.2.raw
  modified_base (309)..(309): a, c, t, g, unknown or other
  misc_feature (309)..(309): n is a, c, g, or t
  modified_base (363)..(363): a, c, t, g, unknown or other
  misc_feature (363)..(363): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggacggtccctgagctctcctgtgcagcctctggacttcaccttcagtagctatggcatgcacgtcggggtcccnccgaggcctccgagggcgaaggggctggggagtgggtgcctagttatatcatangagtaggaaagttaaataaatactatgacagtactccggtagaacgggaccgtattaccacctacgtacctaccgagacgaaacctaacttaaccgaaaagtaccacggtcttacgtactactcgaactaaatagaaacacgaccgtaggaacgacggacgtacggaaacggaccgaaacggtcgttaggtaacgttaacgttacgttcggtacggaccgggtagggtaccggttaag

SEQ ID NO: 321154 - DNA, 620 bp, Homo sapiens
  misc_feature: GZ8MTXP02IHUB7.19.13.B02.1.454.CMB.2.raw
  modified_base (178)..(178): a, c, t, g, unknown or other
  misc_feature (178)..(178): n is a, c, g, or t
  modified_base (212)..(212): a, c, t, g, unknown or other
  misc_feature (212)..(212): n is a, c, g, or t
  modified_base (310)..(310): a, c, t, g, unknown or other
  misc_feature (310)..(310): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagnggtgtccagtgtcaggtgcagctggtggagtcgngggggagcgtggtccagccgtgggagtccctgacgctctctgtgcagcctgtggacttccaccttcagtagctagtggcatcgcacgtcggggtcccnccgaggcctccgagggcgaaggggctggggaggtggggtgcctaagttatatcattagtgtagtagggaaaattaaataaatactagtgacacgtactccggtaaggaacggggaccgtaacttaccgaacccctataccgacccgaaagtacgaaacctaaacttaacccaaaacgtaacccacgtcctagtactacgtagaactaaaagtcgaaacgacgacctaggaggacgactaaggggaacgtacgtaccgggttgttagttaagttaacgttacggtacggtcggtacggtacgggtacgtag

SEQ ID NO: 321155 - DNA, 555 bp, Homo sapiens
  misc_feature: GZ8MTXP02GSHEM.19.13.B02.1.454.CMB.2.raw
  modified_base (306)..(306): a, c, t, g, unknown or other
  misc_feature (306)..(306): n is a, c, g, or t
  modified_base (419)..(419): a, c, t, g, unknown or other
  misc_feature (419)..(419): n is a, c, g, or t
  modified_base (422)..(422): a, c, t, g, unknown or other
  misc_feature (422)..(422): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggaggtccctgacgctctcctgtgcagcctctggattcaccttcagtagctatggcatgcacgtgggtcccncaggcctccgagggcaaggggctgggagtggggtggcctaggttatatcaattagtgagtagggaaagtaaataaagtactagtgacagactccggtagacgggcgattcacntcncagacgacattacaacgacacgtctagtactacgtgacaaagtgaaacacgcctagagtacgcgtacggaacggacgaccggtcgttaggtaacgttattaacggtgtacggacggtaggggtacggtttaag

SEQ ID NO: 321156 - DNA, 624 bp, Homo sapiens
  misc_feature: GZ8MTXP02J3HI6.19.13.B02.1.454.CMB.2.raw
  modified_base (162)..(162): a, c, t, g, unknown or other
  misc_feature (162)..(162): n is a, c, g, or t
  modified_base (196)..(196): a, c, t, g, unknown or other
  misc_feature (196)..(196): n is a, c, g, or t
  modified_base (311)..(311): a, c, t, g, unknown or other
  misc_feature (311)..(311): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttccncgttgctcttttaagaggtgtccagtgtcaggtncagctggtggagtcgtgggggagcgtggtccagcctgggagtccctgagactctcctgtgcagcctctggacttcaaccttcagtagctatggacatgcctacgtcggggtcccncaggctccgagggccgaaggggctggggagtggggtggccagttatatcatagtgatagggaaattaaactaaattcatgaccagtactccggtaggaacgggaccgtattaccacctatctacccgagaacgaactaaatttaacccaaaggtaaccacgtaccgttagtacttacctagaaccaaaagttacgtaaacaactacccgtacggaagacggtacgtagggaacggtaaccgaacggtccgttaggttaacggtttaaatttaccgtgggttacggtaccgggaagggtaccgggtttaaacgg

SEQ ID NO: 321157 - DNA, 571 bp, Homo sapiens
  misc_feature: GZ8MTXP02HSDVF.19.13.B02.1.454.CMB.2.raw
  modified_base (304)..(304): a, c, t, g, unknown or other
  misc_feature (304)..(304): n is a, c, g, or t
  modified_base (497)..(497): a, c, t, g, unknown or other
  misc_feature (497)..(497): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggagtccctgagactctcctgtgcagcctctggattcaccttcagtagctatggcatgcacgtcggggtccnccgaggcctccagggccaaggggtctggggagtggggtgcctaaggttatatcatatgagtagggaaataaataaatatatgacagactcgtagaacgggccgtattcacctatcctaccagacgactaaacttaccgaaagtaacacggcttagtaactctacgactaaatcgaaactagcctagaacgganacgtaggaacggaccgacgggtctaggttaaggttaacttacgttggacggaccggtaagggtaccggtttaag

SEQ ID NO: 321158 - DNA, 535 bp, Homo sapiens
  misc_feature: GZ8MTXP02GIB8J.19.13.B02.1.454.CMB.2.raw
  modified_base (304)..(304): a, c, t, g, unknown or other
  misc_feature (304)..(304): n is a, c, g, or t
  modified_base (346)..(346): a, c, t, g, unknown or other
  misc_feature (346)..(346): n is a, c, g, or t
  modified_base (409)..(409): a, c, t, g, unknown or other
  misc_feature (409)..(409): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggaggtccctgagactctcctgtgcagcctctggattcaccttcagtagctatggtatgcacgtgggtccncaggctccgaggcgaaggggctgggagtggggtggcagttanatcatatgatgggaaataaataaatactatgacaagactccgtagaacgggccattcacatcnccagagacaataccaaagaacacgctagtatctgacaaatagaacagcctagaagacgacgtagaacgggaacacgggacttagtaggtaaattacgtggtaggacggagggtacggtaagtacgg

SEQ ID NO: 321159 - DNA, 651 bp, Homo sapiens
  misc_feature: GZ8MTXP02HFZ9Q.19.13.B02.1.454.CMB.2.raw
  modified_base (311)..(311): a, c, t, g, unknown or other
  misc_feature (311)..(311): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtggggacggtccctgacgactctcctgtgcagcctctggattcaccttcagtagctatggcatgctacgtggggtcccnccgaggcctaccgaggcgaaggggcgtgggaggtggggtggcctaaggttatatctatatgagtagggtaaataaataaatacgtatcgactaagaccgtccgtaaggaacgggtccgtaactttccaacctacttaccctaacccgaagaaccgtaaactaaactttacccaaagtaaccgacgtaccgttagtaactccgtaagaacctaaaagtacgaaaccgtagcccgtaaggaaccggaggtacctagggaaccggaccgtacgggtaccgtttaggtaagtttaaaacgttccggtaggttaccgggacgggtaacggggttaccgttaacgg

SEQ ID NO: 321160 - DNA, 501 bp, Homo sapiens
  misc_feature: GZ8MTXP02FUY0J.19.13.B02.1.454.CMB.2.raw
  modified_base (304)..(304): a, c, t, g, unknown or other
  misc_feature (304)..(304): n is a, c, g, or t
  modified_base (344)..(344): a, c, t, g, unknown or other
  misc_feature (344)..(344): n is a, c, g, or t
  modified_base (486)..(486): a, c, t, g, unknown or other
  misc_feature (486)..(486): n is a, c, g, or t
tcagtactctcgtgcacgaccggtgctcgatttagtctagcgacttccgcggggagctctaggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtagctatggcatgcactggggtccnccaggctccaggcaaggggctggagtggggtgccagttanatcatatgatggaaataataaatactatgcagactccgtgaagggccgattcaccatctccagagacaattccaaagaacacgctagtatctagacaaaatgaaacagcctagagagctgaggacacgggctgtgtattacngtgcggaggcggtaa

SEQ ID NO: 321161 - DNA, 647 bp, Homo sapiens
  misc_feature: GZ8MTXP02G25ZS.19.13.B02.1.454.CMB.2.raw
  modified_base (266)..(266): a, c, t, g, unknown or other
  misc_feature (266)..(266): n is a, c, g, or t
  modified_base (308)..(308): a, c, t, g, unknown or other
  misc_feature (308)..(308): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggaggtccctgagactctcctgtgcagcctntggattccaccttcagtagctagtggcatgcacgtgggcccncaggcctccgagggcgaaggggctggggacgtggggtgaccctagtttatagtcaagttagtgagtagggaaaagttaaattaaaatactagtacgacctaagaccgttcccggtaagaacggggaccctaacgttaccaacccgtactccctaccgaagtaacgtaaacctaaacttaacccgaaaagtaaaccgacgtacgttacgtaactaccgtagaactaaagttacggaaactacgaccgtaggaaacgtaggaccgtaggaacggaccgaccggtacttaggtaagttaagttaccgttagggtacggaccggtacggggtacgttaaacgg

SEQ ID NO: 321162 - DNA, 591 bp, Homo sapiens
  misc_feature: GZ8MTXP02IYRG3.19.13.B02.1.454.CMB.2.raw
  modified_base (282)..(282): a, c, t, g, unknown or other
  misc_feature (282)..(282): n is a, c, g, or t
  modified_base (290)..(290): a, c, t, g, unknown or other
  misc_feature (290)..(290): n is a, c, g, or t
  modified_base (335)..(335): a, c, t, g, unknown or other
  misc_feature (335)..(335): n is a, c, g, or t
  modified_base (351)..(351): a, c, t, g, unknown or other
  misc_feature (351)..(351): n is a, c, g, or t
  modified_base (354)..(354): a, c, t, g, unknown or other
  misc_feature (354)..(354): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactaaccatggagtttgggctgagcgtggttttcctcgttagctctttaagaggtgtccatgtcaggtgcagctgggtggagtcgtgggggagcgtggtccagccgtggggacggtccctgagactctcctgtgcagcctctggattcaccctttnagtgctgngcatgcacggtcggcccgacgaggcacgaggacgagggcgtgggnggtggtgactagttanatnatagtgtaagtaggtaaaattaaataaatacgtagtgactagaccgtacggtaggacggactactaccacctactacacgaagacaactaaacgtaccgaaacgaccgtacgtactagtactacgtacgaaactaagtaacgaacgacgacgtacgaacggacgacgtacggaacggacgacggtacgtagttagttaagttacgtacggtacggtacggacggtacggtacgtacg

SEQ ID NO: 321163 - DNA, 621 bp, Homo sapiens
  misc_feature: GZ8MTXP02JIRXA.19.13.B02.1.454.CMB.2.raw
  modified_base (315)..(315): a, c, t, g, unknown or other
  misc_feature (315)..(315): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccagccgtgggacgtccctgagctctcctgtcgcagcctctggattccaccttcagtagctagtcggcatcgctacgtcggggtcccnccgaggcctccgagggcgaaggggctgggagtggggtgacctaggtttatattcattagtgagttaggggaaaataaattaaaatactaatgacagtaccttaccggtaggaacgggccgtaacttaccaaccgtactccgtaccgaaagtaccgaaactaaacttaccgaaagaacctacgtacctagtactactacgaactaaacgtacgaaactacgaccgtaggacgtacgacgtacggaacggaccgacggtcgttagtaacgttacgttacgtcggtacgtacgggaggtacggttaacg

SEQ ID NO: 321164 - DNA, 587 bp, Homo sapiens
  misc_feature: GZ8MTXP02G3E1R.19.13.B02.1.454.CMB.2.raw
  modified_base (309)..(309): a, c, t, g, unknown or other
  misc_feature (309)..(309): n is a, c, g, or t
  modified_base (400)..(400): a, c, t, g, unknown or other
  misc_feature (400)..(400): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccagccgtgggagtccctgagctctcctgtgcagcctctggacttcaccttcagtagctatggcatgctacgtcgggtcccnccgaggcctccgagggaccgaagggggctaggggaggtggggtgacccgtaggttatatcattagtgagtaggaaagtaaataaatactangacaagctacggtagaggcctattcaccatcctacagaacgaactaacttaccaaacgtaacacgtactagtactcgtagaactaaaacgtacgaaactacgacccttaaggaacgacgtaccgtaggaacggacgaccggtgttaggtaacgtacttacgtggtacggacggtagggtacgtaagg

SEQ ID NO: 321165 - DNA, 613 bp, Homo sapiens
  misc_feature: GZ8MTXP02ITSVC.19.13.B02.1.454.CMB.2.raw
  modified_base (178)..(178): a, c, t, g, unknown or other
  misc_feature (178)..(178): n is a, c, g, or t
  modified_base (307)..(307): a, c, t, g, unknown or other
  misc_feature (307)..(307): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagnggtgtccagtgtcaggtgcagctggtggagtcgtgggggagcgtggtccagcctgggagtccctgagactctcctgtgcagcctcgtggattcaccttcagtagctatggcatgctacgtggggtcccnccaggcctccgaggcgaaggggctgggacggtggggtgcctagttatatcaattagtgagtgggaaaagttaaataaatctaagtgacaagactccgtaggaagggcctaagttcaccattccaccgaagagaaactaaattaccaaaagtaaccacggtctacgtatacgtagaacctaaaatcggaaaacacgtacccgtaggaacgaggtaccgtaaggaaacgggtaccgaaccggggttacgttacggttaacgtttaacgtttacggtagggtacggaccgggtaacggggtacggtaag

SEQ ID NO: 321166 - DNA, 612 bp, Homo sapiens
  misc_feature: GZ8MTXP02IC33H.19.13.B02.1.454.CMB.2.raw
  modified_base (258)..(258): a, c, t, g, unknown or other
  misc_feature (258)..(258): n is a, c, g, or t
  modified_base (304)..(304): a, c, t, g, unknown or other
  misc_feature (304)..(304): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgttgggggagcgtggtccagccgtgggagtcctgagctctcctgtgcngcctctggattcaccttcagtagctatggcatgcacgtgggtcccnccgaggcctccgagggcgaaggggctagggaggtggggtgccctaaggtttactatacgattagtgagtagggtaaaattaaataaaattctaatgactaacgtactaccggtaggaaacgggcccgtaactttacaaccctattacccacccgaaggaacgtaaacctaaacttacccaaaaggtaaaccacggtacttagtaactccgtagactaaaatcgaaacacgacctagacgtacgcgtaggaacgacgacggtacgtagtaaggttacttacggttagcggtacggtacggtacgtaacg

SEQ ID NO: 321167 - DNA, 674 bp, Homo sapiens
  misc_feature: GZ8MTXP02IN0TO.19.13.B02.1.454.CMB.2.raw
  modified_base (315)..(315): a, c, t, g, unknown or other
  misc_feature (315)..(315): n is a, c, g, or t
  modified_base (389)..(389): a, c, t, g, unknown or other
  misc_feature (389)..(389): n is a, c, g, or t
  modified_base (467)..(467): a, c, t, g, unknown or other
  misc_feature (467)..(467): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagccgtgggacgtccctgacgactctccgtgtcgcagccctgtggactctacttcagtagctagtggctatgccacggtcggtcccnccgaggcctaccgagggcgaaggggtctaggggaggttcggggtgacccgtaggttaatacgttaccaattagngtaagttaacgggaaaacttaaaataaacgtactaagtcgacctaagtaccgttaccggtagggaaccggccgttaanacccgtacctaactcgaccaagtaccgaaactaacgtaaaccgacaaaacacccgttaggtaactacgtacctaggtaaacaaacgtaaacacggaaaaccttcggaacgaaggaccgtaaggccggaagggaaaccgtcggtaaccgttaggtaagttaaaaccgtttcggtaggtaccggtacggaaccggggtaaacggtcggg

SEQ ID NO: 321168 - DNA, 585 bp, Homo sapiens
  misc_feature: GZ8MTXP02I7TU9.19.13.B02.1.454.CMB.2.raw
  modified_base (196)..(196): a, c, t, g, unknown or other
  misc_feature (196)..(196): n is a, c, g, or t
  modified_base (263)..(263): a, c, t, g, unknown or other
  misc_feature (263)..(263): n is a, c, g, or t
  modified_base (281)..(281): a, c, t, g, unknown or other
  misc_feature (281)..(281): n is a, c, g, or t
  modified_base (306)..(306): a, c, t, g, unknown or other
  misc_feature (306)..(306): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtncagctggtggagtcgtgggggagcgtggtccagcctgggagtccctgagactctcctgtgcagcctntggattcaccttcagtanctatggcatgcacgtcggggtcccnccgaggcctccgagggcgaaggggtctgggaggtggggtgcctagttatactctattagtagagtaggtaaagttaaataaaacgttactatcgacaagtaccgttaccggtaggaacgggcctacttaccgacctatcctacgagacgaactaaactaccaaacgaaccacgtacttagtactcgtagaactaaatacgaacgacgcctaggacgacgcgtaggacggacgacggtctaggtaacgtacttacgtggtacgacggtacggtacgtaag

SEQ ID NO: 321169 - DNA, 608 bp, Homo sapiens
  misc_feature: GZ8MTXP02GZKTG.19.13.B02.1.454.CMB.2.raw
  modified_base (307)..(307): a, c, t, g, unknown or other
  misc_feature (307)..(307): n is a, c, g, or t
  modified_base (337)..(337): a, c, t, g, unknown or other
  misc_feature (337)..(337): n is a, c, g, or t
  modified_base (358)..(358): a, c, t, g, unknown or other
  misc_feature (358)..(358): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccagccgtgggagtccctgagctctcctgtgcagcctctggattcacttcagtagctatggcatgctacgtcgggtcccnccgaggcctccgagggcgaaggggctgggnggtggggtgccgtagttatancatagtgagtaggaaagttaaattaaagtactagtgacgagtacgtccggtagaacggggcctagttaccaccgtactccgtaccgagaacgtaaacctaaacttaccaaaacgtaaccgaaccgtacgtacgtacttaccgtagaaccaaaagttagaacctacgaccgtagacgagtaccgtaggaacggaacgacggtcgtaggttaacgttagttaacgtggtacgaccggtaggtacggttaagg

SEQ ID NO: 321170 - DNA, 537 bp, Homo sapiens
  misc_feature: GZ8MTXP02F9CSC.19.13.B02.1.454.CMB.2.raw
  modified_base (301)..(301): a, c, t, g, unknown or other
  misc_feature (301)..(301): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggagtccctgagactctcctgtgcagcctctggattcaccttcagtagctatggcatgcactgggtccnccaggctccgaggcgaaggggctgggagtggggtgcctagttatatcatatgagtaggaaagtaaataaatactatgacagactccgtaggaacgggccgattcaaccactctaccgagacgaactaaacttaccaaagaacacgactagtactctagacaaatagaaacagcctagagagcgtagacggacacggcttaggttaacgtattacgtggtacgcggtagggcgtaag

SEQ ID NO: 321171 - DNA, 610 bp, Homo sapiens
  misc_feature: GZ8MTXP02HYC4W.19.13.B02.1.454.CMB.2.raw
  modified_base (308)..(308): a, c, t, g, unknown or other
  misc_feature (308)..(308): n is a, c, g, or t
  modified_base (353)..(353): a, c, t, g, unknown or other
  misc_feature (353)..(353): n is a, c, g, or t
  modified_base (359)..(359): a, c, t, g, unknown or other
  misc_feature (359)..(359): n is a, c, g, or t
  modified_base (390)..(390): a, c, t, g, unknown or other
  misc_feature (390)..(390): n is a, c, g, or t
  modified_base (437)..(437): a, c, t, g, unknown or other
  misc_feature (437)..(437): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgagctctcctgtgcagcctctggacttcaccttcagtagctatggcatgctacgtcggggtcccncaggcctccgaggcgaaggggctgggaggtggggtgcctagttanatcatngtagtagggaaagttaaataaattactagtnactaagtacctccggtaggaacggggcctatttaccaccgtataccnccgaagaacaaactaacgttaccaaaggaacctacgtactagtactcgtagaactaaagtacgaaacgacgtaccgtaggaacgacgtacgacgggaaacggacccggtaacggtcgttaggttaacgttacgtttaacggttcgggaggtacggtacggggtacgttaaagg

SEQ ID NO: 321172 - DNA, 622 bp, Homo sapiens
  misc_feature: GZ8MTXP02GHQS0.19.13.B02.1.454.CMB.2.raw
  modified_base (280)..(280): a, c, t, g, unknown or other
  misc_feature (280)..(280): n is a, c, g, or t
  modified_base (285)..(285): a, c, t, g, unknown or other
  misc_feature (285)..(285): n is a, c, g, or t
  modified_base (306)..(306): a, c, t, g, unknown or other
  misc_feature (306)..(306): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctgggtggagtcgtgggggagcgtggtccaggcctggggacggtccctgagactctctgtgcagcctctggattcaccttnagtanctatgcatgcacgtgggtccnccaggtcctccgagggacgaagggggctaggggaggtcggggtgaccctaaggtttacagtctaatagtggtagtagggaaaagttaaaacttaaaatacgtaagtgactaagtaccgtaccggtagaacggggactaacttacaacctattccaaccgagtaacgaaactaaattacccaaacgtaacacggtctagtaactacagtaacaaaagtacgaaacacgtaccgtaggaaagacggtaccgtaaggaacggaccgtacgtggttaggtaattaacgttacgtagtcgggacggtagggtacgttaagg

SEQ ID NO: 321173 - DNA, 659 bp, Homo sapiens
  misc_feature: GZ8MTXP02GS1PC.19.13.B02.1.454.CMB.2.raw
  modified_base (330)..(330): a, c, t, g, unknown or other
  misc_feature (330)..(330): n is a, c, g, or t
  modified_base (380)..(380): a, c, t, g, unknown or other
  misc_feature (380)..(380): n is a, c, g, or t
  modified_base (386)..(386): a, c, t, g, unknown or other
  misc_feature (386)..(386): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcggtgggggagcggtggtccaggccgtggggacgtccctgacgtactctccgtgtcgcagcctcgtggtacttccaccttcagttacgctagtcggctagtgccgtacgtcggggtcccnccgaggcctccgagggcgaaggggctgggaggtgggtcgctagttatatntatagngagtaggaaaagttaaattaaatactagtcgactaacgtaccgtaccggtaggaacgggtccgtaagttacccaccgtactcctaccgagaacgaacctaaacgttaccaaaacgtaaccgaccgtacgttagtaacttccgtaagaacaaacgtacgaaacgacgtaccgtaggaacgaggtacgtagggaaacggtaaccgacggtacgttacggttaagttaaccgtttaggtaccggtaggtacgggtaacggggtaaccggttaacgg

SEQ ID NO: 321174 - DNA, 569 bp, Homo sapiens
  misc_feature: GZ8MTXP02IU09O.19.13.B02.1.454.CMB.2.raw
  modified_base (310)..(310): a, c, t, g, unknown or other
  misc_feature (310)..(310): n is a, c, g, or t
  modified_base (486)..(486): a, c, t, g, unknown or other
  misc_feature (486)..(486): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccaggcctgggaggtccctgacgactctcctgtgcagctctggacttcaccttcagtgctatggcatcgctacgtggggtcccnccaggcctccgagggcgaaggggctgggagtggggtgcctaggttatagtcaattagtgagtagggaaagtaaactaaaatactaatggacaagctaccgtagaaacgggctatacacctatctacagacactaaactaccaaagacacgctagtactcagtacaaaatgaaaacncgactaggagacgacgtacggaacggacgtacggtcgttaggtaagttacgttacgtcggtacggacggtacggtacggtaag

SEQ ID NO: 321175 - DNA, 687 bp, Homo sapiens
  misc_feature: GZ8MTXP02I784D.19.13.B02.1.454.CMB.2.raw
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagccgtgggacgtccctgacgactctcctgtgcacgcctgtgacttccaccttcagtagctagtggcatcgctacgtcggggtcccaccgaggcctaccgagggcggaaggggctggggaggtggggtcgacgtagttatacgtctattagtgagtaggaaaagttaaactaaatacgtagtcgacgaaacgtaccgtacggtaagggacgggtacctaacgttaccaacctactaccctacgaagaacgtaaactaaaccgttaaccgaaacgtaaaccaccggtacttaacgtacttacgtaacgaacgtaaaacgtacgaaacgtacgacccgtaaggaaacgggacgtacggtaacgggaaacggtacccggaacgggttaccgttaggttaaacggtttaacgtttaacggtcggggttacggtaacggggtaacggggtttaccggtaaacgg

SEQ ID NO: 321176 - DNA, 565 bp, Homo sapiens
  misc_feature: GZ8MTXP02FSU4L.19.13.B02.1.454.CMB.2.raw
  modified_base (352)..(352): a, c, t, g, unknown or other
  misc_feature (352)..(352): n is a, c, g, or t
tcagtactctcgtgcacgaccggtgctcgatttagtctagcgacttccgcgggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggaggtcctgagctctctgtgcagcctctggattcaccttcagtagctatggcatgccacgtgggtccgccaggcctccgaggcgaagggggctgggagtggggtggcctagttanatcatatgatagggaaataaataaatactaatgacaagactccggtagaacgggccgattcgacctatcctccaagagactaaataccaacgaacacgactagtaactcgtacgacaaaagtagaaacacggcctagagagcgtaggaacgggacgaaccgggtgttaggtaagttaacgttacgtcggtacggacggtacgggtacggtaag

SEQ ID NO: 321177 - DNA, 681 bp, Homo sapiens
  misc_feature: GZ8MTXP02JVVFZ.19.13.B02.1.454.CMB.2.raw
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccaggccgtgggacggtccctgacgtacctctcctgtcgcacgcctcgtggtacttccaccttcgagtacgctagtggcagtcgactacgtcggggtcccgaccgaggcctccgagggacggaaggggtcgtgggaggtggggtggaccgtagttatatcattagtggtagtaacggtaaagttaaaactaaagtacttagacgacaacgtacccgtaccggtagggaacgggaccttaacttaccgaacctacttaccgtacgaacgtaacgtaaacctaaactttaaaccgaaacgaaaccgtaccggtcttaagttacctaccggttacgaaacgtaaaacgtacggtaaaacgacggtaacccgtaaggacggtacggaccgtaagggacggtaaccgcggtacgttggtaagttacgttacggtggtacggaccggtaggggtctaaagg

SEQ ID NO: 321178 - DNA, 690 bp, Homo sapiens
  misc_feature: GZ8MTXP02F1OE0.19.13.B02.1.454.CMB.2.raw
  modified_base (309)..(309): a, c, t, g, unknown or other
  misc_feature (309)..(309): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgagactctcctgtgcagcctctggattccaccttcagtagctagtggcatgcacgtcggggtcccnccgagggcctaccgagggaccgaaaggggggtccttaggggagggttggggtcggaccctaaagggtttactataccgtaagttagtaggtagtaggggaaaactttaaaataaaactaacttaagttagacgtaacgtaacgtacccggtaggaacgggaccggtattacaccactactaccgaacgaacgaaactaaacttaaccgaaacgtaaaccgaccgacttacgtactacttagaaccaaaagtacgaaacgaacgaccgtacggaacggaaagtccgtagggaaaccggaacggaaccgggtccgttacgtttaagggttaactttaaaccgttacgggtggtaaccgggaacggggtaccgggtttaaacgg

SEQ ID NO: 321179 - DNA, 674 bp, Homo sapiens
  misc_feature: GZ8MTXP02FPBC4.19.13.B02.1.454.CMB.2.raw
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggccgtgggagtccctgagacctctcctgtgcacgcctcgtggacttccaccttcagtagctagtggcatgctacgtcggtcccgccaggcctccgagggacgaaggggctggggagtggggtgacctagttatatcagtagtagagtagggaaaattaaattaaaacgtacttaagtacgacgtaaacgtaccgttacccggtaggaaaccggggtaccgtaacttacccaacctactacccgtaccgaacgaacggtaaacctaaacgttaacccgaaaacgaaaacccgtaccgtacgttaacgttaactaccgtaggaaacctaaaacgtacgaaaaccgagacccgttaggaacgacggcgtaaacgggacggtaaccgtaacgggcttggttaacgttaagttaccgtagggtcggaccggtaggggtacggttaaacgg

SEQ ID NO: 321180 - DNA, 649 bp, Homo sapiens
  misc_feature: GZ8MTXP02F34FN.19.13.B02.1.454.CMB.2.raw
  modified_base (333)..(333): a, c, t, g, unknown or other
  misc_feature (333)..(333): n is a, c, g, or t
  modified_base (388)..(388): a, c, t, g, unknown or other
  misc_feature (388)..(388): n is a, c, g, or t
tcagtactctcgtgcacgaccggtgctcgatttagtctagcgacttccgcggggaggctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagcgtggtggagtcgtgggggaggcgtggtccagccgtggggacggtccctggacgtacctctcctgtcgcacgcctcgtggtacttccaccttcaagtacgctagtggacatcgacctacgtcggggtcccnccgaggccctaccgagggcgaagggggtctggggaggtcggggtgcctagtttanactcatagtgagtagggaaaattaaataaatctaatgacacgtacctaccggtagaacggcctattacacctactaccaccgaagaacgaaactaactaaccaaacgtaacacgtactagtaactctacgaactaaaagtacgaaaccacgtaccgtaaggaacggtacggtacgtaacggaacgggaaccgtaaccgggtcgttaaggttaacgttaaacgttacgtacggttacggaccgggtacgggttacggtaaag

SEQ ID NO: 321181 - DNA, 585 bp, Homo sapiens
  misc_feature: GZ8MTXP02FTJJK.19.13.B02.1.454.CMB.2.raw
  modified_base (308)..(308): a, c, t, g, unknown or other
  misc_feature (308)..(308): n is a, c, g, or t
  modified_base (566)..(566): a, c, t, g, unknown or other
  misc_feature (566)..(566): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggcggagtcgtgggggagcgtggtccagcctgggaggtccctgagctctcctgtgcagcctctggattccaccttcagtagctagtggcatgcacgtcggggtcccnccgaggcctccgagggcgaagggggtctggggaggtggggtggcctaaggttatatacgattagtgagtaggaaagttaaataaagtacttataggacaagtaccgtccggtaggaacgggccgtaattcccgaaccgtactcctaccaagtacgaacctaacttaccgaaacgaaccaccgtactagtactacgtacgaactaaatacgaacacgacctagagagcgtaggacggacacggcttagtgtacttacgnggtgacggtaggacgtaag

SEQ ID NO: 321182 - DNA, 583 bp, Homo sapiens
  misc_feature: GZ8MTXP02IN1P9.19.13.B02.1.454.CMB.2.raw
  modified_base (276)..(276): a, c, t, g, unknown or other
  misc_feature (276)..(276): n is a, c, g, or t
  modified_base (318)..(318): a, c, t, g, unknown or other
  misc_feature (318)..(318): n is a, c, g, or t
  modified_base (371)..(371): a, c, t, g, unknown or other
  misc_feature (371)..(371): n is a, c, g, or t
  modified_base (530)..(530): a, c, t, g, unknown or other
  misc_feature (530)..(530): n is a, c, g, or t
  modified_base (568)..(568): a, c, t, g, unknown or other
  misc_feature (568)..(568): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctgggtggagtcgtggggggagcgtggtccaggccgtggggacggtccctggacgactctcctgtgcaggccttcnggacttcaccttcagtagctatggcatgcacgtcggggtccnccgaggcctccgagggcgaaggggctggggagtggggtgccgtagttatactntatagtgagttagggaaattaaataaattacttagagtacacgtactacccggtaggaacggggtcctaacgttacacctactcctacccgagaacgtacaacttaccaaaagaccacgtctagtactctagactaaaagtgaacacgtccgagaacgngactaggacggaccgacggtctgtaagtacttacgtgngacggaggtacgtag

SEQ ID NO: 321183 - DNA, 598 bp, Homo sapiens
  misc_feature: GZ8MTXP02HJ655.19.13.B02.1.454.CMB.2.raw
  modified_base (307)..(307): a, c, t, g, unknown or other
  misc_feature (307)..(307): n is a, c, g, or t
  modified_base (353)..(353): a, c, t, g, unknown or other
  misc_feature (353)..(353): n is a, c, g, or t
  modified_base (357)..(357): a, c, t, g, unknown or other
  misc_feature (357)..(357): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctgttgctcttttaagaggtgtccagtgtcaggtgcagctggtggagtcgtgggggaggcgtggtccagccgtgggagtccctgagactctcctgtgcagcctctggattccaccttcagtagctagtggcatgcacgtgggtcccncaggctcgagggcgaaggggctgggagtggggtgcctagttatatnatangataggaaataaataaatactatcgacagactaccgtagaagggccgtattaccacctatcctaccagacgaactaacttaccaaacgtaacacggtctagtactcgtacgaactaaactacgaaacgacgtaccgtacggaagacggaccgtaggaacggaaccgaaccgggtcgttaaggttaacggttaagtttaccggtagggttacggaccgggaacggggttaccggttaaacgg

SEQ ID NO: 321184 - DNA, 673 bp, Homo sapiens
  misc_feature: GZ8MTXP02HO732.19.13.B02.1.454.CMB.2.raw
  modified_base (267)..(267): a, c, t, g, unknown or other
  misc_feature (267)..(267): n is a, c, g, or t
  modified_base (314)..(314): a, c, t, g, unknown or other
  misc_feature (314)..(314): n is a, c, g, or t
  modified_base (463)..(463): a, c, t, g, unknown or other
  misc_feature (463)..(463): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagccgtgggacgtccctgagactctcctgtcgcagcctntggacttcaccttcagtagctagtggctagtgccacggtcggtcccnccgaggccctcggagggtccgaaggggtctaggggtaggtggggtgaccgtaggtttatactcgtaattagtgagttagggtaaaacttaaataaacttaactagtacgacgaagtacctacggtaggaacgggtctattccgaacctntacctaccgagaacgtaaactaaacttaccgaaaagaaacccgtacgtactaacgttactaccgtacgaaacgtaaaacgttacgaaaacgtacggtaacccgtaggaacgtacggtaccgttaaaggggaaacggacccgtacggttacgttcggttaaggtttaacttaccggttggtacggtaccgggtaggtaacggtttaaacgg

SEQ ID NO: 321185 - DNA, 587 bp, Homo sapiens
  misc_feature: GZ8MTXP02IN002.19.13.B02.1.454.CMB.2.raw
  modified_base (197)..(197): a, c, t, g, unknown or other
  misc_feature (197)..(197): n is a, c, g, or t
  modified_base (262)..(262): a, c, t, g, unknown or other
  misc_feature (262)..(262): n is a, c, g, or t
  modified_base (267)..(267): a, c, t, g, unknown or other
  misc_feature (267)..(267): n is a, c, g, or t
  modified_base (314)..(314): a, c, t, g, unknown or other
  misc_feature (314)..(314): n is a, c, g, or t
  modified_base (364)..(364): a, c, t, g, unknown or other
  misc_feature (364)..(364): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtncagctggtggagtcgtgggggagcgtggtccagccgtgggacgtccctgacgctctcctgtcgcngcctntggacttccaccttcagtgctatggcagtcgctacgtcggggtcccnccgaggcctaccgagggcgaaggggctgggaggtggggtgcctagttatntacatagtgagtaggaaaattaaactaaatactatacgactaagaccgtacggtaggaacggccgtattaccgaccatcctaccaagacgaaactaactaacccaaaagtaccacgtctagtactcgacgaactaaagcgaaacagcctagacgacgcgtaacggacgtaccgacgggtctaggttaagttacttacggtggtacggacggagggtacgtaag

SEQ ID NO: 321186 - DNA, 521 bp, Homo sapiens
  misc_feature: GZ8MTXP02GHPSF.19.13.B02.1.454.CMB.2.raw
  modified_base (305)..(305): a, c, t, g, unknown or other
  misc_feature (305)..(305): n is a, c, g, or t
  modified_base (348)..(348): a, c, t, g, unknown or other
  misc_feature (348)..(348): n is a, c, g, or t
  modified_base (498)..(498): a, c, t, g, unknown or other
  misc_feature (498)..(498): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagccctctggattcaccttcagtagctatggcatgcacgtggggtccnccgaggcctccgaggcgaaggggctggagtggggtgcagttanatcatatgatggaaataaataaaatactaatgcaagactccggtagaacgggccattacaccatctaccaagacaactaaattccaaaagaacacgtactataatctagacaaaatgaaacagcctagagagcaggacgacacggctagngtatacgtgtgacgaggcgtaag

SEQ ID NO: 321187 - DNA, 556 bp, Homo sapiens
  misc_feature: GZ8MTXP02H4VSS.19.13.B02.1.454.CMB.2.raw
  modified_base (307)..(307): a, c, t, g, unknown or other
  misc_feature (307)..(307): n is a, c, g, or t
  modified_base (485)..(485): a, c, t, g, unknown or other
  misc_feature (485)..(485): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccaggcctgggaggtccctgagactctcctgtgcagcctctggattcaccttcagtagctatggcatgcacgtgggtcccnccaggcctccgaggccgaaggggctgggaggtgggtggcctagttatatcatatgagtaggaaagttaaataaatactagtgacagtactaccgtagaacggggccgaattcacctatcctaccgagacgaaacaaccttaaccaaacgtacacgtactagtactctagacaaaagtnaaacgagaccgtagagagcgtagacggacacggtctagtaagttattaacgtgtagacggtagggacgtag

SEQ ID NO: 321188 - DNA, 588 bp, Homo sapiens
  misc_feature: GZ8MTXP02IA08R.19.13.B02.1.454.CMB.2.raw
  modified_base (275)..(275): a, c, t, g, unknown or other
  misc_feature (275)..(275): n is a, c, g, or t
  modified_base (305)..(305): a, c, t, g, unknown or other
  misc_feature (305)..(305): n is a, c, g, or t
  modified_base (355)..(355): a, c, t, g, unknown or other
  misc_feature (355)..(355): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagctctcctgtgcagcctctggattcaccttnagtagctatggcatgccacgtggggtcccnccaggcctccgagggcgaaggggctgggaggtggggtgccgtaagtttanatcagttatggacttagggaaattaaataaaatactagtcgactaagtacctccggttagaaacggggcccaagttaccgaaccacttccaccgagaacgaactaagttaccaaagtaaccacggctagtaactcctaggaacaaagtgaaaccaggaccctaggaacgaggacctagggaaacgacgtaaccggctaggttaagtacttacgtgtgacggtaggtacgtaag

SEQ ID NO: 321189 - DNA, 753 bp, Homo sapiens
  misc_feature: GZ8MTXP02IT37G.19.13.B02.1.454.CMB.2.raw
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtggggacgtccctgacgactctcctgtgcagcctgtggacttccaccttcagtacgtctagtggactagtcgacctacggtcggggtccccacccgaggccctaccggagggtaccggaaagggggtcctaggggaggtcgggggtacgtaccgtaaggtttatactcgaaattagttagggagttaagggggtaaaatttaaaatttaaaaacgttaccgtaagttacggaaaccgtaaacgtaaacccgttacccggggtaaacgggtaaaccgggggtacccggtaacgtttaacccgaaacccttaacgttaccccgtaaccgaacgggaaacgaaacccttaaaacgtttaaaccccgaaaacgaaaaccgtaaccggtaccgtttaacgtacgttaccttaacggaaactaaaacgtaacgaaaccgtaacgaccgtaagacggaagtcgaacggacgacgacgtttttacagttaacgttacgtaacgttggtagaccggtagggtacgtaag

SEQ ID NO: 321190 - DNA, 672 bp, Homo sapiens
  misc_feature: GZ8MTXP02I13JG.19.13.B02.1.454.CMB.2.raw
  modified_base (269)..(269): a, c, t, g, unknown or other
  misc_feature (269)..(269): n is a, c, g, or t
  modified_base (287)..(287): a, c, t, g, unknown or other
  misc_feature (287)..(287): n is a, c, g, or t
  modified_base (291)..(291): a, c, t, g, unknown or other
  misc_feature (291)..(291): n is a, c, g, or t
  modified_base (309)..(309): a, c, t, g, unknown or other
  misc_feature (309)..(309): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagccgtgggacggtccctgagactctcctgtcgcagccttnggacttcaccttcagtanctanggcatgcacgtgggtccnccgaggcctccgagggccgaaggggtctggaggtggggtgacctagttatatcaatatgtagtagggaaagttaaattaaagtactaagtacgacgtaaacgtaccgtaccggtaggaacggggtacccgtaacgtttaccaaccctacttacccgtaaccgaacgtaacgtaaaccgtaaactttaaacccgaaaacgtaaccgaaccgtacgttacgtacgttactacgaactaaaacgttacgaaacgacgtaccgtagacggtaacgacggtaacggaacgtaccgggaccgttacgtacggtttaagtttaacgttaacgttcgggtacggtacgggtaacggggtacgttaacgggg

SEQ ID NO: 321191 - DNA, 588 bp, Homo sapiens
  misc_feature: GZ8MTXP02G6XIZ.19.13.B02.1.454.CMB.2.raw
  modified_base (266)..(266): a, c, t, g, unknown or other
  misc_feature (266)..(266): n is a, c, g, or t
  modified_base (280)..(280): a, c, t, g, unknown or other
  misc_feature (280)..(280): n is a, c, g, or t
  modified_base (307)..(307): a, c, t, g, unknown or other
  misc_feature (307)..(307): n is a, c, g, or t
  modified_base (340)..(340): a, c, t, g, unknown or other
  misc_feature (340)..(340): n is a, c, g, or t
  modified_base (351)..(351): a, c, t, g, unknown or other
  misc_feature (351)..(351): n is a, c, g, or t
  modified_base (386)..(386): a, c, t, g, unknown or other
  misc_feature (386)..(386): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccagccgtgggagtccctgagctctcctgtcgcagcctntggacttcaccttnagtagctatggcatgcacgtggtcccncaggcctccgaggcgaggggctgggagtggggngctagttatancatagtagagtagggtaaataaataaatactaagngactaagaccgtaccggtagaacgggcctagttaccaccactccgtaccaagacaaacacttaccaaacgtaacacgaccttagtactctaagacaaatacgaaactacgcctaaggagaacggcctagggaacggaccgaacggggtcctaaggttcgttaagttaccggtaggttacggacggtagggtacgttaaacgg

SEQ ID NO: 321192 - DNA, 648 bp, Homo sapiens
  misc_feature: GZ8MTXP02IPLGI.19.13.B02.1.454.CMB.2.raw
  modified_base (244)..(244): a, c, t, g, unknown or other
  misc_feature (244)..(244): n is a, c, g, or t
  modified_base (307)..(307): a, c, t, g, unknown or other
  misc_feature (307)..(307): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgngactctcctgtgcagcctctggacttcaccttcagtagctatggcatgctacgtcgggtcccnccgaggcctccgagggcgaaggggctgggaggtggggtgaccgtagttatatctatagtgagtagggaaattaaataaatactagtgacgagtacgtaccggtagaacggggtacctacgttaccacctaactccgtaccgagaacgtaaacctaaacttaccgaaagaaccaaccgtacgtacgtacttacgtacgaactaaaacgtcgaaaacgacgtacccgtagaacggtacgtacggtaacggaacgggtaacccgtaaccggtaccgttaggttaacgttaacgtttaccggttacgggtacggtaccggggtacggggtacgggtttaaaccgg

SEQ ID NO: 321193 - DNA, 612 bp, Homo sapiens
  misc_feature: GZ8MTXP02HOK66.19.13.B02.1.454.CMB.2.raw
  modified_base (279)..(279): a, c, t, g, unknown or other
  misc_feature (279)..(279): n is a, c, g, or t
  modified_base (308)..(308): a, c, t, g, unknown or other
  misc_feature (308)..(308): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttggctgagctgggttttcctcgttgcttcttttaagaggtgtccagtgtcaggtgcagctggtggagtcgtgggggagcgtggtccagccgtgggacgtccctgagactctcctgtgcagcctctggacttcaccttnagtagctatggcatgcacgttggggcccncaggcctccgaggcgaggggctggggagtggggtgcctagttatatcaattgagagtacgggaaaattaaataaaattctaagtgacaagtaccgtacccggtaggaaacgggtacccgtaattacccaaccctattaccctaccgaaagaacgaaactaaacttaccaaaggtaaaccacgtacctagtaactctacgaactaaagtacgaaacgacgtcctaggaacgagacgtaggacggaacgaccggtagttagttaagttacgttacgtggtacgtacggtacggtacggtttaaacg

SEQ ID NO: 321194 - DNA, 550 bp, Homo sapiens
  misc_feature: GZ8MTXP02JKED5.19.13.B02.1.454.CMB.2.raw
  modified_base (303)..(303): a, c, t, g, unknown or other
  misc_feature (303)..(303): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcctctggattcaccttcagtagctatggcatgcactggggtccnccaggctccgaggcaaggggctgggagtggggtgcctagttatagtcatatgatagggaaagttaaataaatactatgcaagactccggtagaacgggcgtattcacccatccgtaccagagaactaagttaccaaagaacacgacttagtatcctagacaaatagaaacagcctagagacgacgtaggaacggacgacgggtcttaggtaagttagttacgtggtcggacggtagggtacggtaag

SEQ ID NO: 321195 - DNA, 643 bp, Homo sapiens
  misc_feature: GZ8MTXP02H3U0A.19.13.B02.1.454.CMB.2.raw
  modified_base (198)..(198): a, c, t, g, unknown or other
  misc_feature (198)..(198): n is a, c, g, or t
  modified_base (286)..(286): a, c, t, g, unknown or other
  misc_feature (286)..(286): n is a, c, g, or t
  modified_base (623)..(623): a, c, t, g, unknown or other
  misc_feature (623)..(623): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtncagctgggtggagtcggtgggggagcgtggtccagccgtgggacgtccctgacgtactctctgtcgcagcctctggacttccaccttnaagtgctagtggactatcgaccgtacgtcggggccccgacgacggcctaccggagggtaccggaagggggctaggggtaggtggggtagccgtaaggttatatacgtattagagtacgtaagggtaaaataaaattaaatactagtcgaaacgtacgacctacggggtaaggaacggggtaccctaacgttacccaactactaccgtacccgaagaacgtaactaaactaccgaaaagtaccacgtctacgtataccgtaagtaacctaaaagtaccgaaactacgaccgtagaacgtggtacgaggaacggacacggtctaggtaagtagttacgngtacggacgtaggtacgtag

SEQ ID NO: 321196 - DNA, 571 bp, Homo sapiens
  misc_feature: GZ8MTXP02GY23Y.19.13.B02.1.454.CMB.2.raw
  modified_base (263)..(263): a, c, t, g, unknown or other
  misc_feature (263)..(263): n is a, c, g, or t
  modified_base (307)..(307): a, c, t, g, unknown or other
  misc_feature (307)..(307): n is a, c, g, or t
  modified_base (461)..(461): a, c, t, g, unknown or other
  misc_feature (461)..(461): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggagtccctgagctctcctgtgcagcctntggattcaccttcagtagctatggcatgctacgtcggggtcccnccgtaggcctaccgagggccgaagggggctgggaggtggggtgcccgtagttatatcatatgatagggaaataaactaaatcgtatcgcaagtctaccggtagaacggggccattccacatcaccagacaacagtaccaaagaaccacgacgtnaactcttacgaactaaaacgaacgaacgacgacgtacgagagacgtacggacggacgacgtcgtacgtaagttacgttacgtacggtacggtacggtacggtacggtacg

SEQ ID NO: 321197 - DNA, 545 bp, Homo sapiens
  misc_feature: GZ8MTXP02JHZRK.19.13.B02.1.454.CMB.2.raw
  modified_base (263)..(263): a, c, t, g, unknown or other
  misc_feature (263)..(263): n is a, c, g, or t
  modified_base (302)..(302): a, c, t, g, unknown or other
  misc_feature (302)..(302): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagctcnggattcaccttcagtagctatggcatgcacgtgggtccnccaggctccgagggcgaaggggtctggggagtggggtgcccgtagttactatcgatagtgatagggaaataataaagtactaatgacagactccggtaggaacgggcctagttacaccgactcctaccgagacgaactaacgttaccaaagaaccgacgtctagtactctagacaaatacgaacagcctagagagcgtacgacgacgacgcgtgtaagtactacgtgtagcggaggtacgtag

SEQ ID NO: 321198 - DNA, 677 bp, Homo sapiens
  misc_feature: GZ8MTXP02HDVVT.19.13.B02.1.454.CMB.2.raw
  modified_base (283)..(283): a, c, t, g, unknown or other
  misc_feature (283)..(283): n is a, c, g, or t
  modified_base (311)..(311): a, c, t, g, unknown or other
  misc_feature (311)..(311): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagtcttgggttttcctcgttgcttcgttttaagaggtgtccagtgtcaggtgcagcgtggtggagtcgtgggggagcgtggtccagccgtgggacgtccctgagctctcctgtgcagcctctggacttcaccttnagtagctatggcatgcacgtgggtcccncgaggcctccgagggcgaaggggtctaggggacggtggggtgaccgtagtttatagctaagttagtggtaagtagggtaaaaagttaaaacttaaaagtacctagtacggacctaaaggtaacccgttcccgggtaaggaaaccgggggtccctaaagttaccaaccctagttaccctaaccgaagtaacgaaacctaacgttaaacccaaaggaacctaccggtacttagtaactacgtagaaactaaaagacgtaaaccaggtccctaaaggacgaggttaccgagggtaacggaccgtaacgggtcctttaggtaagttacgttaacggttccggaggaccggtaaggggtaccgttaaacgg

SEQ ID NO: 321199 - DNA, 541 bp, Homo sapiens
  misc_feature: GZ8MTXP02H9SL7.19.13.B02.1.454.CMB.2.raw
  modified_base (303)..(303): a, c, t, g, unknown or other
  misc_feature (303)..(303): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggaggtccctgagactctcctgtgcagcctctggattcaccttcagtagctatggcatgcacgtggtccnccaggcctccgagggcgaaggggctgggagtggggtgcagttatatcatatgagtgggaaataaataaatctatgcagctccgtagaggcatcacatctcagacgaactaactacaaagacacgtactagtatcgtagacaaaatcgaaacagacctaggaacgagacgtaggaacggaccgaacgggtcttagggtaagttaacttacgttggtcggacggtaaggggtcggttaag

SEQ ID NO: 321200 - DNA, 566 bp, Homo sapiens
  misc_feature: GZ8MTXP02FG56B.19.13.B02.1.454.CMB.2.raw
  modified_base (305)..(305): a, c, t, g, unknown or other
  misc_feature (305)..(305): n is a, c, g, or t
  modified_base (356)..(356): a, c, t, g, unknown or other
  misc_feature (356)..(356): n is a, c, g, or t
  modified_base (385)..(385): a, c, t, g, unknown or other
  misc_feature (385)..(385): n is a, c, g, or t
  modified_base (485)..(485): a, c, t, g, unknown or other
  misc_feature (485)..(485): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctggggaggtccctgagactctcctgtgcagcctctggatcaccttcagtagctatggcatgcacgtggggtccnccaggcctccgagggcaaagggggtctggggagtggggtggcctagtttanatcatagtagataggaaataataatatangacagtacgtaccggtaggaacggccgtataccacctactacctaccagacgaacctaaactaccaacgaaccacgtacttagtactctacgaactaaanacgaacacgccgagagacgacgtaggacggacgacggtcgttagtaagtacttacgtggtacggacggacggtacgtaacg

SEQ ID NO: 321201 - DNA, 588 bp, Homo sapiens
  misc_feature: GZ8MTXP02FIGKE.19.13.B02.1.454.CMB.2.raw
  modified_base (264)..(264): a, c, t, g, unknown or other
  misc_feature (264)..(264): n is a, c, g, or t
  modified_base (277)..(277): a, c, t, g, unknown or other
  misc_feature (277)..(277): n is a, c, g, or t
  modified_base (306)..(306): a, c, t, g, unknown or other
  misc_feature (306)..(306): n is a, c, g, or t
  modified_base (354)..(354): a, c, t, g, unknown or other
  misc_feature (354)..(354): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctggggagtccctgagactctcctgtgcagcctntggattcaccttnagtagctatggcatgcacgtcgggtcccnccgaggctccgagggcgaagggggctgggaggtggggtgcctagttanatcaatatgagtaggaaagttaaataaatactatgacagactcgagaacggcattcaccatcctacagagaacaattaccaaagaaccacgtactagtactcgtagaactaaatacggaaacacgtacccgtaggaacgaggaccgaggaaacggaccgtaacgggccgttagttaacggtttaagtttaaccggttcgggtaggtaccgggtagggggtaccggtttaaacgg

SEQ ID NO: 321202 - DNA, 672 bp, Homo sapiens
  misc_feature: GZ8MTXP02H13AR.19.13.B02.1.454.CMB.2.raw
  modified_base (197)..(197): a, c, t, g, unknown or other
  misc_feature (197)..(197): n is a, c, g, or t
  modified_base (255)..(255): a, c, t, g, unknown or other
  misc_feature (255)..(255): n is a, c, g, or t
  modified_base (265)..(265): a, c, t, g, unknown or other
  misc_feature (265)..(265): n is a, c, g, or t
  modified_base (297)..(297): a, c, t, g, unknown or other
  misc_feature (297)..(297): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagcttgggttttcctcgttgctcttttaagaggtgtccagtgtcaggtncagctggtggagtcgtgggggagcgtggtccagccgtgggagtccctgagactctccngtgcagcctntggacttcaccttcagtagctatggcatgccncgtggtcccgcaggcctccgagggcgaaggggctggggaggtggggtagcccgtaaggtttatagtactaattagtgataaggggtaaaattaaattaaaatactagtagactaacgtaccgtaccggtaggaacggggtacccgtaagtttaccaacctaacttaccctaacccgagtaaacgaactaaactttaacccgaaaacgtaaaccgaacgtacctaggttaactaccgtacgaactaaaacgtacgaaaaccgacgacccgttaggaaaggacggtaccgtaggggaacggtaaaccgaaccggtcgttacggttaacgtttaattaaccggtggtacggtaccgggaacggggtaccggtaaacgg

SEQ ID NO: 321203 - DNA, 526 bp, Homo sapiens
  misc_feature: GZ8MTXP02FE3D1.19.13.B02.1.454.CMB.2.raw
  modified_base (303)..(303): a, c, t, g, unknown or other
  misc_feature (303)..(303): n is a, c, g, or t
  modified_base (343)..(343): a, c, t, g, unknown or other
  misc_feature (343)..(343): n is a, c, g, or t
  modified_base (350)..(350): a, c, t, g, unknown or other
  misc_feature (350)..(350): n is a, c, g, or t
  modified_base (466)..(466): a, c, t, g, unknown or other
  misc_feature (466)..(466): n is a, c, g, or t
tcagtactctcgtgcacgaccggtgctcgatttagtctagcgacttccgcgggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggaggtccctgagactctcctgtgcagcctctggatcaccttcagtagctatggcatgcactggggtccnccaggctccgaggcaaggggctggagtgggtgccagttanatcatangatgggaaataaataaatactatgcaagactccggtagaacggccgattaccaccatcctccaagacgaacaacttaccaaagaacacgtactagtactctagacaaaatgaaacngaccctgaagagctaggacgacacggctgtaagtattaacgtggtagacggaggcgtaag

SEQ ID NO: 321204 - DNA, 534 bp, Homo sapiens
  misc_feature: GZ8MTXP02FPICR.19.13.B02.1.454.CMB.2.raw
  modified_base (349)..(349): a, c, t, g, unknown or other
  misc_feature (349)..(349): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggaggtccctgagactctcctgtgcagcctctggattcaccttcagtagctatggcatgcactgggtccgccaggctccgaggcaaggggctggagtggggtgcagtatatcatangagtagaaagtaataaatactaatgacagactccggtagaacgggccgattacaccaatctccagacgacaaattaccaaagaacacgtactagtatccgtagactaaaatcgaaacacgacctagagtagcgtaggacggacacggcttaggtgttatacgtggtcgtacggaggtacggtaag

SEQ ID NO: 321205 - DNA, 726 bp, Homo sapiens
  misc_feature: GZ8MTXP02HEGZS.19.13.B02.1.454.CMB.2.raw
  modified_base (263)..(263): a, c, t, g, unknown or other
  misc_feature (263)..(263): n is a, c, g, or t
  modified_base (369)..(369): a, c, t, g, unknown or other
  misc_feature (369)..(369): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagcgtggtggagtcgtgggggaggcggtggtccagccgtggggaggtccctgagctctcctgtgcngcctgtggtacttccaccttcagtacgctagtggctagtcgccgtacgtcggggtccccgccgacgggtcctacccggagggaccggaaagggggtccgtaggggnggtgggggtcggaccgtaggtttatagtactagttagtgtagttaaggtaaaacgttaaattaaaactacttaagtagaccgtaaagtacccttaccggtaggaacggggtaccctaactttacccgaaccctataccccgtaccgaaggtaaacgaaacctaaactttaacccgaaaagtaaccgacgtaccgttataaaccgtcctaaggaaccctaaagtacgaaaaccgacggtaccctaggaaacgggactaccgtaaaggggaaacgggaaaccccgcgggttaccgttagggtttaataaccggttttaacgggtcgggttaacgggacgggtacggggttacggtacgg

SEQ ID NO: 321206 - DNA, 568 bp, Homo sapiens
  misc_feature: GZ8MTXP02IZ1JS.19.13.B02.1.454.CMB.2.raw
  modified_base (305)..(305): a, c, t, g, unknown or other
  misc_feature (305)..(305): n is a, c, g, or t
  modified_base (414)..(414): a, c, t, g, unknown or other
  misc_feature (414)..(414): n is a, c, g, or t
  modified_base (461)..(461): a, c, t, g, unknown or other
  misc_feature (461)..(461): n is a, c, g, or t
  modified_base (474)..(474): a, c, t, g, unknown or other
  misc_feature (474)..(474): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggaggtccctgagactctcctgtgcagcctctggacttcaccttcagtagctatggcatgcacgtggtccnccaggctccgaggccgaggggctggaggtgggtggcctagttatagtcatatgagtaggaaagtaaataagtactatgactagactcggtagaaacgggcctagttacnccgatacctccaagacgaaactaacttaccaaacgaacctaccggtntacgtactcgtanactaaatcgaaacacgcgtaggagtagccgtaggacggacgacggtcgttaggtaagttacgttacgtggtacgtagggtacggacggtttaag

SEQ ID NO: 321207 - DNA, 564 bp, Homo sapiens
  misc_feature: GZ8MTXP02GWLOW.19.13.B02.1.454.CMB.2.raw
  modified_base (402)..(402): a, c, t, g, unknown or other
  misc_feature (402)..(402): n is a, c, g, or t
  modified_base (429)..(429): a, c, t, g, unknown or other
  misc_feature (429)..(429): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtggggaggtccctgagactctccgtgtgcagcctcgtggattcaccttcagtagctagtggcagtgcacgtggggtccccgccagggcctaccgagggcggaaggggctaggggaggtggggtgcgtagttatatcattagtagagtaggaaagttaaataaatactangacagactcgtagacgggctatcaccntccacagacacacttaccgaagaacacgactagtactcgagacaaagtagaacagactaggaagagaccgtaggaacggacgacggtcttaggtaacgttacttacggtggtacggacggtacgggtacggtaag

SEQ ID NO: 321208 - DNA, 548 bp, Homo sapiens
  misc_feature: GZ8MTXP02H57WS.19.13.B02.1.454.CMB.2.raw
  modified_base (130)..(130): a, c, t, g, unknown or other
  misc_feature (130)..(130): n is a, c, g, or t
  modified_base (198)..(198): a, c, t, g, unknown or other
  misc_feature (198)..(198): n is a, c, g, or t
  modified_base (267)..(267): a, c, t, g, unknown or other
  misc_feature (267)..(267): n is a, c, g, or t
  modified_base (313)..(313): a, c, t, g, unknown or other
  misc_feature (313)..(313): n is a, c, g, or t
  modified_base (362)..(362): a, c, t, g, unknown or other
  misc_feature (362)..(362): n is a, c, g, or t
  modified_base (393)..(393): a, c, t, g, unknown or other
  misc_feature (393)..(393): n is a, c, g, or t
  modified_base (509)..(509): a, c, t, g, unknown or other
  misc_feature (509)..(509): n is a, c, g, or t
  modified_base (526)..(526): a, c, t, g, unknown or other
  misc_feature (526)..(526): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactnaccatggagtttgggctgagcttgggttttcctcgttgcttcttttaagaggtgtccagtgtcaggtncagctggtggagtcgtgggggagcgtggtccagccgtgggaggtccctgagactctcctgtgcagcctntggacttcaccttcgagtagctagtggacatgcacgtggggtcccncgaggcctccgagggcgaaggggctggggaggtggggtcgcaagtttantcatagtgatagggaaataataaaatacatnacaagactcggtagaacgggccattacacactcaccgagacgaacattaccaagtaaacacgtctagtatcctagaacaaatagaacagacctagagtagctaggacgacacggtntagtaagtacgttacgnggtacgacggtacggtacgtag

SEQ ID NO: 321209 - DNA, 567 bp, Homo sapiens
  misc_feature: GZ8MTXP02JM5QV.19.13.B02.1.454.CMB.2.raw
  modified_base (306)..(306): a, c, t, g, unknown or other
  misc_feature (306)..(306): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggacgtccctgagactctcctgtgcagcctctggattccaccttcagtagctatggcatgcacgtgggtccncaggctacgaaggcgaaggggctgggaggtggggtgccgtagttatagtctatatgagtagggaaattaaagtaaatactatcgacagactccgtaggaacggcagttacacctatcctacagagaactaacttaccaaagaaccacgactagtactcgtacgactaaatcggaaacacgaccgtaggagacgacgtagggacggaccgacggtctaggtaagttacgttaacgtggtaggacggtaggtacggttaacgg

SEQ ID NO: 321210 - DNA, 678 bp, Homo sapiens
  misc_feature: GZ8MTXP02GB2HJ.19.13.B02.1.454.CMB.2.raw
  modified_base (263)..(263): a, c, t, g, unknown or other
  misc_feature (263)..(263): n is a, c, g, or t
  modified_base (305)..(305): a, c, t, g, unknown or other
  misc_feature (305)..(305): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcctntggattcaccttcagtagctatggcatgcacgtcgggtcccnccgaggcctaccgagggccgaagggggtctggggaggtgggggtgcccgtaaggtttatacgtacaagttagtggtagtaggggaaaagttaaattaaaacttacctaagtagaccaaagtaccgtacccggtagggaaacggggtcccgtaagtttacccaccctaattacccgttacccgaaagtaacggaaaccctaaacgtttaaccccgaaaacggtaaaccaaaccggtccgttaagtaacttaccgttagaacctaaaagttacgaaaccgacgtacccgtaggaagaaacggccgtagggaacggtaccgaaccggtcgttaggtaagttacgttacgtggtacggcggtaagggtcggttaacg

SEQ ID NO: 321211 - DNA, 576 bp, Homo sapiens
  misc_feature: GZ8MTXP02I4BPJ.19.13.B02.1.454.CMB.2.raw
  modified_base (308)..(308): a, c, t, g, unknown or other
  misc_feature (308)..(308): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggacggtccctgagactctcctgtgcagcctctggacttcaccttcagtagctatggcatgcacgtcgggcccncaggcctccgagggcgaaggggctgggaggtggggtgcctagttatatcattagtgagtagggaaattaaattaaaatctaatgacaagtactccggtaggaacgggcctagttacaccctattcccaccagacgaactaaacttaccgaaagtaaccacgtctagtacttctagactaaaatcggaaacacgcctagagagtctagggacgacgaacggtcgttaggttaagttacttacgtaggtacggacggaggtacggttaag

SEQ ID NO: 321212 - DNA, 632 bp, Homo sapiens
  misc_feature: GZ8MTXP02F62B8.19.13.B02.1.454.CMB.2.raw
  modified_base (307)..(307): a, c, t, g, unknown or other
  misc_feature (307)..(307): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagctctcctgtgcagcctctggattccaccttcagtagctagtggcatgctacgtggggtcccnccgaggcctccgagggcgaaggggctggggagtggggtgcctagttatatcaatagtggagtagggtaaaacgttaaataaaactactagtgacaagtaccgtacggtaggaaacgggcccgtaagtttacccaacctacttacccttaccgaagaacgtaaacctaaacgttaacccgaaaacggtaaccaccggtacttacgttaactcgtaagaactaaaagtcgaaacgacgtcccgagaggacgacgtacggaacggaccgaacggtcgttaggtaacgttaagttacgtggttacggacggtacgggtacggttaaacg

SEQ ID NO: 321213 - DNA, 674 bp, Homo sapiens
  misc_feature: GZ8MTXP02G3X04.19.13.B02.1.454.CMB.2.raw
  modified_base (322)..(322): a, c, t, g, unknown or other
  misc_feature (322)..(322): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccaggccgtgggacgtcccgtgacgtactctcctgtcgcagcctcgtggtacttccaccttcgagtagctagtcggcatgcctacgtcggtcccnccgtaggcctaccgagggtcgaaacggggtctaggggtaggtggggtcggacctaaggtttaatacgtacgtaagttagtaggtagttagggtaaaagttaaataaaattactaagtcacgaagtaccgtaccggtagaacggccgtattaccaaccagtaccctacgaacgactaaactaacttaaccgaaacgtaaccgacccgtagtacgtaactacgtacgaaactaaaacgtacgaaaccgtacgccctaaaggacgtaacgccgttaaagggaccgtacgtaaccggtcgttaagttaacggttaacgttaccggttaggtaggaccggtagggtaaccggttaag

SEQ ID NO: 321214 - DNA, 592 bp, Homo sapiens
  misc_feature: GZ8MTXP02JS8CL.19.13.B02.1.454.CMB.2.raw
  modified_base (317)..(317): a, c, t, g, unknown or other
  misc_feature (317)..(317): n is a, c, g, or t
  modified_base (552)..(552): a, c, t, g, unknown or other
  misc_feature (552)..(552): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccagccgtgggacgtccctgacgtactctcctgtcgcagcctctggacttcaccttcagtactctagtggcagtcgctacgtgggtcccncgaggcctcgaggcgaaggggctgggagtggggtgacctagttatatcatagagtagttacgggaaaagttaaattaaagtactagtgaccaagtacgtaccgtaggaacggtcctaagttaccaacctacgttccaacgagtaacgaactaacgttaccaaagaacacgtctagtactactagaactaaatacgaactacggacctaggacgacgctaggaacgacgaccggtntagtaagttaacgttacgcggtgacggagggtacgtaagg

SEQ ID NO: 321215 - DNA, 652 bp, Homo sapiens
  misc_feature: GZ8MTXP02ITD93.19.13.B02.1.454.CMB.2.raw
  modified_base (265)..(265): a, c, t, g, unknown or other
  misc_feature (265)..(265): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggacgtccctgacgctctcctgtgcagcctntgattccaccttcagtagctatggcagtcgctacgtcggggtcccgaccaggcctacccggaagggccggaaagggggtcctaggggaggtggggtcgacctaggttatagtcaagttatagacgtaggtaaaagtaaattaaatactaagtcgacgaacgtaccgtacggtaggaacgggtacccgtaatttaccaacctacttacccgtaccgaagaacgtaaacaaacgtttaaccaaaacgtaaccacgtaccttagtaacgttacacggtaaaccaaagttacgaaactacgaaccgtaggaacgagaccgtaggaacggaaccgtccggtattacggttaattaaccgttacgtaggtcggtacggacgggtacgtaacgg

SEQ ID NO: 321216 - DNA, 718 bp, Homo sapiens
  misc_feature: GZ8MTXP02GZ87N.19.13.B02.1.454.CMB.2.raw
  modified_base (271)..(271): a, c, t, g, unknown or other
  misc_feature (271)..(271): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgtctcttttaagaggtgtccagtgtcaggtgcagcgtggtggagtcgtgggggaggcggtggtccagccgtgggacggtccctgagactctccgtgtgcagcctntggtacttccaccttcaagtacgctagtggaccagtcgccgacgttcggggtccccgaccgagggtccctccggaagggaccgaaaggggggtcctaggggagggttgggggtggacccgttaagggtttataagtacgtaagttagttaggaggttaacgggtaaaagttaaaattaaaattacttaagtacgaccgtaagtaccgtacccggtaaggaaaccgggggtaccctaacgtttacccaacccgtaacttacccgaacccgaagaaaccgtaaaccttaaacttaaacccgaaaagtaaccgacgtaccgttagtacgtacttagaactaaaagacgaaacgacgccgtaagacggtaacgcgtaaaggacggtaccggacggtacttaggtaacgtaacgttacggtaggttccggagggtaccgggtacgttaacgg

SEQ ID NO: 321217 - DNA, 603 bp, Homo sapiens
  misc_feature: GZ8MTXP02HWA29.19.13.B02.1.454.CMB.2.raw
  modified_base (508)..(508): a, c, t, g, unknown or other
  misc_feature (508)..(508): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagcttgggttttcctcgttgctctttttaagaggtgtccagtgtcaggtgcagctgggtggagtcgtgggggaggcgtggtccagccgtggggacggtccctgagactctcctgtcgcagcctctggattcaccttcagtagctagtggcatcgctacgtcgggtcccgccgaggcctaccgagggacggaaggggcgtgggagggtggggtgaccgtagttatatacgtattagtgtagtaggaaagttaaataaaagtactaatgacagacgtcgtagacggcctattaccactactctaccagtaacgaaactaacttaaccgaaagaaacacgtactacgtatctagaactaaaanacgaaacacgacccgtagaacggtacgacgtagggaacggaacgcggtacttagtaacgttaacttacgtggtacggaccggagggtacgtaagg

SEQ ID NO: 321218 - DNA, 603 bp, Homo sapiens
  misc_feature: GZ8MTXP02IKOEM.19.13.B02.1.454.CMB.2.raw
tcagtactctcgtgcacgaccggtgctcgatttagtctagcgacttccgcggggagctctgggagaggagccccagcactagaagtcggcggtgtttccattcggtgatcagcactgaacacagaggactcaccatggagtttgggctgagctgggttttcctcgttgctctttttaagaggtgtccagtgtcaggtgcagctgggtggagtcgtgggggagcgtggtccagccgtggggacggtccctgacgactctcctgtgcagccttcgtggactttcacctttcagtacgctatcggcagtgcctacgtcggggtcccgccaggcctaccgacgggcgtaagggggctaggggacggtggggtcggacctaagtttatatactaattatagtagtaggtaaagttaaattaaaattactagtcggactaaagtaccgtacggtaggaacgggtccgtattaccacctatacctcagacgactaacgtaccaaagaaccacgtactagtactactagaacaaagtacgaactcgacgtagacgagcgtaggacgaccgacgtcgtagtgttacgtacgtggtacgacggtaggcgtaag

SEQ ID NO: 321219 - DNA, 586 bp, Homo sapiens
  misc_feature: GZ8MTXP02IXF2N.19.13.B02.1.454.CMB.2.raw
  modified_base (259)..(259): a, c, t, g, unknown or other
  misc_feature (259)..(259): n is a, c, g, or t
  modified_base (309)..(309): a, c, t, g, unknown or other
  misc_feature (309)..(309): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgagactctcctgtgcngcctcgtggattcaccttcagtagctatggcatcgcacgtcggggtcccnccgaggcctccgagggcgaaggggctgggaggtggggtgccgtagttatatcattagtgagttagggaaaactaaataaaattactagtgacgaagtacgtccgtaggaacgggcctaagttccacctactactaccaagacgaactaaacttaaccgaaacgtaaccaccgtctagtaactacgttagaactaaatagaaacacgacctaggagtagacgtagacggacgacggtactagtcgtaattacgtaggtcgacggtaggggtacgtaag

SEQ ID NO: 321220 - DNA, 697 bp, Homo sapiens
  misc_feature: GZ8MTXP02HSO2J.19.13.B02.1.454.CMB.2.raw
  modified_base (266)..(266): a, c, t, g, unknown or other
  misc_feature (266)..(266): n is a, c, g, or t
  modified_base (313)..(313): a, c, t, g, unknown or other
  misc_feature (313)..(313): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggaggcgtggtccagccgtgggagtccctgagctctcctgtgcagccctnggacttccaccttcagtagctatggctatgcctacgtcggggtcccncaggtcctaccgagggccgaagggggtctaggggtaggtgggggttggacccgtaaggtttatactacgaagttagtaaggtagttaaaggggtaaaaactttaaaattaaaaacgttaccgtaagtacgaaccgaaacgtaaccgttacccgggtaagggtaaaccggggtcccgtaaatttaccccggaaccctaaactttaccccgtaacccgaaagtaaacgtaaaacctaaaccggttaaacccaaaacggtaaaccaaccgtccgttaagtaactaccgtacgaaacaaagtacgaaaccgtagacctaggacgtagccgtaggacgtaccgacgtacgtgtaacgttacttaggcggtagaccggaaggtacgtaag

SEQ ID NO: 321221 - DNA, 621 bp, Homo sapiens
  misc_feature: GZ8MTXP02FM14Q.19.13.B02.1.454.CMB.2.raw
  modified_base (196)..(196): a, c, t, g, unknown or other
  misc_feature (196)..(196): n is a, c, g, or t
  modified_base (266)..(266): a, c, t, g, unknown or other
  misc_feature (266)..(266): n is a, c, g, or t
  modified_base (391)..(391): a, c, t, g, unknown or other
  misc_feature (391)..(391): n is a, c, g, or t
  modified_base (580)..(580): a, c, t, g, unknown or other
  misc_feature (580)..(580): n is a, c, g, or t
tcagtactctcgtgcacgaccggtgctcgatttagtctagcgacttccgcggggagctctgggagaggagcccggcactagaagtcggcggtgtttccattcggtgatcagcactgaacacagaggactcaccatggagtttgggctgagctgggttttcctcgttgctcttttaagaggtgtccagtgtcaggtncagctggtggagtcgtgggggaggcgtggtccagcctgggaggtccctgacgactctcctgtgcagcctntggattcaccttcagtagctttggcatccacgtcgggtccgcccgaggcctccgaggccgaaaggggctaggagggtggggtcggctaggtttactagtcatagtgaagttagggaagttaaatnttaaagttagtagggaacgtacgtccggtaggaaacggggccgtaattacacctatccctaccaagacgaaactaacttaccgaaacgaaaccaacgtagtggacttacgtacggaacaaaagtacgaaacgtagaccgtagaagacggtcgtacgggggaccacggtcgttggttacgttattaccgnggtaggccggaggacggcggtgtacggaactaacgtaaccg

SEQ ID NO: 321222 - DNA, 587 bp, Homo sapiens
  misc_feature: GZ8MTXP02FIWR8.19.13.B02.1.454.CMB.2.raw
  modified_base (281)..(281): a, c, t, g, unknown or other
  misc_feature (281)..(281): n is a, c, g, or t
  modified_base (313)..(313): a, c, t, g, unknown or other
  misc_feature (313)..(313): n is a, c, g, or t
  modified_base (360)..(360): a, c, t, g, unknown or other
  misc_feature (360)..(360): n is a, c, g, or t
  modified_base (367)..(367): a, c, t, g, unknown or other
  misc_feature (367)..(367): n is a, c, g, or t
  modified_base (394)..(394): a, c, t, g, unknown or other
  misc_feature (394)..(394): n is a, c, g, or t
  modified_base (467)..(467): a, c, t, g, unknown or other
  misc_feature (467)..(467): n is a, c, g, or t
tcagtactctcgtgcacgaccggtgctcgatttagtctagcgacttccgcgggggagctctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtggagtcgtggggggagcgtggtccagccgtggggacgtccctgagactctcctgtgcagcctgtggatcaccttnagtagctagtggcatgccacgtcggggtcccnccgaggcctccggaggcgaaggggctgggaggtggggtgctagttanatcatangataggaaattaaataaaactattaangacaagtaccgtacgtaggaacggccgtaattaccaccctatccaccaagaacgaaacaaacttaccgaaaanaacacgactagtactctagaacaaatacgaaacacggaccaggacgtagacgaggaacggacgtaaccgggtgttagttaagttaacgttacggtaggtacggacggacgggtacgtaag

SEQ ID NO: 321223 - DNA, 622 bp, Homo sapiens
  misc_feature: GZ8MTXP02GV6ZH.19.13.B02.1.454.CMB.2.raw
  modified_base (179)..(179): a, c, t, g, unknown or other
  misc_feature (179)..(179): n is a, c, g, or t
  modified_base (530)..(530): a, c, t, g, unknown or other
  misc_feature (530)..(530): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgcttcttttaagnggtgtccagtgtcaggtgcagctggtggagtcgtgggggagcgtggtccagccgtggggagtccctgacgactctcctgtcgcacgcctgtggacttcaccttcagtagctatggcatcgcctacgtcggggtcccacctagggcctaccggagggcggaagggggtctggggaggtggggtcgacctagttatagtcaattagtggattaggggaaaacttaaattaaaatactagtgactacgaccgttccgggtagaacggggtcctaattccaacctctaccgtacgagaacgtaactaacttaaccgaaacgaaccacgtactagtacttacgacgaacgtaaaanaacgaacgacgacgtacgacggagacggacggacggacgtacgtacgtagtaagttacgttacgtcggtacggtacggtacggtacggtacg

SEQ ID NO: 321224 - DNA, 541 bp, Homo sapiens
  misc_feature: GZ8MTXP02HFZUC.19.13.B02.1.454.CMB.2.raw
  modified_base (403)..(403): a, c, t, g, unknown or other
  misc_feature (403)..(403): n is a, c, g, or t
  modified_base (431)..(431): a, c, t, g, unknown or other
  misc_feature (431)..(431): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggaggtccctgagctctcctgtgcagcctctggattcacttcagtagctatggctatgcacgtgggtcccgcaggctccgaggcgaaggggctaggagtggggtgcctagtatatcatatgagtggaaagtaaataaatctaatgacagactccgtagacggcgatcacntctaccagagacacttacaagtaacacnctagtatctagaacaaagtacgaaacacgcctaggaacgacgtacgtaggaacgacgacggcttaggtggttaacttacgtcggttacggcggtacggggtacgttaagg

SEQ ID NO: 321225 - DNA, 684 bp, Homo sapiens
  misc_feature: GZ8MTXP02JWKZA.19.13.B02.1.454.CMB.2.raw
  modified_base (263)..(263): a, c, t, g, unknown or other
  misc_feature (263)..(263): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggaggcggtggtccaggccgtgggacggtccctgagactctctgtncagcctctgacttcaccttcagtgctatggcatgctacgtcgggtccgccgaggtcctaccggagggtaccggaaagggggtccttagggggtaggtgggggttaggtaccccgtaaagggtttattagtaccgaattagttaggtagtaggggtaaaataaaattaaaagtacttagcgtaaccagtacccgttacggtaggaaacggggtaccctaacgttaccaaccgtacttaccgaccgagtaaaccggaaacttaaacttacccgaaaggtaaaccaccgtcgttaacgtaactttacgaacggtaacctaaagtaccgtaaacgacgtaccgtaaggacgacggtacgacggacggaacgacggttacttaggtaacggttaacttgtacggtaggacggacggtacggttaag

SEQ ID NO: 321226 - DNA, 664 bp, Homo sapiens
  misc_feature: GZ8MTXP02GAJC0.19.13.B02.1.454.CMB.2.raw
  modified_base (178)..(178): a, c, t, g, unknown or other
  misc_feature (178)..(178): n is a, c, g, or t
  modified_base (318)..(318): a, c, t, g, unknown or other
  misc_feature (318)..(318): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagnggtgtccagtgtcaggtgcagctggtggagtcgtgggggaggcgtggtccagccgtgggacggtccctggacgtactctcctgtgcacgcctcgtggtacttcaccttcagtagctatggcatgccgacgtcgggtcccnccgaggcctccggagggccgaaggggctgggaggtggggtgacctagttatatcattagtgagtagggaaaattaaataaatacgtatgacgtacgaccgttcggaggaacggccgtaacttccgaaccgtactacctacgaacgtaacgaaacctaaacgttaaccgaaacgaaaccgtaccgtacttaacgtaaccttacggtaactaaccgtaaaagttccggaaaaccgtaggacccgttaaggaacggtacggtacgtaaacggggaacgaccgtacggtcgtttaggttaacggttaactttacggtggtacggtacgggtaacggggtacgtttaacgg

SEQ ID NO: 321227 - DNA, 580 bp, Homo sapiens
  misc_feature: GZ8MTXP02GS7VL.19.13.B02.1.454.CMB.2.raw
  modified_base (196)..(196): a, c, t, g, unknown or other
  misc_feature (196)..(196): n is a, c, g, or t
  modified_base (267)..(267): a, c, t, g, unknown or other
  misc_feature (267)..(267): n is a, c, g, or t
  modified_base (307)..(307): a, c, t, g, unknown or other
  misc_feature (307)..(307): n is a, c, g, or t
  modified_base (349)..(349): a, c, t, g, unknown or other
  misc_feature (349)..(349): n is a, c, g, or t
  modified_base (352)..(352): a, c, t, g, unknown or other
  misc_feature (352)..(352): n is a, c, g, or t
  modified_base (387)..(387): a, c, t, g, unknown or other
  misc_feature (387)..(387): n is a, c, g, or t
  modified_base (422)..(422): a, c, t, g, unknown or other
  misc_feature (422)..(422): n is a, c, g, or t
  modified_base (431)..(431): a, c, t, g, unknown or other
  misc_feature (431)..(431): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttggctgagctgggttttcctcgttgcttcttttaagaggtgtccagtgtcaggtncagctggtgagtcgtgggggagcgtggtccagccgtgggacggtccctggacgctctctgtgcagcctcgnggacttcacctcagtagctatggcatgcacgtcgggtccncaggcctcgaggcgaaggggctaggaggtggtgcctagttanatnatatagataggaaaattaaataaactataatcganaagaccttacggagaacggctaattacaccatccncaagacaanaactacaaacgacacgactagtaactcgagaacaaataacgaaacgacgaccgtacgaggacgtacgtacggaacggaaccgacggtaccgttagtaacggttaactttaacgttacgttcggtacggaacggggtacgggttaaacgg

SEQ ID NO: 321228 - DNA, 631 bp, Homo sapiens
  misc_feature: GZ8MTXP02G7JS0.19.13.B02.1.454.CMB.2.raw
  modified_base (350)..(350): a, c, t, g, unknown or other
  misc_feature (350)..(350): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccagccgtgggacgtccccgagactctcctgtgcagcctctgattccaccttcagtacgctagtggcagtcgcaccgtggggcccaccaggccctaccgaggccgaaggggctgggagtgggngactagttatactcaatagtagagtagggtaaattaaataaaactctaagtcgacgtaacgtactcggtaggaacgggctaacttaccaacctactaccgtaccgaagaacgaacctaaacgttacccgaaacggtaaaccacgtccttaggtaactaccgtaagaacctaaaagaacgaacgtaacgaccgtacgaagacgaccgtaggaacggaacgacggtaccgtagttacgttaacgttacgtacggtacggtacggaggtaccggtacgtaacgg

SEQ ID NO: 321229 - DNA, 714 bp, Homo sapiens
  misc_feature: GZ8MTXP02HXPFB.19.13.B02.1.454.CMB.2.raw
  modified_base (382)..(382): a, c, t, g, unknown or other
  misc_feature (382)..(382): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctgggtggagtcgtgggggagcgtggtccgagccgtgggacggtccctgagactctcctgtgcacgcctctggacttcaccttcagtacgctagtggcagtcgcgaccgtcgggtcccgccgaggtcctccgaggcggaaggggcgtggtagggtggggtcggcctaagttatagtctaaatntagtagttaaggggtaaaattaaaacgttaaaagtaacttaagtacgaccgtaaagtacccgtacggtaacgggaacgggtaccgtaactttacccgaacttactacccgttacccgaaagggtaaacctaaaccgtaaaacttacccgaaaacgtaaaccgaccgtaccgtttagtaccttacgaacggaaacctaaagtaaccgaaaaccgttacggaacccgttaggaaacgtacggtaccgtaaggggaaccggtaaccgcggttacgttacgttaaggttaaacgtttacgtacggggtggacccgggtaaagggtttccggtaacg

SEQ ID NO: 321230 - DNA, 784 bp, Homo sapiens
  misc_feature: GZ8MTXP02J0422.19.13.B02.1.454.CMB.2.raw
  modified_base (725)..(725): a, c, t, g, unknown or other
  misc_feature (725)..(725): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagcgtggtggagtcggtgggggagcgtggtccaggccgtgggacggtccctgacgtactctccgtgtcgcagcctcgtggacttccaccttcaaggtacgcttagtggactagtcgacctacggtcggggtccccgccgtacggtcccgtacccggaggggtaccggaaacggggggtcgttagggggacggggtttcgggggtacggtaccgttaaggtttacgtacttacgtaagttagtaggtagtaaaggggtaaaattaaaattaaaagtctaaagttacgacctaaacggtacccgttaccgggtaacgggaaaccggggtccctaaagttacccaaccgtaacgttacccgacgaaagaacggtaaaccttaaaaccgttacccgaaaagtaccgtaaccgttacgttaacggtaactttacccgtaaagaaacccgttaaaagtaccgaaaaccgttacggacccgtaagggaaaacggttacgaccggtaaacgggaccgttaacgacccggggttnttaaggtttcgttaaaacgttcggtaggtacgggacgggtaacggggtaccgtttaagg

SEQ ID NO: 321231 - DNA, 601 bp, Homo sapiens
  misc_feature: GZ8MTXP02HW1ES.19.13.B02.1.454.CMB.2.raw
  modified_base (306)..(306): a, c, t, g, unknown or other
  misc_feature (306)..(306): n is a, c, g, or t
  modified_base (353)..(353): a, c, t, g, unknown or other
  misc_feature (353)..(353): n is a, c, g, or t
  modified_base (361)..(361): a, c, t, g, unknown or other
  misc_feature (361)..(361): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgagactctcctgtgcagcctctggattcaccttcagtagctatggcatgcacgtggggtcccnccagggcctccgagggcaaggggctggggagtggggtggccagttanagtcatangattagggaaaacttaataaatactatgacacgactcccggtagaacggggccaagtttcacctatccgtaccaagacgaactaacgttacccaaaggaacctaacggtctagttatcctacggaactaaacgtagaaaccgagacccgttacggagtaacgctagggaaacgaccgaacgggtccttaggtaaggttaacgtttacggtacggtcggaccggtagggtaccggttaaag

SEQ ID NO: 321232 - DNA, 593 bp, Homo sapiens
  misc_feature: GZ8MTXP02GZKWV.19.13.B02.1.454.CMB.2.raw
  modified_base (316)..(316): a, c, t, g, unknown or other
  misc_feature (316)..(316): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagccgtgggacgtccctgacgactctcctgtcgcagccctcgtggtacttccaccttcagtacgctagtggcatgcacgtgggtcccncgaggcctcgagggcgaaggggctggggaggtggggtgcctagttatagtcatatgagtagggaaaataaataaaagtctagtcgacagtacctccggtagaacggggtcctaattccacctatcctaccagacaactaacttaccaaagaaccacgtacgttatacgtacctagaacaaagtacgaaccgagacccgtaagacggagtaccgtaggaacggacgaaccgggttcgttagtaagttacgtacgtcggtaggacggtacggtacgtag

SEQ ID NO: 321233 - DNA, 554 bp, Homo sapiens
  misc_feature: GZ8MTXP02FKWOT.19.13.B02.1.454.CMB.2.raw
tcagtactctcgtgcacgaccggtgctcgatttagtctagcgacttccgcgggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggaggtccctgagactctcctgtgcagcctctggattcaccttcagtagctatggcatgcacgtgggtcccgccaggcctccgaggccgaagggggctggggaggtggggtggcctagttatatcatatgagtagggaaagttaaataaatactatgacagactccgtagaacgggcgattcaccatctcagacgactaataccaaagaacacgacctagtatctagactaaatcgaacacgcctagacgagcgtaggaacggacgacggcgttaggtaagttaacttacgtggtcggacggtaggggtacgttaagg

SEQ ID NO: 321234 - DNA, 655 bp, Homo sapiens
  misc_feature: GZ8MTXP02JCDC7.19.13.B02.1.454.CMB.2.raw
  modified_base (264)..(264): a, c, t, g, unknown or other
  misc_feature (264)..(264): n is a, c, g, or t
  modified_base (307)..(307): a, c, t, g, unknown or other
  misc_feature (307)..(307): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggacgtccctgagactctctgtgcagcctntggattcaccttcagtagctagtggcatgctacgtgggtcccncgaggctccgaggcgaaggggctgggagtggggtgccagttatatctaatagtgagtagggaaaagttaaataaaacttacgtagtacgactaacgtaccgttcccggtagggaaaccgggtaccgtaacttacccaccctaattcccaccgaagaacgtaaacctaaacgtttacccaaaacggtaaaccaccgtacttacggttaactaccgttacggaacctaaaagttaccggtaaaaccgacggtaccgtacggaaacgaggtacccgtagggaacggacccgagggtaccttggttaacgttacttaccggttggacggtacgggtaacggtcggttaaacg

SEQ ID NO: 321235 - DNA, 623 bp, Homo sapiens
  misc_feature: GZ8MTXP02GTWHW.19.13.B02.1.454.CMB.2.raw
  modified_base (304)..(304): a, c, t, g, unknown or other
  misc_feature (304)..(304): n is a, c, g, or t
  modified_base (347)..(347): a, c, t, g, unknown or other
  misc_feature (347)..(347): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggagtccctgagactctcctgtgcagcctctggattcaccttcagtagctatggcatgcacgtggtcccncaggcctccgaggcaaggggctgggagtggggtgcctagttanagtcatatgatggaaataaataaatactaatgacagacgtaccggtagaaacgggtccagttccaccgactacctaccagaacgaaactaaacttaccaaagtaaccgacgtacgttagtactacgtacgaactaaaacgttacgaaaccgacgtacccgtaggaacggtacgtaccggttaagggaaacggtaccgaaacccgggtcgtttacggttaaggtttaactttaaccggttggttacggaccggtaagggggttaccggtttaaacgg

SEQ ID NO: 321236 - DNA, 602 bp, Homo sapiens
  misc_feature: GZ8MTXP02IXKHX.19.13.B02.1.454.CMB.2.raw
  modified_base (309)..(309): a, c, t, g, unknown or other
  misc_feature (309)..(309): n is a, c, g, or t
  modified_base (354)..(354): a, c, t, g, unknown or other
  misc_feature (354)..(354): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggacggtccctgagactctcctgtgcagcctctggattcaccttcagtagctatggcatgctacgtggggtccccncgaggctccgagggcgaaggggctgggagtggggtgcctagttanatcgatagtgatcgggaaataataaatactaagtgacagacgtccgtagaacgggccgtattcgacctatcctaccagacgaactaacttacccaaagtaaccaccgtacgtacgtactccgtacgactaaaaacgttcgaaacgtacgacccgttacggacgaaggccgtaggaacggtaccgaacgggtcttacggttaagttaacgttacgttaggtcggaccggtaaggggtaccgtttaaagg

SEQ ID NO: 321237 - DNA, 614 bp, Homo sapiens
  misc_feature: GZ8MTXP02GD3KB.19.13.B02.1.454.CMB.2.raw
  modified_base (266)..(266): a, c, t, g, unknown or other
  misc_feature (266)..(266): n is a, c, g, or t
  modified_base (311)..(311): a, c, t, g, unknown or other
  misc_feature (311)..(311): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggccgtggggagtccctgagactctcctgtgcagcctntggattccaccttcagtagctagtggcatcgcacgtggggtcccnccgaggcctccgagggccgaagggggctagggaggtggggtgcctagttatatcatagtgacgtagggaaaagtaaattaaaatacttaagtcgacaagtaccgtaccggtaggaaacgggccgtaattccaacctatcctaccgagaacgaactaattacccaaagaaccacgtactagtactacgtagaactaaactgaaacgtacgaccgtaggaacgagtaccgtaggaacggtaccgacgggtcttaggtaagtttacgttaaccgtggtacggacggtaacgggtacggtttaaagg

SEQ ID NO: 321238 - DNA, 716 bp, Homo sapiens
  misc_feature: GZ8MTXP02G8LOW.19.13.B02.1.454.CMB.2.raw
  modified_base (313)..(313): a, c, t, g, unknown or other
  misc_feature (313)..(313): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggagtccctgagactctcctgtgcacgcctcgtggacttcaccttcagtagctatggctatggcacgtcggggtcccnccgaggcctcgagggcgaaggggctggaggtggggtaggcccaaggtttatactcgtagtatggtatagggtaaaagttaaataaaatactaagtcgacaagtaccgtacccggtaggaaacgggggtcctaaagtttccaaacccgtatcccgtacccagaaacgaaactaaacgttaacccgaaaacgtaaaaccgtaccggtacttacgttaaccgttacctacggtaaactaaaacgttaacggaaaccgaaaccggtaccgttaaccgggaaagggtaccggttaccgtaaaggggaaccgggtaaaccgacccggggttaccgttagggttaaccgttttaaacgtttaacggtcggtttacgggaacccggggtaggggtaacccggtttaaacgg

SEQ ID NO: 321239 - DNA, 696 bp, Homo sapiens
  misc_feature: GZ8MTXP02IGNQ0.19.13.B02.1.454.CMB.2.raw
  modified_base (196)..(196): a, c, t, g, unknown or other
  misc_feature (196)..(196): n is a, c, g, or t
  modified_base (204)..(204): a, c, t, g, unknown or other
  misc_feature (204)..(204): n is a, c, g, or t
  modified_base (269)..(269): a, c, t, g, unknown or other
  misc_feature (269)..(269): n is a, c, g, or t
  modified_base (311)..(311): a, c, t, g, unknown or other
  misc_feature (311)..(311): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtncagctggnggagtcgtgggggagcgtggtccagccgtggggacggtccctgagactctcctgtgcagcctcgnggacttcaccttcagtagctagtgcatgcacgtcggggtccnccgaggcctccgaaggggccgaaagggggcttaggggaaggttgggggacggccctaaggttttaatacgtacgtaagttagtggtagttaagggtaaaattaaaacgttaaaatacttagtacgtaccgtaacgtaaccgtaccggttaacggaacgggtccgtaacgttacccgaacctactacccgtaccgaacgaaacgtaaacctaaacttaacccgaaaacgtaaaccgtacgtaccgttaagttactacgtaacgaacgtaaaagtaacgaaacgaacgtaccgtaggaacggtacgtacgtaagggaacggaccgtacggtacgttagttaacgttaacgtttacgtacggtacggtacggtacgggtacggtaacg

SEQ ID NO: 321240 - DNA, 664 bp, Homo sapiens
  misc_feature: GZ8MTXP02JK99Y.19.13.B02.1.454.CMB.2.raw
  modified_base (273)..(273): a, c, t, g, unknown or other
  misc_feature (273)..(273): n is a, c, g, or t
  modified_base (287)..(287): a, c, t, g, unknown or other
  misc_feature (287)..(287): n is a, c, g, or t
  modified_base (292)..(292): a, c, t, g, unknown or other
  misc_feature (292)..(292): n is a, c, g, or t
  modified_base (380)..(380): a, c, t, g, unknown or other
  misc_feature (380)..(380): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcgaggtgcagctggtggaggtcgtgggggaggcggtggtccgagccgtgggacggtccctgagactctcctgtgcagcctntggacttcaccttnagtanctatggcagtgcctacgtcgggtcccgcgaggcctccggaggccggaaggggctgggaggtggggtggaccgtagttatatcattagngagtagggtaaaagttaaattaaacttactagttacgacgtaaacgtaccgttaccggaagggaaccgggtaccctaacgtttacccaacccgtacttaccccgtaccgaaacggtaactaaacctaaacttaacccgaaaacgaaaccctaccgtacgtttaacgttactacgtacgaaacaaaacgtacgaaacacgtacgtaaggacgacggcgtacggaacggaccgtacgtcgttagtaagttacgttacgtggtacgacgggtaacggtcgttaaacg

SEQ ID NO: 321241 - DNA, 652 bp, Homo sapiens
  misc_feature: GZ8MTXP02I10E0.19.13.B02.1.454.CMB.2.raw
  modified_base (408)..(408): a, c, t, g, unknown or other
  misc_feature (408)..(408): n is a, c, g, or t
  modified_base (607)..(607): a, c, t, g, unknown or other
  misc_feature (607)..(607): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggacgtcctgagactctcctgtgcagcctctggacttcaccttcagtagctatcggacatgctacgtggggtcccaccgtaggctacccgagggccgaaggggctggggagtggggtcggactaggtttactatcaatgtagagtagggaaattaaagtaaaacttacgttaancgtaaacaacggtacccgttacggtacgggaacgggtaccgttaaactccgtaacccctaagtacccctacccgaaagaaccggtaaacccttaaacttaaccccgaaaacggtaaccacccggttattaggtaactacgtagaaccaagttacaacgtacgctaggagacgtcggaaaggaccgtacgtaccgggttntacggttaagttacgtacggtcggttaggacggtaggtacgtaag

SEQ ID NO: 321242 - DNA, 840 bp, Homo sapiens
  misc_feature: GZ8MTXP02HOJQK.19.13.B02.1.454.CMB.2.raw
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagtcttgggttttcctcgttgtcttcttttaagaggtgtccagtgtcgaggtgcagcgtgggtggaggtcggtggggggaggcggttcggtccgaggtcccgtgggggacggttccccgtggacgtaccttccgttccgtggtcgctacggcccttcgtggtattcccaccctttcaggtacgccttagtggactagtggcctacggtcggggtccccgcacgggcctaccggagggaccggaaagggggtcgtaggggacgggtgggggtcggtacccgtaggtttaactacgttacgtaagttaaggttggtaaggttaacgggggttaaaaatttaaaaacgttaaaagttaccgttaagaacggtacccgaaacggttaacccgtacccgggggtttaaagggaaacccgggggtcccgtttaaactttaccccgaaaccccgttcttacccgtaaccccggtaaagaaaccgtaaaccttaaacctttaacccgaaaagttaacccgaaccggtacctttaacgtaaccgttacgtaacgaaaccgttaaaacgacggaaaaccgtaccgttaaccgtaaggtaaaggccggttaaaccggtacgggaccggaaaaccgacggggttcctttaaggtaagtttaacgttacccggtaggtcggacggggtaacgggttcggtaaacg

SEQ ID NO: 321243 - DNA, 762 bp, Homo sapiens
  misc_feature: GZ8MTXP02GTAD1.19.13.B02.1.454.CMB.2.raw
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctggggacgtccctgagactctcctgtgcagcctcgtggtacttccaccttcgagtagctagtcggcagtgcctacggtcgggtcccgaccgagggtcctaccggagggacgaaagggggccttaggggaggttcgggggtaggacccgtaagggtttaactagttccgaaagtttagtacgggtagttagggaaaagtttaaaaccttaaaagttaccgtaagttacggactaaagtaaccgttacccggtagggaaacgggggtaccctaaagtttacccaacccgtaacttcccgtaacccgtaaaggaaccgtaaaacctaaactttaacccgaaacggtaaaccaccggtacttacggtactaccggttacgaacctaaaagtaccggaaaactacggtacccgtaacgggaacggtagtaccggtaagggaaacggtaacccggaaccgggtacgttacgggttaacgttaacgtttaaccggttgggttacccgggaacgggtaaggggtaccgtttaaacggg

SEQ ID NO: 321244 - DNA, 721 bp, Homo sapiens
  misc_feature: GZ8MTXP02G3G2E.19.13.B02.1.454.CMB.2.raw
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgcttcttttaagaggtgtccagtgtcgaggtgcagcgtggtggagtcgtgggggaggcgtggtccagccgtgggaggtcccgtgagtactctcctgtcgcagcctctggtattccaccttcagtagcctagtggccagtcgcctacggtcggggtccccgccgagggtccctaccccggagggtaccggaagggggtccgttaggggagggttcgggggttaggaccccgtaaggtttatatcgaagtttagtagggtagttaaggggtaaaaatttaaattaaaaaccgttagttaaatcggtaaacgtaaacgggtacccgtttacccggggttaaaggggaaaccggggttaccccgtaagtttaccccaacccgtacgtttacccacccggtaaaggacctaaaaccgtaaccttaaacccgaaagtaaccgaccggtcttaggtaacctatacgaaataaactacgaacgacgacctagagtagtcgaggacggacgcggtcgttagtaagttacgttacgtcggtaggaccggttagggaccggttaag

SEQ ID NO: 321245 - DNA, 506 bp, Homo sapiens
  misc_feature: GZ8MTXP02FQOCY.19.13.B02.1.454.CMB.2.raw
  modified_base (327)..(327): a, c, t, g, unknown or other
  misc_feature (327)..(327): n is a, c, g, or t
  modified_base (343)..(343): a, c, t, g, unknown or other
  misc_feature (343)..(343): n is a, c, g, or t
  modified_base (351)..(351): a, c, t, g, unknown or other
  misc_feature (351)..(351): n is a, c, g, or t
  modified_base (492)..(492): a, c, t, g, unknown or other
  misc_feature (492)..(492): n is a, c, g, or t
tcagtactctcgtgcacgaccggtgctcgatttagtctagcgacttccgcgggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggaggtccctgagactctcctgtgcagcctctggatcaccttcagtagctatggcatgcactgggtccgccaggctccaggcaaggggctgggngtggggtgccagttanatcagtangatgggaaagtaaataaatactatgacagactccggtagaaggccgattcaaccatctcagagacaattaccaagaacacgactgtactctagacaaatgaaacagacctgagagcagacggacacggctgtgtattacgngtgcgaggcgtaag

SEQ ID NO: 321246 - DNA, 686 bp, Homo sapiens
  misc_feature: GZ8MTXP02H2MNY.19.13.B02.1.454.CMB.2.raw
  modified_base (286)..(286): a, c, t, g, unknown or other
  misc_feature (286)..(286): n is a, c, g, or t
  modified_base (657)..(657): a, c, t, g, unknown or other
  misc_feature (657)..(657): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggtttttcctcgttgtcttctttttaagaggtgtccagtgtcaggtgcagctggtggagtcgtgggggaggcgtggtccagccgtgggacggtccctgagactctcctgtgcacgcctctggacttcaccttnagtagctagtggacatgcctacgtcggggccccacgaggtcctaccgagggacggaagggggctaggggtacggtggggtacgtaccgtaggtttaatagtactaattagtagtagttaaggggtaaaattaaattaaaagtacctaagtcaacgtacgaccgtacccggtaggaaccgggtacctaagttacccaacgtacttaccgacccgaagtaactaaacgtaaaccttacccgaaaagtaaccgaacgtccgtaagttaactacgtaacgaaacctaaaagttacgaaaacctacgaaccgtaggaaacgtacgacgtaacggacggttaaccgacggtcgttagttaaggttaactttaacggngggttcgaacgggtacgggtacgtaaacg

SEQ ID NO: 321247 - DNA, 645 bp, Homo sapiens
  misc_feature: GZ8MTXP02JNF05.19.13.B02.1.454.CMB.2.raw
  modified_base (181)..(181): a, c, t, g, unknown or other
  misc_feature (181)..(181): n is a, c, g, or t
  modified_base (313)..(313): a, c, t, g, unknown or other
  misc_feature (313)..(313): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagtcttgggttttcctcgttgcttcttttaagnggtgtccagtgtcaggtgcagctggtggagtcgtgggggagcgtggtccaggccgtgggacgtccctgacgctctcctgtgcagcctctggacttccaccttcagtagctatggcatgctacgtcgggtccnccgaggcctccggagggccgaaggggtctagggaggtggggtgaccgtaggtttatatcgtagttagtagtagtaagggtaaagttaaataaaagtactaagtagacaacgtaccgtacggtaggaacggccgtacttaccacctatcctacagaacgtaactaaacttaccaaacgaaccgtacgtacttagtaactcgtagtaacaaagttacgaaacgtacgtaccgagtaaggacgaacgtacgggaaacggtacccgaggttaccgtaggttaacgttaacgtttacggttaggtacggtacgggtaacggggttacggtaaacggg

SEQ ID NO: 321248 - DNA, 661 bp, Homo sapiens
  misc_feature: GZ8MTXP02HSCA8.19.13.B02.1.454.CMB.2.raw
  modified_base (197)..(197): a, c, t, g, unknown or other
  misc_feature (197)..(197): n is a, c, g, or t
  modified_base (322)..(322): a, c, t, g, unknown or other
  misc_feature (322)..(322): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtncagctggtggagtcgtgggggagcgtggtccaggccgtggggacggtccctggacgactctccgtgtcgcacgcctcgtggacttccaccttcgagtagctagtggcatgctacgtcgggtcccncgaggcctccgagggcgaaaggggctggggaggtggggtaggcccgtaaggtttactatcagttagtagagttagggtaaaacttaaattaaaactactagtcgacaagtaccgtacggtaggaacgggtccatttaccgaacctacttccaccgtaagtaacgaacttaaacgtaccgaaaacgtaactaaccgtcgtagttaactccgtaagaaccctaaaagtaccgaaacgtacgacctaggaaacgacgacgttacgggaacggtaccgacgggtaacctttgggtaacgtttagttaccgttagggtcggtacggtaacggggtacgtaacgg

SEQ ID NO: 321249 - DNA, 721 bp, Homo sapiens
  misc_feature: GZ8MTXP02GPH83.19.13.B02.1.454.CMB.2.raw
  modified_base (250)..(250): a, c, t, g, unknown or other
  misc_feature (250)..(250): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccagccgtgggacgtccctgacnctctcctgtgcagcctgtggattcaccttcagtagctagtgcagtcgcctacggtcggtccgacccgagggtcctaccccggaaggggacccgtaagggggggtcccgttagggggtaacggttcgggggggttacggaccccgttaaaggtttaacgtataccgtaagtttaagttagggtaggttaaaggggtaaaattaaattaaaacgttacgtaagtacgacgtaaacgtaccgttacccggtagggaaaccggtccgtaacttccgaacctactcccgtacgaaacgtacgaaactaaccttaaccgaaacgtaaccgacgtactagtaacctgtacgaactaaacgtacgaaacgtacgtaccgaggaacgacgtacggtaacgggaacggaccggtacggttaccgttaggttaacgtttaacgttaggttacggtggaccggtaagggtaccggtttaaagg

SEQ ID NO: 321250 - DNA, 601 bp, Homo sapiens
  misc_feature: GZ8MTXP02JL9ZV.19.13.B02.1.454.CMB.2.raw
  modified_base (179)..(179): a, c, t, g, unknown or other
  misc_feature (179)..(179): n is a, c, g, or t
  modified_base (267)..(267): a, c, t, g, unknown or other
  misc_feature (267)..(267): n is a, c, g, or t
  modified_base (310)..(310): a, c, t, g, unknown or other
  misc_feature (310)..(310): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgcttcttttaagnggtgtccagtgtcaggtgcagcgtggtggagtcgtgggggagcgtggtccagccgtgggacgtccctgagactctcctgtgcagcctntggattcactttcagtagctagtggcatgctacgtgggtcccnccgaggcctccgagggcgaaggggctagggaggtggggtgcctagttatatctagtatgagtagggaaacgttaaataaaatctaagtgacagtacctccggtaggaacgggccgtattacccacctacttccctaccgaagaacgtaactaaacttaaccgaaaagaaccacgtacttagtactctagaactaaatacgaaacacgaccgtagacgacgcgtaaggacggaccgacgggtacttaggtaacgttaacttacgtggtacggaccggtagggtacggtaacg

SEQ ID NO: 321251 - DNA, 640 bp, Homo sapiens
  misc_feature: GZ8MTXP02GXFZZ.19.13.B02.1.454.CMB.2.raw
  modified_base (381)..(381): a, c, t, g, unknown or other
  misc_feature (381)..(381): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagcgtggtggagtcgtgggggaggcgtgggtccgagccgtggggacggtccccgtggacgtaccttcctccgtgtgcagccctgtggtacttccaccttcagtacgtcctagtggaccagtcgcgtacggtccggggcccgaccgacggcctaccgagggcgaaggggcttggggaggtggggngcctagtatatcgatagtagagtaggtaaaagtaaataaaactacgtaatcgagtaacgaccgtccggtaggaaacgggcctacttaccgaccctactacctaccgaaggacgaaactaaacttaaccaaacgtaaacgaaccgtctagtactaccgtataaccaaaagtacgaaacgacgaccgtagagacgtaccgaggaacggaccgtacggacgtagtaagttaacttagtaggacggacggtacggtacgtaag

SEQ ID NO: 321252 - DNA, 581 bp, Homo sapiens
  misc_feature: GZ8MTXP02FG7PJ.19.13.B02.1.454.CMB.2.raw
  modified_base (309)..(309): a, c, t, g, unknown or other
  misc_feature (309)..(309): n is a, c, g, or t
  modified_base (351)..(351): a, c, t, g, unknown or other
  misc_feature (351)..(351): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgagactctcctgtgcagcctctggattccaccttcgagtagctagtggcatgcacgtggggtcccncaggcctccgagggcaaggggctgggagtgggtgccagttanatcatatgatagggaaattaaataaaatactagtcgacaagacctccggtaggaacgggtccgtaattaccgaccctatcctacaagacgaaactaactaccaaagaaccacgactagtactctagaactaaatacgaaactacgaccgtaggaacgagtaccgtaggaacggtacgacggcttaggtaacgtaacttacgtggtacggacggtacgggtacggttaacg

SEQ ID NO: 321253 - DNA, 809 bp, Homo sapiens
  misc_feature: GZ8MTXP02F1A54.19.13.B02.1.454.CMB.2.raw
  modified_base (327)..(327): a, c, t, g, unknown or other
  misc_feature (327)..(327): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggacgtccctgagactctcctgtgcagcctctaggtacttacctacccttcgagtacgtctagtggaccatcgaccgtacgtcggggtacccnccggtaggcctacccggagggacgaaacgggggtctaggggaacggtgggggttacggaccttaaggtttaataacgttactaaaggttaagttagggtaaggttaaacgggtaaaaaggttaaaaattaaaaactttaccgttaaagtaccgggaacctaaacgggttacccgtacccggttaaggggaaaaccggggacccttaaacgttcccaaacccgtactacccgtaacccgaaaagaaccgtaaaacctaaaactttaacccgaaaacggtaaccacccgggttaccttaaggttaaccttacgtaaacggtaaaccttaaaaagtacgtaaaaaccgacggtaccccgttaaggaaaggtaaccggaccggttaaaggggaaaccggtaaaccgtaccggggtaccgtttaggttaaccgggtttaattacccggtttacgggaggtaaccggggtacgggtaaccggttaagg

SEQ ID NO: 321254 - DNA, 631 bp, Homo sapiens
  misc_feature: GZ8MTXP02G7VM6.19.13.B02.1.454.CMB.2.raw
  modified_base (320)..(320): a, c, t, g, unknown or other
  misc_feature (320)..(320): n is a, c, g, or t
  modified_base (371)..(371): a, c, t, g, unknown or other
  misc_feature (371)..(371): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagcgtggtggagtcgtggggggaggcgtggtccagccgtgggacggtccctgagactctcctgtgcagcctcgtggtacttccaccttcagtagctagtggcagtgcctacgtcggggcccncgaggccgtaccgagggccgaaggggctgggaggtggggtgacctagttanagtcaatagttagagttaggaaaagttaaataaaacgttaataagtgacaagtaccgtaccggtaaggaaacgggtcccgtaatttaccaacccaactacgtacccgaagtaacgaaactaaacttaacccaaaacgtaacaaccgtactactataccgtagaaacctaaaagtacgaaaccgagacccgtaaggaagaggtaccagggaacgaacgaccggtgtagtgtaacttacgcggtgacggtagggtacgtaag

SEQ ID NO: 321255 - DNA, 585 bp, Homo sapiens
  misc_feature: GZ8MTXP02JF17M.19.13.B02.1.454.CMB.2.raw
  modified_base (303)..(303): a, c, t, g, unknown or other
  misc_feature (303)..(303): n is a, c, g, or t
  modified_base (541)..(541): a, c, t, g, unknown or other
  misc_feature (541)..(541): n is a, c, g, or t
  modified_base (562)..(562): a, c, t, g, unknown or other
  misc_feature (562)..(562): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggagtccctgagctctcctgtgcagcctctggattcaccttcagtagctatggcatgcacgtcggggtccnccgaggcctccgagggcgaaggggctggggaggtggggtgcctaggttatatcatattgagtgggaaagtaaataaatactatgacagtacgtccgtaggaacgggcctagttcaccgtatcctaccgagacgaactaaacttaccaaaaggtaaccacgtacgtagttaactccgtagaacctaaaagtacgaaacgacaccgtaggaagtaggaccgtaggacggacgaccgggtnttaggtaaggtacttaacggnggtcggacggtagggtacgtaag

SEQ ID NO: 321256 - DNA, 586 bp, Homo sapiens
  misc_feature: GZ8MTXP02I25I3.19.13.B02.1.454.CMB.2.raw
  modified_base (198)..(198): a, c, t, g, unknown or other
  misc_feature (198)..(198): n is a, c, g, or t
  modified_base (265)..(265): a, c, t, g, unknown or other
  misc_feature (265)..(265): n is a, c, g, or t
  modified_base (418)..(418): a, c, t, g, unknown or other
  misc_feature (418)..(418): n is a, c, g, or t
  modified_base (495)..(495): a, c, t, g, unknown or other
  misc_feature (495)..(495): n is a, c, g, or t
  modified_base (503)..(503): a, c, t, g, unknown or other
  misc_feature (503)..(503): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtncagctggtggagtcgtgggggagcgtggtccagcctgggacgtccctgagctctcgtgtgcagcctncggattcaccttcaagtgctaagtcggacagtcgctacgtcgggtcccgaccagggccctaccgacgggcgaacgggggtctaggggacgggtggggtcggaccctaggttaactatactattagtgacgtaggtaaaactaaattaaacgtntaagcaacagactacgtacggacggactgtacactactacgacagacgtaacaataccgaaatacacgtctagtacncgtacganaacacgaacgacgacgacgagacgacgacgacggacgacgtacgtagtaacgtacgttacgtcgtacgtcgacgtacggtacg

SEQ ID NO: 321257 - DNA, 534 bp, Homo sapiens
  misc_feature: GZ8MTXP02HGY6U.19.13.B02.1.454.CMB.2.raw
  modified_base (278)..(278): a, c, t, g, unknown or other
  misc_feature (278)..(278): n is a, c, g, or t
  modified_base (346)..(346): a, c, t, g, unknown or other
  misc_feature (346)..(346): n is a, c, g, or t
  modified_base (380)..(380): a, c, t, g, unknown or other
  misc_feature (380)..(380): n is a, c, g, or t
  modified_base (451)..(451): a, c, t, g, unknown or other
  misc_feature (451)..(451): n is a, c, g, or t
  modified_base (456)..(456): a, c, t, g, unknown or other
  misc_feature (456)..(456): n is a, c, g, or t
  modified_base (458)..(458): a, c, t, g, unknown or other
  misc_feature (458)..(458): n is a, c, g, or t
  modified_base (461)..(461): a, c, t, g, unknown or other
  misc_feature (461)..(461): n is a, c, g, or t
tcagtactctcgtgcacgaccggtgctcgatttagtctagcgacttccgcgggggagctctgggagaggagcccagcactagaagtcggcggtgtttccattcggtgatcagcactgaacacagaggactcaccatggagttttgggctgagctgggttttcctcgttgctcttttaagaggtgtccagtgtcaggtgcagctggtggagtcgtgggggagcgtggtccagccgtgggagtccctgagactctctgtgcagcctctggattcaccttnagtagctatggcatgcacgttgggccccgaggctccgaggcgaagggctggagtgggtgactagttanatcgatagtgagtgggaaaattaaataaatatanaggacaagtactccgtagaagggccattacaccatcaccagactaacaattaccaagaacacgacttatanctaananaanacaacacacgacgagagacgacgacgacgacgtacgtagtaagtagtacgtacgtaggacggacggtacgtag

SEQ ID NO: 321258 - DNA, 614 bp, Homo sapiens
  misc_feature: GZ8MTXP02FNGZQ.19.13.B02.1.454.CMB.2.raw
  modified_base (243)..(243): a, c, t, g, unknown or other
  misc_feature (243)..(243): n is a, c, g, or t
  modified_base (305)..(305): a, c, t, g, unknown or other
  misc_feature (305)..(305): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtcccngagctctctgtgcagcctgtgtatccaccttcagtagctagtgcatcgctagtcgggtcccnccaggcctccgagggcgaaggggtctaggggagtggggtcgaccgtagttatacgtctaagtagtagtagtagggaaattaaaataaattactagtacgacgtaacgtacgtccggtaggaacggtccgtaacttccacctatacccgtaccaagaacgtaaacctaacttaaccgaaacgaaacgacgtaccttagtactactagaacctaaagtacgaaacgacgtacccgtagaacggaggtacgtaggaacgacgaaccggtgttagtaagttacgttacgtaggtcgtacggaggtacgttaag

SEQ ID NO: 321259 - DNA, 725 bp, Homo sapiens
  misc_feature: GZ8MTXP02FR8XZ.19.13.B02.1.454.CMB.2.raw
tcagtactctcgtgcacgaccggtgctcgatttagtctagcgacttccgcggggagctctggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggaggtccctgagactctcctgtgcagcctcgtggtacttcaccttcagtagctatggacatgcgtaccgtcggggtcccgccgaggtccctaccgagggtaccgaaaggggggtcctaggggacggttggggggtgaccccgtaagggttttacaattccgtaattaggttaggtagtaggggaaaatttaaataaaacttactaagtcgaccgtaacgtaccgttaccggtagggaaacgggtcccgtaattccaaccctatacccgtacccgaaagaaccggaaactaaaccgtttaccaaaacggaaccgtaacgtaccgttagttaacctacgttacgaaactaaaacgtacgaaacccgaaaagtcccgtaacggtaaggaacggaccggttaagggaaacgggaacccggtaacccggggttcgtttacggttaagtttacgttacggtacgggtcgggaccgggtaacggggtacggtaag

SEQ ID NO: 321260 - DNA, 668 bp, Homo sapiens
  misc_feature: GZ8MTXP02FVEGR.19.13.B02.1.454.CMB.2.raw
  modified_base (248)..(248): a, c, t, g, unknown or other
  misc_feature (248)..(248): n is a, c, g, or t
  modified_base (271)..(271): a, c, t, g, unknown or other
  misc_feature (271)..(271): n is a, c, g, or t
tcagtactctcgtgcacgaccggtgctcgatttagtctagcgacttccgcgggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagcgtggtggagtcgtgggggaggcgtggtccagccgtgggaggtcccngacgctctcctgtgcagcctcgnggtattcaccttcgagtagctagtcggcatgcacgttcggggcccacgaggtcctccgagggaccgaagggggccttggggaggtggggtagccctaaggtttatactcgaattagttaggagtaggggtaaaacttaaaattaaaagttacctaaagtcgactaaggtacctacccgggtaggaaacggggtcccgtaattacccgaccttacgtacctaccgaaacgacgtaaacctaaacttacccgaaaagaacccgacggtacttacgtaacttccgtagaaaccttaaaagcggaaaaccacggtcctaggagaccgttgacggacgtaacgaccgggttattacggtaagttacgttacggtcgggtaggtacggtacgggtacgtaacg

SEQ ID NO: 321261 - DNA, 538 bp, Homo sapiens
  misc_feature: GZ8MTXP02FR8ZY.19.13.B02.1.454.CMB.2.raw
  modified_base (258)..(258): a, c, t, g, unknown or other
  misc_feature (258)..(258): n is a, c, g, or t
  modified_base (263)..(263): a, c, t, g, unknown or other
  misc_feature (263)..(263): n is a, c, g, or t
  modified_base (281)..(281): a, c, t, g, unknown or other
  misc_feature (281)..(281): n is a, c, g, or t
  modified_base (331)..(331): a, c, t, g, unknown or other
  misc_feature (331)..(331): n is a, c, g, or t
  modified_base (427)..(427): a, c, t, g, unknown or other
  misc_feature (427)..(427): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgagctctcctgtgcngcctntggatcaccttcagtagntatgcatgcacgtcggtccgccgaggcctcgagggcgaagggggctgggngtggggtgcctagttacatcatatgatagggaaattaaataaatacttagtgacagaccgtccggtagaacgggcgattccacctatctccaaganaactacttacaaacgtacacgctagtactctagacaaagtacgaacgacgacgtcgagtagcgtaggacggaccgacggctagtgtatacgtgtcgacggtaggtcgtaag

SEQ ID NO: 321262 - DNA, 705 bp, Homo sapiens
  misc_feature: GZ8MTXP02HF8SC.19.13.B02.1.454.CMB.2.raw
  modified_base (313)..(313): a, c, t, g, unknown or other
  misc_feature (313)..(313): n is a, c, g, or t
  modified_base (381)..(381): a, c, t, g, unknown or other
  misc_feature (381)..(381): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagccgtgggacgtccctgacgctctcctgtgcagccctgtggacttccaccttcagtagctagtgcatgcctacgtcgggtcccnccgaggtcctccgagggacgaacggggctggggaggtggggtcggacctagttatactctagttaagngagtagggtaaaacgttaaattaaaactatagtacgacgaacgtacgttaccggtaggaaccggggtaccctagttacccaccctacttcccgtaacccgtaaagaacgtaaacctaaacgtttaaacccgaaaacggtaaaccctaccggtacctacggttaaactccgttaacggaaactaaaacgttcgggaaaacctacggtacccgttaaaggacggtacgtacccggtaaggaaacggacccgtaaccggggtaccttagggttaacgtttaacgttaccggttggaaccggtaccggaaggggttaccgtttaaagg

SEQ ID NO: 321263 - DNA, 599 bp, Homo sapiens
  misc_feature: GZ8MTXP02JAG6X.19.13.B02.1.454.CMB.2.raw
  modified_base (266)..(266): a, c, t, g, unknown or other
  misc_feature (266)..(266): n is a, c, g, or t
  modified_base (279)..(279): a, c, t, g, unknown or other
  misc_feature (279)..(279): n is a, c, g, or t
  modified_base (307)..(307): a, c, t, g, unknown or other
  misc_feature (307)..(307): n is a, c, g, or t
  modified_base (363)..(363): a, c, t, g, unknown or other
  misc_feature (363)..(363): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggacggtccctgagactctcctgtgcagcctntggattcaccttnagtagctatggcatgcacgtgggtcccnccgaggcctccgagggccgaaggggctgggagtggggtgcctagttatatcattangatagggtaaataaataaatactatgacagactcggtagaacggcctatacacctatcctaccagacgaacaaacttaccaaacgtaaccacgtacttagtactacgttacgactaaaactacgaaacacgtaccgtaacggagtacggcgtaacggaaacgggtaccgaacggtccgttaggtaacgttaacgtttaccggtaggtacgggtaccgggtaagggtacggttaagg

SEQ ID NO: 321264 - DNA, 610 bp, Homo sapiens
  misc_feature: GZ8MTXP02FK0EM.19.13.B02.1.454.CMB.2.raw
  modified_base (263)..(263): a, c, t, g, unknown or other
  misc_feature (263)..(263): n is a, c, g, or t
  modified_base (307)..(307): a, c, t, g, unknown or other
  misc_feature (307)..(307): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgagctctcctgtgcagcctntggattcaccttcagtagctagtggcatgcacgtcggggtcccnccgaggcctccgagggccgaaggggctaggggaggtggggtggcctaggttatatcaatagtgagtaggaaagttaaataaagtactatgacagtacgtccggtaggaacgggtcctaagttaccacctactaccctacaagaacgaaacctaaacttaccgaaacgaaaccgacgtaccgttagtacttaccgtagaacaaaagtcgaaaacgacgtaccgtaggaacggagtaccgtaggaacggaccgaccggtcgttagtaacgttattaacgtggtacggacggtagggtacggtaag

SEQ ID NO: 321265 - DNA, 717 bp, Homo sapiens
  misc_feature: GZ8MTXP02F796I.19.13.B02.1.454.CMB.2.raw
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagcgtggtggagtcgtgggggagcgtggtccagccgtgggacggtccctgagtactctccgtgtgcagcctctggattcaccttcagtagctatcggcagtgcctacgtcggggtcccgccgaggcctccggagggcgaaagggggtcctaggggaggtaggggtggacccgtaaggtttatagttactaagttaagttggtagttacgggaaaagttaaattaaaacttacgtaagttgacaacgtacgtacccggtaggaaacgggtcccggtaactttacccaacccgtataccctaccgaaggaacgaaacctaaacttacccgaaacgaaacctaaccgtccgttagtaacttaccgtagaacctaaaagtacgaaacgtacgtacccgtaggaacggagtacgttaacggggaacggaacccgtaccggggttacttcggggttaaacgttaagtttttaaacccgggggtacggttacgggtaccgggttaacggggtaccggttaaacgg

SEQ ID NO: 321266 - DNA, 722 bp, Homo sapiens
  misc_feature: GZ8MTXP02IV71H.19.13.B02.1.454.CMB.2.raw
  modified_base (195)..(195): a, c, t, g, unknown or other
  misc_feature (195)..(195): n is a, c, g, or t
  modified_base (607)..(607): a, c, t, g, unknown or other
  misc_feature (607)..(607): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttggctgagctgggttttcctcgttgctcttttaagaggtgtccagtgtcaggtncagctggtggagtcgtgggggagcgtggtccagccgtgggacgtccctgacgtactctctgtgcagctcgtgacttcaccttcagtagcgtaatcggactagttcgacgtacgttcgggtccccgacccgaggccctacccggaaggggcccggaaagggggtccttaggggacgggttcgggggtagaccccgttaggtttaaactcgttacgtaaattagtagggtacggttagggtaaaattaaacttaaacgttaactagtacggtacaacggtaccgttacccggtaggaacggggtcccgtaagtttacccgaacccttacttacccgtaacccgtaaggtaaccgaaaaccttaaaccgttaaccgaaaacgtaaccacggtaccctttagtaacttccggtaanaacgaaacgtaacgaacgtacgtacgtacggtacggacgtacgtacggacggacgtacggtacgttacgttaacgttacgttacgttacggtacggtacggtacggtacggtacg

SEQ ID NO: 321267 - DNA, 673 bp, Homo sapiens
  misc_feature: GZ8MTXP02GDAO3.19.13.B02.1.454.CMB.2.raw
  modified_base (195)..(195): a, c, t, g, unknown or other
  misc_feature (195)..(195): n is a, c, g, or t
  modified_base (373)..(373): a, c, t, g, unknown or other
  misc_feature (373)..(373): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctgttgctcttttaagaggtgtccagtgtcaggtncagctggtggagtcgtgggggagcgtggtccagccgtgggacgtccctgagactctctgtgcacgcctgtggtattccaccttcgagtacgctagtcggcatcgcacgtggtacccgccgaggcctccgagggacgaagggggtcctaggggtacggtggggtccgacgtaggtttanagtcagttagtgtacgtagggaaattaaactaaactagtatgacagtacgttaccggtaggaacgggtcctacttacaccgattccaaccgaggtaacgaaacctaaacgttacccgaaaacgttaccgaaccgtccgttaaggtaaccttagttacggaaacccttaaaagaacgtaaacgaacgtacccgtacggtacggtaacggtacggtaaggaacgggtaaccgaccggtaccgttacggtaacggttaacgttaacgttacgggttcggtaggacggtaccggtttaaacggg

SEQ ID NO: 321268 - DNA, 584 bp, Homo sapiens
  misc_feature: GZ8MTXP02GGM23.19.13.B02.1.454.CMB.2.raw
  modified_base (255)..(255): a, c, t, g, unknown or other
  misc_feature (255)..(255): n is a, c, g, or t
  modified_base (262)..(262): a, c, t, g, unknown or other
  misc_feature (262)..(262): n is a, c, g, or t
  modified_base (273)..(273): a, c, t, g, unknown or other
  misc_feature (273)..(273): n is a, c, g, or t
  modified_base (283)..(283): a, c, t, g, unknown or other
  misc_feature (283)..(283): n is a, c, g, or t
  modified_base (307)..(307): a, c, t, g, unknown or other
  misc_feature (307)..(307): n is a, c, g, or t
  modified_base (376)..(376): a, c, t, g, unknown or other
  misc_feature (376)..(376): n is a, c, g, or t
  modified_base (518)..(518): a, c, t, g, unknown or other
  misc_feature (518)..(518): n is a, c, g, or t
  modified_base (521)..(521): a, c, t, g, unknown or other
  misc_feature (521)..(521): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggacgtccctgagactctctgncagcctntgatcaccttnagtagctagnggacatgctacgtcggggtacccnccgaaggtccctccgaagggacgaaacgggggtctaggggaggtggggtgaccctagttatatcattangagtaggaaagtaaataaactacgtaatcgactaaacgtacgttacccggtaggaaacggggtacctaacttacaaccctaagttccaccgagaacgaaactaacttaccaaagaaccacgctagaactctagataaagaanaanacgacacgagagacgagacgacgacgtacgtagtgtacgtacgtagtagacggacggacgtag

SEQ ID NO: 321269 - DNA, 597 bp, Homo sapiens
  misc_feature: GZ8MTXP02JZF0Q.19.13.B02.1.454.CMB.2.raw
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggaggtccctgagacctctcctgtgcagcctctggattcaccttcagtagctatggcatcgcacgtggggtcccgccaggcctaccgagggcgaaggggctagggaggtggggtgccaggttatatcatagttagagtagggaaataaactaaagtactatgacaacgtacgttaccgtaggaacgggcccgtagtttaccacctagttccctaccgagtaacgaacctaaacgttaccaaagaacctacgtacttagtattcgtagaactaaagtacggaaacacgaccgtaggaacgagaccgtaggacggacgaccggtctaggttaagttacttacgtggtacggcggtacggtcgtag

SEQ ID NO: 321270 - DNA, 780 bp, Homo sapiens
  misc_feature: GZ8MTXP02GOCA4.19.13.B02.1.454.CMB.2.raw
  modified_base (689)..(689): a, c, t, g, unknown or other
  misc_feature (689)..(689): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagtcttgggttttcctcgttgtcttcttttaagaggtgtccagtgtcaggtgcagcgtggtggagtcggtgggggaggtcggtggtccgagccgtggggacgtcccgtgacgtacctcgttcctgtcgcgacgtcccttcgtggtacttcctaccttccgaaggttacgtaccttagtcggtacagttcggccgttaaccggtccggggtccccacccggacgggtccccgttaccggaacggggaccgggtaaacgggggtccggttagggggtaaggggttcgggggttaggtacccccttaaagggtttactaaagttacctaaagttagttaagggttaggtaaaggtaaaacggttaaaatttaaaactacgtacgttacgacgtaacggtaccgtaccggtaaggaaccgggtactacttaccgacctacgtacctacgaacgtaacgaaactaacgtaaccgaaacgaaccgacgtaccgttaagacgttacctaacgaactaaacgtcgaacgacgtacccgtagaccggtanaccggtaggtacggtacgtaccggttggtttaccgtaagtttaaccgttagttaccgggtagggtaccggtagggtaaccggggtttaacg

SEQ ID NO: 321271 - DNA, 663 bp, Homo sapiens
  misc_feature: GZ8MTXP02J1CF4.19.13.B02.1.454.CMB.2.raw
  modified_base (182)..(182): a, c, t, g, unknown or other
  misc_feature (182)..(182): n is a, c, g, or t
  modified_base (243)..(243): a, c, t, g, unknown or other
  misc_feature (243)..(243): n is a, c, g, or t
  modified_base (264)..(264): a, c, t, g, unknown or other
  misc_feature (264)..(264): n is a, c, g, or t
  modified_base (306)..(306): a, c, t, g, unknown or other
  misc_feature (306)..(306): n is a, c, g, or t
  modified_base (358)..(358): a, c, t, g, unknown or other
  misc_feature (358)..(358): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtntccagtgtcaggtgcagctggtggagtcgtgggggagcgtggtccagccgtgggagtcccngagctctcctgtcgcagcctntggattcaccttcagtagctatggcatgcacgtcggggtccnccgaggctccgagggcaaggggctggggaggtggggtgcctaggttatactnattagtgagtgggtaaaattaataaacgtactaatcggacaacgtaccgtaccggtaggtaaacggggccgttaacttccaaccctacgtaccgttacccgaagaacgtaaacctaaaactttacccgaaaacggtaaccctaaccgggtacctttagttaacgttccttaacggaaacttaaaacgttcggaaaacctaccggtaccgtaaggaacggacggaccgttaggggaaccgacggaaccggttcgttaggttcgttaacgtttacgagggttcggaccggtaaggggtcgttaacgg

SEQ ID NO: 321272 - DNA, 674 bp, Homo sapiens
  misc_feature: GZ8MTXP02HDGJY.19.13.B02.1.454.CMB.2.raw
  modified_base (600)..(600): a, c, t, g, unknown or other
  misc_feature (600)..(600): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggacgtcctgagctctcctgtgcagcctcgtggacttccgaccttcagtagctagtcggacatgcctacgtcggggtcccgccgtaggccctaccgaggggacccggaaagggggccgttaggggaagggttggggtacggaccccgtaggtttaattacgtactaagttagtggtagtagggtaaaagttaaattaaaatacttaagtacgacctagtaccgtcccgggtagaaacgggggtcctaaacgttccaacctacgttcctacccgaagaacgtaaacctacttaaccgaaactaaacgttaccgttagttactacgttacgaacttaaacgacgtaaccgtacggtacctaggaacgngaccgtagggaaacggtaccgacggttacgtgttagtaacgttacgtgtacggacgtaacgggcgtaaatccgg

SEQ ID NO: 321273 - DNA, 664 bp, Homo sapiens
  misc_feature: GZ8MTXP02HW8T0.19.13.B02.1.454.CMB.2.raw
  modified_base (270)..(270): a, c, t, g, unknown or other
  misc_feature (270)..(270): n is a, c, g, or t
  modified_base (427)..(427): a, c, t, g, unknown or other
  misc_feature (427)..(427): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagcgtggtggagtcgtgggggagcgtggtccaggccgtgggagtccctgacgactctcctgtcgcacgcctcnggtacttcacccttctaaggtgctatcggccagtcgccgtacgtcggggtccccgccgaggcctccggaggccgtaagggggctggggaggtggggtcggacctagttatacgtactatagttacgagtacgggtaaagtaaaattaaactacgtancgactagtaccgtacgtacggaaacgggtcccgaagtttccaacctacgtaccaccgaagaacgaaactaaacgttaccaaaagaacctacggtactacgtaattccgacgaacaaaacttacgaaccaacgtaccgtaggaacgtacggccgtaagggaaacggtaccgaacggggttcctagggtttaagttacgttaaaccgttggttacggccggtaagggtacccggttaag

SEQ ID NO: 321274 - DNA, 600 bp, Homo sapiens
  misc_feature: GZ8MTXP02I6MNX.19.13.B02.1.454.CMB.2.raw
  modified_base (310)..(310): a, c, t, g, unknown or other
  misc_feature (310)..(310): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggaggtccctgagactctcctgtgcagcctctggattcgaccttcagtagctagtcggcatgcacgtggggtcccncgaggcctccgagggcgaaggggctgggagtggggtgcctagttatagtctatatgagtagggaaattaaactaaagtactatgacaagactaccggtagaacgggccgtaacgttccaacctacttcctaccaaggaacaaactaacgttaaccaaacgaaacaccgtacctagtactaccgtagaacctaaaagtacggaaactgtaccctagaggacgtacgtaggaacggacgtacggtcttagtaagtaagtttacggtacggtacggacggtacggtacggtag

SEQ ID NO: 321275 - DNA, 654 bp, Homo sapiens
  misc_feature: GZ8MTXP02G6AWR.19.13.B02.1.454.CMB.2.raw
  modified_base (203)..(203): a, c, t, g, unknown or other
  misc_feature (203)..(203): n is a, c, g, or t
  modified_base (362)..(362): a, c, t, g, unknown or other
  misc_feature (362)..(362): n is a, c, g, or t
  modified_base (372)..(372): a, c, t, g, unknown or other
  misc_feature (372)..(372): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcacatggagtttgggctgagctgggttttcctcgttgctcttttaagaggtgtccagtgtcaggtgcagctggnggagtcgtgggggagcgtggtccagcctgggagtcctgagactctcctgtgcagcctctggacttcaccgttcagtagctatggctaatcgcacgtggggcccgtaccagggctccgaggacgaaggggctagggacggtgggtcgacgtagttaactntacagttagngagtaggtaaaacgtaaataaaatgtatagacagtaaccgtaccggtaggaaacgggtacctaacgttccaaacctactccgtaacccgaagaactaaacgttaaaaccttaaacggaaaaccaaacgtaacccggttacgttaacgttactaccgtaacgaacgtaaacgtaacgaaacgtaccgacgtaggaacgtaggacgtaacggacggtaacgacgtaccgttaaggtaacgttaaacgttacggtacggacggtacggtaacggtaacggtaacg

SEQ ID NO: 321276 - DNA, 602 bp, Homo sapiens
  misc_feature: GZ8MTXP02I5YRI.19.13.B02.1.454.CMB.2.raw
  modified_base (178)..(178): a, c, t, g, unknown or other
  misc_feature (178)..(178): n is a, c, g, or t
  modified_base (264)..(264): a, c, t, g, unknown or other
  misc_feature (264)..(264): n is a, c, g, or t
  modified_base (278)..(278): a, c, t, g, unknown or other
  misc_feature (278)..(278): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagnggtgtccagtgtcaggtgcagctggtggagtcgtgggggagcgtggtccagccgtgggacgtccctgagctctcctgtgcagcctntggacttcaccttnagtacgctagtcggctagtcgactacgtcggggtccccaccgaggcctacccgagggaccgaaggggctaggggaggtggggtcggactagttatatctattagagtagtagggaaaagttaaataaatacgtatagacagtaccgtcggtagaacgggctataccacctagtcctacagacgaactaaactaccgaaaggaaccacgtactagtactacgtagtaaaccaaagtagtaaaccgacgtcctaggaacgacgtacgtacggaacggacgtaacggtcttagtaagttatacgtggtgaccggtaggtacggtaag

SEQ ID NO: 321277 - DNA, 742 bp, Homo sapiens
  misc_feature: GZ8MTXP02JSB0Y.19.13.B02.1.454.CMB.2.raw
  modified_base (287)..(287): a, c, t, g, unknown or other
  misc_feature (287)..(287): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggtttttcctcgttgtctcttttaagaggtgtccagtgtcaggtgcagctggtggagtcgtgggggaggcgtggtccagccgtgggaggtccctgacgactctcctgtcgcagcctctggacttcgaacccttnaagtacgcttagtggctagtcgcctacgtcggggtcccacccgaggtccacggtacgggcgtaaacggggctgggaggtcggggtgaccctaggttatagccgtataacgtagtagtaagggtaaataaagtaaacttaactagttacgacttaaacgaccgttacccggtaagggtaaccgggtaccggtaacttaccgtaacccaacgttacccgtaccccgtaaaggaacgtaaaacccgtaaaccgtttaaacccgaaaacggttaaacccgaccccgttagttaacgttaacgtaccccgtttaggaaaccctaaaggttacgaaaacctacggttacccgttaaggaaaacggttcgaacccgggttagttaaacgggaccggtaacggtaaccggttgtaacgttacgttaaccgtggtaccggtccggtaaggtaccggttaaacgg

SEQ ID NO: 321278 - DNA, 616 bp, Homo sapiens
  misc_feature: GZ8MTXP02G4PZD.19.13.B02.1.454.CMB.2.raw
  modified_base (162)..(162): a, c, t, g, unknown or other
  misc_feature (162)..(162): n is a, c, g, or t
  modified_base (180)..(180): a, c, t, g, unknown or other
  misc_feature (180)..(180): n is a, c, g, or t
  modified_base (285)..(285): a, c, t, g, unknown or other
  misc_feature (285)..(285): n is a, c, g, or t
  modified_base (341)..(341): a, c, t, g, unknown or other
  misc_feature (341)..(341): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttccncgttgcttcgttttaagnggtgtccagtgtcaggtgcagctggtggagtcgtgggggagcgtggtaccagccgtgggacgtccctgacgactctctagtgcagcctcgaggtacttcaccttnagtgctagtggcatgcacgtggccacgagctaccgaggcgaagggtcaggggtagnggggtcgacgtagtttacatcatatagagtaacggaaattaaactaaagtctaagtcgactaaacgtaccgtaccgggtaagaaaccggggtcctaattacccaacctaacgacctaccgaagtaaaccgaaccttaaacgtaccgaaaacgaaccacggtactagttaactccgtaaacaaacgtaaacgaacgaacgacgacgtacgacgacgacgacgacggacgacgtacgtagtaagttacgtacgtacgtaggacggacggtacgtacg

SEQ ID NO: 321279 - DNA, 634 bp, Homo sapiens
  misc_feature: GZ8MTXP02G3OXI.19.13.B02.1.454.CMB.2.raw
  modified_base (296)..(296): a, c, t, g, unknown or other
  misc_feature (296)..(296): n is a, c, g, or t
  modified_base (305)..(305): a, c, t, g, unknown or other
  misc_feature (305)..(305): n is a, c, g, or t
  modified_base (355)..(355): a, c, t, g, unknown or other
  misc_feature (355)..(355): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggatcgtgggggagcgtggtccagcctgggagtccctgagctctctgtgcagcctcgtggacttcaccttcgagtagctagtggcatgccncgtggcccncaggctccgagcgagggctgggagtcgggtgaccgtagtatatcgatagngagtaggaaagtaaataaaatactatagaccaagtacccgttaccggttaaggaaccggggtacgtaacgttaccaaacccgtactaccgtacccgaaaggaacgaaaccctaaacttaaacccgaaaacggtaaactaacccgggtactttaacgtaactaccggttacaaaccgttaaaagacgtaaacgtacgacccgttaaggagtacgactagggacgaacgtacggtcttaggtaacgttagtacgttaggaggtccggaaggtcggttaaag

SEQ ID NO: 321280 - DNA, 661 bp, Homo sapiens
  misc_feature: GZ8MTXP02I951H.19.13.B02.1.454.CMB.2.raw
  modified_base (180)..(180): a, c, t, g, unknown or other
  misc_feature (180)..(180): n is a, c, g, or t
  modified_base (592)..(592): a, c, t, g, unknown or other
  misc_feature (592)..(592): n is a, c, g, or t
tcagtactctcgtgcacgaccggtgctcgatttagtctagcgacttccgcgggggagctctgggagaggagcccagcactagaagtcggcggtgtttccattcggtgatcagcactgaacacagagactcaccatggagtttgggctgagcttgggttttcctcgttgcttcttttaagnggtgtccagtgtcaggtgcagcgtggtggagtcgtgggggagcgtggtccaggccgtggggacgtccctggacgccttctccgtgtcgcgagcctgtggacttcctaccttcaagtgacctagtggaccagtcgctaccggtcggtcccgccgaggcctaccgagggcggtaaggggctggggaggtggggtacgacgttagttactagtacaagttacgtagtaggtacggtaaaagtaaaattaaaaccgtattaagtacgacgtaacgtacccgtacggtaagggaaccgggtccctaagttacccaaccctacttaccctaccgaaggtaactaaaccgtaaactaccgaaaacggtacctacgtacctagtaactcgtaagaacaagtaacgaacacgtctaagganagcgtaagggacgtaccgtacggtcttagtaacgttacgttacggtcgtaggaccggtaggtacgtacg

SEQ ID NO: 321281 - DNA, 567 bp, Homo sapiens
  misc_feature: GZ8MTXP02GVRHY.19.13.B02.1.454.CMB.2.raw
  modified_base (249)..(249): a, c, t, g, unknown or other
  misc_feature (249)..(249): n is a, c, g, or t
  modified_base (260)..(260): a, c, t, g, unknown or other
  misc_feature (260)..(260): n is a, c, g, or t
  modified_base (294)..(294): a, c, t, g, unknown or other
  misc_feature (294)..(294): n is a, c, g, or t
  modified_base (296)..(296): a, c, t, g, unknown or other
  misc_feature (296)..(296): n is a, c, g, or t
  modified_base (330)..(330): a, c, t, g, unknown or other
  misc_feature (330)..(330): n is a, c, g, or t
  modified_base (342)..(342): a, c, t, g, unknown or other
  misc_feature (342)..(342): n is a, c, g, or t
  modified_base (385)..(385): a, c, t, g, unknown or other
  misc_feature (385)..(385): n is a, c, g, or t
tcagtactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagcgtggtttctcgttagctctttaagaggtgtcagtgtcaggtgcagctggtggagtcgtagggggagcgtggtccaggccgtgggagtccctgagactntccgtgtgacngccctgtgacttcacttcgagttacgctatgganangcgtacgtcggtccgcgacgcgacgagacgaggngtaggaggtggngtcgtagtatatatatatagtagaagaaagtaaataaatatanagacgacgacgtacgtacgacgacgtactacacactactacgacgaacgaactaactaaacgaaacgaacgaacgtacgtagtacgtacgtacgaacgaacaagaacgacgacgacgagagacgacgacgacgacgtacgtacgtaacgtacgtacgtacgtacggacggacggtacgtacg

SEQ ID NO: 321282 - DNA, 534 bp, Homo sapiens
  misc_feature: GZ8MTXP01DPDX3.3.12.B01.1.454.CMB.2.raw
  modified_base (199)..(199): a, c, t, g, unknown or other
  misc_feature (199)..(199): n is a, c, g, or t
  modified_base (320)..(320): a, c, t, g, unknown or other
  misc_feature (320)..(320): n is a, c, g, or t
  modified_base (348)..(348): a, c, t, g, unknown or other
  misc_feature (348)..(348): n is a, c, g, or t
  modified_base (358)..(358): a, c, t, g, unknown or other
  misc_feature (358)..(358): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtcgtccggggganagagcccaccctctcctgcagggccagtcagagtgttgacagcaacttggcctggtaccagcagcaacctggccaggctcccaggctcctcatctatgatgcatccacagggccacggtancccagccaggttcagtcgcagtgggtcnggggaacagngtcactctacaccatcagcagcctgcagtctgagtatttgactaatttattactgtcagtctagtaataataactggtgtacgttcggaccgaaaggggaccaaagggtaagaaattacgaaaacgaacgtagtggacttggacaaccattctgtcttctaacttccttaaccccg

SEQ ID NO: 321283 - DNA, 510 bp, Homo sapiens
  misc_feature: GZ8MTXP01CBFE2.3.12.B01.1.454.CMB.2.raw
  modified_base (353)..(353): a, c, t, g, unknown or other
  misc_feature (353)..(353): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgaggggagagagccaccctctcctgcagggccagtcagagtgttgacagcaacttggcctggtaccagcagcaactggccaggctcccaggctcctcatctatgatgcatccacaggcccacggtatcccagccaggttcagtggcaggtgggtcagggacngacgttcactctcaccatcagcagcctgcagtctgagtatttgctagtttatactggtcagtcattaacaataacgtgtcctcgtctcgtacgttcggcggaggaccgaaaggttggaagtagttacgaacgactgtggctgcactaacgttcgtcg

SEQ ID NO: 321284 - DNA, 513 bp, Homo sapiens
  misc_feature: GZ8MTXP01BWGZF.3.12.B01.1.454.CMB.2.raw
  modified_base (286)..(286): a, c, t, g, unknown or other
  misc_feature (286)..(286): n is a, c, g, or t
  modified_base (319)..(319): a, c, t, g, unknown or other
  misc_feature (319)..(319): n is a, c, g, or t
  modified_base (352)..(352): a, c, t, g, unknown or other
  misc_feature (352)..(352): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaactggccaggctccaggctcctnatctatgatgcatccaccgagggcccacggtancccagccaggtcagtggcaggtggtctgggacnggagttcactctcaccatcagcagctgcagtctgagtatttgctagtttattactgggtcagtctaattacaataactggacctcggtctctacgtttgggcggagggaccgaagggttggagtattacgaaacgacgtggtggctcgcactaagttctcg

SEQ ID NO: 321285 - DNA, 538 bp, Homo sapiens
  misc_feature: GZ8MTXP01C4RN7.3.12.B01.1.454.CMB.2.raw
  modified_base (197)..(197): a, c, t, g, unknown or other
  misc_feature (197)..(197): n is a, c, g, or t
  modified_base (283)..(283): a, c, t, g, unknown or other
  misc_feature (283)..(283): n is a, c, g, or t
  modified_base (397)..(397): a, c, t, g, unknown or other
  misc_feature (397)..(397): n is a, c, g, or t
  modified_base (521)..(521): a, c, t, g, unknown or other
  misc_feature (521)..(521): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccacctgtctgtgtctcgagggganagagtcaccctctcctgcagggccagtcagagtgttgacagcaacttggcctggtaccagcagcaactggccaggctccagctccncatctatgatgcactcccaccgacgggcccaaccggtactccccaagcccagggttccaaggttcggactagggtcggggtcctagggggaacctggtacgtttccaacttccncaacccatccagcagcctgcagtctggtagtatttgctagtttatactgtcagctaatacaatacgtgtacctcgtctcacgttcggcggtaaggacgtaaggttcgagattacgaacgactgngctgacactaagttctg

SEQ ID NO: 321286 - DNA, 578 bp, Homo sapiens
  misc_feature: GZ8MTXP01AGHYK.3.12.B01.1.454.CMB.2.raw
  modified_base (371)..(371): a, c, t, g, unknown or other
  misc_feature (371)..(371): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgaggggagagagcccaccctctcctgcagggccagtcagagtgttgacagcaacttggcctggtaccagcagcaacctggccaggcctcccaggcctcctcatctatgatgcactcccaccgagggcccaccggtactccccgagccaggttcaggtcggctaggtgggtctaggggacnggtacgttcactctcaccatcagcagcctgcagtctgaggttatttgcttagtttattactggtcagtctaattaactaataacgtcggtccgtcggtcctcgtaccgtttcgggcgggtacgggttaccgaagggttcggaagtaacgttaccgaaaacggttaccgttgggtcgggtcctcggaccttaccgtaacttccgttcg

SEQ ID NO: 321287 - DNA, 517 bp, Homo sapiens
  misc_feature: GZ8MTXP01B0XY4.3.12.B01.1.454.CMB.2.raw
  modified_base (357)..(357): a, c, t, g, unknown or other
  misc_feature (357)..(357): n is a, c, g, or t
tcagagacgcactccacgaccggtgctcgatttagtagtgtagattccgcggggaggaactgctcagttaggacccagacggaaccatggaagccccagcgcagcttctcttcctcctgctactatggctcccagatgccactggagaaatggggttgacgcagtttccagccaccctgtctgtgtctccaggggagagagccaccctctcctgcagggccagtcagagtgttgacagcaacttggcctggtaccagcagcaacctggccaggctccagctcctcatctatgatgcatcccaccagggcccaccggtatcccagccaggttcaggtggcaggtgggtctaggggacngagttcactctcaccatcagcagcctgcagtctgaggtatttgctagtttattactggtcagtcattacaataacgtgcctcggtctcgtacgtttcgggcggtagggaccgaaggttggaagattacgaaacgaacgtgtggctgcacctaattcgtcg

SEQ ID NO: 321288 - DNA, 555 bp, Homo sapiens
  misc_feature: GZ8MTXP01ERNT5.3.12.B01.1.454.CMB.2.raw
  modified_base (406)..(406): a, c, t, g, unknown or other
  misc_feature (406)..(406): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccacctgtctgtgtctccgaggggagagagccaccctctcctgcagggccagtcagagtgttgacagcaacttggcctggtaccagcagcaacctggccaggcctcccgaggcctcctcatctatgatgcatcccacgacggcccaccggtatcccagccaggttcagtggctaggtcgggtctaggggacaagtacgttcactctcaccatcagcacgctgcagtctgtagtntttgactagtttattacgtgtctagtactaattaacaaattaactggtaccgtcgtcttcgtacgttcgggaacggtaacgggaccgtaagggttggaagtaacgttacgaaacgttacgtggtcgcgtcgcttacctaagttcgttcg

SEQ ID NO: 321289 - DNA, 585 bp, Homo sapiens
  misc_feature: GZ8MTXP01A57PS.3.12.B01.1.454.CMB.2.raw
  modified_base (159)..(159): a, c, t, g, unknown or other
  misc_feature (159)..(159): n is a, c, g, or t
  modified_base (286)..(286): a, c, t, g, unknown or other
  misc_feature (286)..(286): n is a, c, g, or t
  modified_base (359)..(359): a, c, t, g, unknown or other
  misc_feature (359)..(359): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttnacgcagtttccagccacctgtctgtgtctccaggggagagagccaccctctcctgcagggccagtcagagtgttgacagcaacttggcctggtaccagcagcaacctggccaggctcccagctcctnatctatgatgcatcccaccgagggcccaccggtatcccagccaggttcaggtggcaggtgggtctaggggacnggagttcactctcaccatcagcagcctgccagtcgtgaggtatttgctagtttattactggtctagtactacttaactaattaacgtcggacccttcggtcttaccgtacgttttccgggcgggtaacggggaacccgtaaagggttcggaaacggtaacgttaaccgaaaacgggttaaccgttaagggaggtccgttcgggaccacccgtaagttcctttccgg

SEQ ID NO: 321290 - DNA, 529 bp, Homo sapiens
  misc_feature: GZ8MTXP01EF4M9.3.12.B01.1.454.CMB.2.raw
  modified_base (284)..(284): a, c, t, g, unknown or other
  misc_feature (284)..(284): n is a, c, g, or t
  modified_base (353)..(353): a, c, t, g, unknown or other
  misc_feature (353)..(353): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgaggggagagagccaccctctcctgcagggccagtcagagtgtgacagcaacttggcctggtaccagcagcaactggccaggctccagctccnatctatgatgcatccaccagggcccacggtatcccagccaggttcagtggcaggtgggtctaggggacnggtacgttcactctcaccatcagcagctgcagtctgagtatttgctagtttattactggtcagtctattacaataactggtcctcggtctctacgttcgggcggtacgggttaccgaagggttggagtaacttacgaaacgttacgtggtacggcgtcgaccacctaagttcttcg

SEQ ID NO: 321291 - DNA, 661 bp, Homo sapiens
  misc_feature: GZ8MTXP01CHK1P.3.12.B01.1.454.CMB.2.raw
  modified_base (396)..(396): a, c, t, g, unknown or other
  misc_feature (396)..(396): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgaggggagagacgccaccctctcctgcagggccagtcagtagtgttgacagctaacgttggcctggtaccagcagcaactggccaggcctcccgaggcctcctcatctatgatgcactcccgaccgacgggcccaaccggtactccccgagccctagggttccacgggttcggacgtagggttcgggggtacctagggggaaccngggtaacggtttcccaaaccgtttccacccaaccctatacccgagccaacgccctgctaaggttcgtaggtaggttagttttcgacttaagtttattacgttggttactagtacttaattaaactaaacgttaacgtcggtacccttacggtcctacgttacgtttcggggaacggtaacgggaccgtaaagggttacgggaaatacgttaaccgaaacggttaacgttggtacggcgttcgacgttacctaacgttcgttaacg

SEQ ID NO: 321292 - DNA, 507 bp, Homo sapiens
  misc_feature: GZ8MTXP01DJTFO.3.12.B01.1.454.CMB.2.raw
  modified_base (317)..(317): a, c, t, g, unknown or other
  misc_feature (317)..(317): n is a, c, g, or t
  modified_base (350)..(350): a, c, t, g, unknown or other
  misc_feature (350)..(350): n is a, c, g, or t
  modified_base (502)..(502): a, c, t, g, unknown or other
  misc_feature (502)..(502): n is a, c, g, or t
tcagagacgcactccacgaccggtgctcgatttagtagtgtagatcccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaacctggccaggctcccaggctcctcatcatgatgcatccacagggcccacggtntcccagccaggttcagtggcagtggctgggacngagttcactctcacatcagcagctgcagtctgaggtatttgctagtttattactggtacagctattaacaataactggacctcggtctctacgtttcgggcggtagggaccgaaggttggagattacgaaacgaactggtaggctgcacctnttctg

SEQ ID NO: 321293 - DNA, 601 bp, Homo sapiens
  misc_feature: GZ8MTXP01CPLZI.3.12.B01.1.454.CMB.2.raw
  modified_base (289)..(289): a, c, t, g, unknown or other
  misc_feature (289)..(289): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgaggggagagacgccaccctctcctgcagggccagtcagagtgttgacagcaacttggcctggaccagcagcaactggccaggcctcccaggctcctnatctatgatgcactccaaccgagggcccaccggtactcccgagcccgtaggttcaggtcggcgtaggtggggtccgtaagggggacaaggtacgttccacttctaccacctatcacgcagcctgctagtcgtggtaggttatttgtcttaagtttacttacgttggttcaagtacttaaattaactaaacttaacgtcggtacccgtcggtccttacgtaccgtttcggggaacgggtaacgggaccgtaaagggttggaagtacttaacgaaacgttacgtggacggtctgaccttactaacgttcgttcg

SEQ ID NO: 321294 - DNA, 525 bp, Homo sapiens
  misc_feature: GZ8MTXP01DGOJ6.3.12.B01.1.454.CMB.2.raw
  modified_base (268)..(268): a, c, t, g, unknown or other
  misc_feature (268)..(268): n is a, c, g, or t
  modified_base (518)..(518): a, c, t, g, unknown or other
  misc_feature (518)..(518): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgaggggagagagccaccctctcctgcagggccagtcagagtgttgacagcaacttggcctggtaccagcagcaaccnggccaggcctccaggcctcctcatctatgatgcatccacgacgggccaccggtactcccagccaggttcagtcggctaggtcggggtctaggggacaaggtacgttcaccttctacaaccatccagcagcctgcagtctgaggtatttgctagttattactggtcagctatacaatacgtggcctcggctcgtacgttcgggcggagggaccagggttgagtattacgaaacgacgtgtcgctgcacctnttcgtcg

SEQ ID NO: 321295 - DNA, 535 bp, Homo sapiens
  misc_feature: GZ8MTXP01B6CEQ.3.12.B01.1.454.CMB.2.raw
  modified_base (321)..(321): a, c, t, g, unknown or other
  misc_feature (321)..(321): n is a, c, g, or t
  modified_base (356)..(356): a, c, t, g, unknown or other
  misc_feature (356)..(356): n is a, c, g, or t
  modified_base (368)..(368): a, c, t, g, unknown or other
  misc_feature (368)..(368): n is a, c, g, or t
tcagagacgcactccacgaccggtgctcgatttagtagtgtagattccgcggggaggaactgctcagttaggacccagacggaaccatggaagccccagcgcagcttctcttcctcctgctactctggctcccagatgccactggagaaatggggttgacgcagtttccagccaccctgtctgtgtctccgaggggagagagccaccctctcctgcagggccagtcagagtgttgacagcaacttggcctggtaccagcagcaacctggccaggctcccaggcctcctcatctatgatgcatccaccagggcccacggtancccagccaggttcagtggcaggtgggtctgggacnggagttcactcncaccatcagcagcctgcagtctgaggtatttgctagtttattactggtcagtactattaacaataacgtgacctcggtcctcgtacgtttcgggaacgggaacgggaccgtaagggttggaagtagttacgaaacgacgtggtggctcggacttactaacgttcttg

SEQ ID NO: 321296 - DNA, 521 bp, Homo sapiens
  misc_feature: GZ8MTXP01ENEHS.3.12.B01.1.454.CMB.2.raw
  modified_base (159)..(159): a, c, t, g, unknown or other
  misc_feature (159)..(159): n is a, c, g, or t
  modified_base (284)..(284): a, c, t, g, unknown or other
  misc_feature (284)..(284): n is a, c, g, or t
  modified_base (318)..(318): a, c, t, g, unknown or other
  misc_feature (318)..(318): n is a, c, g, or t
  modified_base (353)..(353): a, c, t, g, unknown or other
  misc_feature (353)..(353): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttnacgcagtttccagccaccctgtctgtgtctccgaggggagagagccaccctctcctgcagggccagtcagagtgtgacagcaacttggcctggtaccagcagcaactggccaggctccagctctnatctatgatgcactccacgagggcccacggtacncccagccaggttcagtggacaggtggtctgggacngtagtcactctcacatcagcagcctagcagtctagtagtatttgctagtttattacttggtactagtctaattaactaataacgtggtctcggtctcgtacgttcgggaacggtagggaccgaagggttgagtattacgaaacgactgtaggctgcactaattcgtcg

SEQ ID NO: 321297 - DNA, 595 bp, Homo sapiens
  misc_feature: GZ8MTXP01AFSIR.3.12.B01.1.454.CMB.2.raw
  modified_base (290)..(290): a, c, t, g, unknown or other
  misc_feature (290)..(290): n is a, c, g, or t
  modified_base (326)..(326): a, c, t, g, unknown or other
  misc_feature (326)..(326): n is a, c, g, or t
  modified_base (365)..(365): a, c, t, g, unknown or other
  misc_feature (365)..(365): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgaggggagagagcccaccctctcctgcagggccagtcagagtgttgacagcaacttggcctggtaccagcagcaactggccaggctcccaggcctcctnatctatgatgcactccaccgagggcccaccggtacncccgagccaggttcagtcggcaggtgggtctaggggacngtacgtccactctaccgacctatcacgcacgccgtgctaggtctaggtagttatttgcttaagtttattacgtgggtctagtactaacttaacaacgttaacgtcggtccctcggtccttccgtaccggtttcgggaacgggaacgggaccgtaaggggttcggaaacgtacgttaaccgaaacgttaccgttgggacggtccgtcggacccttaacgtcttcgtttccg

SEQ ID NO: 321298 - DNA, 558 bp, Homo sapiens
  misc_feature: GZ8MTXP01A726J.3.12.B01.1.454.CMB.2.raw
  modified_base (283)..(283): a, c, t, g, unknown or other
  misc_feature (283)..(283): n is a, c, g, or t
  modified_base (316)..(316): a, c, t, g, unknown or other
  misc_feature (316)..(316): n is a, c, g, or t
  modified_base (361)..(361): a, c, t, g, unknown or other
  misc_feature (361)..(361): n is a, c, g, or t
  modified_base (376)..(376): a, c, t, g, unknown or other
  misc_feature (376)..(376): n is a, c, g, or t
  modified_base (408)..(408): a, c, t, g, unknown or other
  misc_feature (408)..(408): n is a, c, g, or t
  modified_base (535)..(535): a, c, t, g, unknown or other
  misc_feature (535)..(535): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaagtggggttgacgcagtttccagccaccctgtctgtgtctccgaggggagagacgccaccctctcctgcagggccagtcagagtgtgacagcaacttggctggtacagcagcactggccaggctccagctccnatcatgatgcactccgacgacgggccaccggtntcccagcctaggttccaggtcggacaggtcgggtcgtaggggacngtacgttccacttcncaaccataccagcacgcctgcagtctagagtnttgcttagttatacgtgtcgtatactaataactaactaacgtcggtacctcggtcttaccgtacgtttcgggaacgggtaacggacgtaaggttgggaactaattacgaaacgacgtgtacgggtcncggaccacttaacgttctttccg

SEQ ID NO: 321299 - DNA, 568 bp, Homo sapiens
  misc_feature: GZ8MTXP01EA4TB.3.12.B01.1.454.CMB.2.raw
  modified_base (375)..(375): a, c, t, g, unknown or other
  misc_feature (375)..(375): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgaggggagagagccaccctctcctgcagggccagtcagagtgttgacagcaacttggcctggtaccagcagcaacctggccaggctccaggctcctcatctatgatgcactccaccgagggcccacggtactccccgaagcccaggtttccaggtcggacgagggtcggggtcctgggggaacngggtacgtttccaaccttcctaccaaccctatcagccaggccctgccagttcctggtaggtatttgacttagtttattacttggtcagtctaattaacaatactggtacctcgtctctacgttggaacgggtaggaccgtaagggttgaagtacttacgaaacgacgtggtagtctggcacctaattcgttcg

SEQ ID NO: 321300 - DNA, 540 bp, Homo sapiens
  misc_feature: GZ8MTXP01D33YF.3.12.B01.1.454.CMB.2.raw
  modified_base (198)..(198): a, c, t, g, unknown or other
  misc_feature (198)..(198): n is a, c, g, or t
  modified_base (286)..(286): a, c, t, g, unknown or other
  misc_feature (286)..(286): n is a, c, g, or t
  modified_base (354)..(354): a, c, t, g, unknown or other
  misc_feature (354)..(354): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccagggganagagccaccctctcctgcagggccagtcagagtgttgacagcaacttggcctggtaccagcagcaactggccaggctccaggctcctnatctatgatgcatccaccgagggcccacggtactccagccaggttcagtggcaggtgggctagggacngtagttcactctacacatcagcagcctgcagtctgtaggtatttgctagtttattactggtctagtctaattacaattaacgtcggtcctcggtcctctacgtttcgggaacggtaagggaccgtaagggttgaagtaattacgaaacgttaacgtggtacgggcttcggacacctaattcgttcg

SEQ ID NO: 321301 - DNA, 505 bp, Homo sapiens
  misc_feature: GZ8MTXP01AM95V.3.12.B01.1.454.CMB.2.raw
  modified_base (290)..(290): a, c, t, g, unknown or other
  misc_feature (290)..(290): n is a, c, g, or t
  modified_base (320)..(320): a, c, t, g, unknown or other
  misc_feature (320)..(320): n is a, c, g, or t
  modified_base (357)..(357): a, c, t, g, unknown or other
  misc_feature (357)..(357): n is a, c, g, or t
  modified_base (360)..(360): a, c, t, g, unknown or other
  misc_feature (360)..(360): n is a, c, g, or t
  modified_base (489)..(489): a, c, t, g, unknown or other
  misc_feature (489)..(489): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgaggggagagagcccaccctctcctgcagggccagtcagagtgttgacagcaacttggcctggtaccagcagcaacctggccaggctcccagcctcctnatctatgatgcatccacagggcccacggtncccagccaggttcagtggcaggtgggtctaggggacnggngttccactctcaccatcagcagcctgcagtctgagtatttgctagtttattactggtcagctatacaatactgcctcgtctctcgttcggcggtagggaccaagggttggaagattacgaaacgactgnggctgcactgttctcg

SEQ ID NO: 321302 - DNA, 686 bp, Homo sapiens
  misc_feature: GZ8MTXP01BN9PD.3.12.B01.1.454.CMB.2.raw
  modified_base (199)..(199): a, c, t, g, unknown or other
  misc_feature (199)..(199): n is a, c, g, or t
  modified_base (286)..(286): a, c, t, g, unknown or other
  misc_feature (286)..(286): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgagggganagagccaccctctcctgcagggccagtcagagtgttgacagcaacttggcctggtaccagcagcaactggccaggctccagctcctnatctatgatgcactccacgacgggcccaccggtactcccagcccaggttccaggtcggactagggtcggggtctacgggggaactaagggtacgttttaccaccgttccgtaccaaccctattcccgaacgccgaacggtaccccttgggaccctaaggtttcccgtagggtaacggttagtttttacggaccgtttaagttttacgtttaaccgttggggttacctaaggtacctaactttaacaaacttaaaccgtcggtacccgttcggtaccttaccgtaccggttttccggggaacggggaaacggggttaaccggtaaagggttacggaaacgtaacgttaacgaaaacgttacggtaaggttcgggaactcggacacctaacgttcgttaacg

SEQ ID NO: 321303 - DNA, 608 bp, Homo sapiens
  misc_feature: GZ8MTXP01EYUJU.3.12.B01.1.454.CMB.2.raw
  modified_base (319)..(319): a, c, t, g, unknown or other
  misc_feature (319)..(319): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatgggttgacgcagtttccagccaccctgtctgtgtctccaggggagagagccaccctctcctgcaggccagtcagagtgttgacagcaacttggaccgtacggtaccgacgacgacgaccgaaccgtacggaccgacggtaccgtacccgtacggttacctactaccntctacgtacgtacgtacgtacgtaccgtacccgtacccgaacccggacccggtacccgtacccgtacccgtacccgtaccgtaccgtaccggtacgtacggtcggtacggtacggtacggtacggggtacggtacggtacgtaccgtaccgtaccgtaccgtaccgtacctacgtaccgacgaccgtaccgtcgtacgttacgtacggttacgtacggttacgttacgtttacgttacgtttaacgtttacgttaacgttacgtacgttaacgtaacgttaacgtaacg

SEQ ID NO: 321304 - DNA, 619 bp, Homo sapiens
  misc_feature: GZ8MTXP01DHOOD.3.12.B01.1.454.CMB.2.raw
  modified_base (199)..(199): a, c, t, g, unknown or other
  misc_feature (199)..(199): n is a, c, g, or t
  modified_base (327)..(327): a, c, t, g, unknown or other
  misc_feature (327)..(327): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgagggganagagccaccctctcctgcagggccagtcagagtgttgacagcaacttggcctggtaccagcagcaaccgtggccaggcctcccaggcctcctcatctatgatgcatcccacgacgggcccaccggtancccagccaggttcaggtcggctaggtcgggtcgtaggggacaaggtacgttcactctaccacatcacgcacgcctgcagtcgtaggtaggttatttgacttagtttaattacttgggtacagtactaattaactaaactaacgtcggtaccctccggtaccttcgtaccggtttcggggaaccggggtaacggggttaacccggtaaaggggttaggaaacggtaacgttaaaccggaaaaccggttaacgttgggtacggcgttacggaccttaccgtaacttccgtttcg

SEQ ID NO: 321305 - DNA, 521 bp, Homo sapiens
  misc_feature: GZ8MTXP01BKCYA.3.12.B01.1.454.CMB.2.raw
  modified_base (285)..(285): a, c, t, g, unknown or other
  misc_feature (285)..(285): n is a, c, g, or t
  modified_base (319)..(319): a, c, t, g, unknown or other
  misc_feature (319)..(319): n is a, c, g, or t
  modified_base (358)..(358): a, c, t, g, unknown or other
  misc_feature (358)..(358): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaactggccaggctccaggctccnatctatgatgcatccaccgagggcccacggtacncccagccagggttcaggtggctagggtggtctggggacnggagttccactctcaccatcagcacgcctgctagtcgtgtaggtatttgctagtttattactggtcagctattacaatactgcctcggtctctacgttcgggcggaggaccgagggttcggagtattacgaaacgactggtaggctggcacctaattcgttcg

SEQ ID NO: 321306 - DNA, 537 bp, Homo sapiens
  misc_feature: GZ8MTXP01AE9TG.3.12.B01.1.454.CMB.2.raw
  modified_base (198)..(198): a, c, t, g, unknown or other
  misc_feature (198)..(198): n is a, c, g, or t
  modified_base (287)..(287): a, c, t, g, unknown or other
  misc_feature (287)..(287): n is a, c, g, or t
  modified_base (358)..(358): a, c, t, g, unknown or other
  misc_feature (358)..(358): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccagggganagagccacctctcctgcagggccagtcagagtgttgacagcaacttggcctggtaccagcagcaacctggccaggctcccaggctcctnatctatgatgcatccaccgagggcccaccggtatccccagccaggttcagtggcaggtgggctaggggacngtagtcactctcaccatcagcagcctgcagtctagaggtatttgctagtttattactggttcagtctattaactaataactcggtcctcggtcctcgtacgtttcggcgggagggttaccgaagggttggagaacgttacgaaaccggactcggtgggaactcggcacctaagttctcg

SEQ ID NO: 321307 - DNA, 582 bp, Homo sapiens
  misc_feature: GZ8MTXP01BKYVF.3.12.B01.1.454.CMB.2.raw
  modified_base (286)..(286): a, c, t, g, unknown or other
  misc_feature (286)..(286): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgaggggagagagccaccctctcctgcagggccagtcagagtgttgacagcaacttggcctggtaccagcagcaactggccaggctccaggctccncatcatgatgcatccaccgaggcccaccggtatccccagccaggttcagtggcaggtgggtctaggggacaaggagttccacttctacaccatcagcagcctgcagtcgtgaggtatttggctagtttattacgtgtcagtactaattaacaataaccgtggtcccttcggtccttacgtaacgtttccggggaacgggtaacgggttaacccggtaagggttagggaacgtaagttaccgaaaacgttaccgtaagggttcggaacgttacggacttaaccctaagtttcttccg

SEQ ID NO: 321308 - DNA, 570 bp, Homo sapiens
  misc_feature: GZ8MTXP01A718Z.3.12.B01.1.454.CMB.2.raw
  modified_base (273)..(273): a, c, t, g, unknown or other
  misc_feature (273)..(273): n is a, c, g, or t
  modified_base (282)..(282): a, c, t, g, unknown or other
  misc_feature (282)..(282): n is a, c, g, or t
  modified_base (316)..(316): a, c, t, g, unknown or other
  misc_feature (316)..(316): n is a, c, g, or t
  modified_base (337)..(337): a, c, t, g, unknown or other
  misc_feature (337)..(337): n is a, c, g, or t
  modified_base (351)..(351): a, c, t, g, unknown or other
  misc_feature (351)..(351): n is a, c, g, or t
  modified_base (362)..(362): a, c, t, g, unknown or other
  misc_feature (362)..(362): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgaggggagagagcccaccctctcctgcagggccagtcagagtgttgacagcaacttggcctggaccagcagcactgccagcnccagctccnatctatgatgcatccaccgagggcccacggtacncccagccaggttcaggtggcnggtggtctgggacngagttcactcncaccatccagcagcctgctagtcgtgtaggtattttcgacttagtttattactgggtcagtacaatttaacaattaacgtcggtaccctcggtccttacgtaccggttcgggaacgggtaaggggaaccgtaaaggggttggaaacgtaacgttaccgaaaacggttaacgtgggtaggtccttggaccttaccgtaagttccgttcg

SEQ ID NO: 321309 - DNA, 582 bp, Homo sapiens
  misc_feature: GZ8MTXP01BOZ3H.3.12.B01.1.454.CMB.2.raw
  modified_base (375)..(375): a, c, t, g, unknown or other
  misc_feature (375)..(375): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgaggggagagagccaccctctcctgcagggccagtcagagtgttgacagcaacttggcctggtaccagcagcaacctggccaggcctcccgaggcctcctcatctatgatgcactcccaccgacgggcccaaccggtactccccgagccgaggttccaggtggcgaggtcgggtcgaggggacnggtacgtttccacgttcctacaacctatccagcgagccgtgctagtctaggtagttatttgacttagtttattacgtaggtctagtctaattaacaagtacgtggtcctcgtctacgtacgttcgggaacgggtaacggacgtaagggttggaagtaacgttaacgaaacgttacgtggtcgcgtcggaccactcgttcgttaaccg

SEQ ID NO: 321310 - DNA, 549 bp, Homo sapiens
  misc_feature: GZ8MTXP01DZJ77.3.12.B01.1.454.CMB.2.raw
  modified_base (289)..(289): a, c, t, g, unknown or other
  misc_feature (289)..(289): n is a, c, g, or t
  modified_base (357)..(357): a, c, t, g, unknown or other
  misc_feature (357)..(357): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgaggggagagagccaccctctcctgcagggccagtcagagtgttgacagcaacttggcctggtaccagcagcaacctggccaggcctccaggctcctnatctatgatgcatccaccgagggcccacggtatcccagccaggttcaggtggcaggtggctagggacngacgttcactctacaccatcagcagcctgcagtctaggtaggtattttgacttagtttattactggttacagtactaattaacaaattaacgtcggcctcggtctactacgttcgggaacgggaacgggaccgtaagggttaggaacgtattaacggaaacgacgtggtcggctcgccactaacttcgttcg

SEQ ID NO: 321311 - DNA, 648 bp, Homo sapiens
  misc_feature: GZ8MTXP01EHT07.3.12.B01.1.454.CMB.2.raw
  modified_base (291)..(291): a, c, t, g, unknown or other
  misc_feature (291)..(291): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgaggggagagacgccaccctctcctgcagggccagtcagagtgttgacagctaacgttggcctggtaccagcagcaacctggccagtcctccagctcctnatcatgatgcactccaccgacgggcccacggtactcccgagtccgtaggttccaggtcggacgtagggtcggggtctaacggggaactgggtactttccaacttcctaccaaccgtatcgaacgccgacgccctggaccaggttctaggtagttatttcgacttaagtttataccgttaggtacgtaacgtactaaactttaacaaacgttacgtcggtccccttacgggtccttaccgttaaccggttccggggaacgggtaacgggttaacccgtaaggggttgaaacgtacttaaacccgttaaacgttaaccgttggtacggaacttcggacccttacgtaacttcccgttcg

SEQ ID NO: 321312 - DNA, 555 bp, Homo sapiens
  misc_feature: GZ8MTXP01BX16D.3.12.B01.1.454.CMB.2.raw
  modified_base (372)..(372): a, c, t, g, unknown or other
  misc_feature (372)..(372): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgaggggagagagccaccctctcctgcagggccagtcagagtgttgacagcaacttggcctggtaccagcagcaacctggccaggcctcccaggcctcctcatctatgatgcatcccaccgaggggccccaccggtactccccgagcccaggttcacggtggcaggtggggtctaggggacnggtagttccacttctacaccatcagcagcctgcagtctgtaggtattttgcttagtttattactggtcagtcattacaataacgtcggtcctcggtcttcgtacgtttcgggcggacgggacctaaggggttgaagtagttaccgaaacgttacgtgtggaactggccaccgtaagttcttcg

SEQ ID NO: 321313 - DNA, 627 bp, Homo sapiens
  misc_feature: GZ8MTXP01AOB9W.3.12.B01.1.454.CMB.2.raw
  modified_base (199)..(199): a, c, t, g, unknown or other
  misc_feature (199)..(199): n is a, c, g, or t
  modified_base (268)..(268): a, c, t, g, unknown or other
  misc_feature (268)..(268): n is a, c, g, or t
  modified_base (445)..(445): a, c, t, g, unknown or other
  misc_feature (445)..(445): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccacactgtctgtgtctccgagggganagagccaccctctcctgcagggccagtcagagtgttgacagcaacttggcctggtaccagcagcaaccnggccaggcctcccgaggcctcctcatcctatgatcgactactcccgaccgacgggcccaaccgggtactcccccgagtcccgtaggtttcccaggttggccgtagggttcggggtactaggggaacaggtacgttccaccgttctaccacctatcagcacgcctgcagtctgtagtntttgcttagtttacttacgtgtacgtactacttaacttaacaaacgttaaccgtcgggtcccttccgggtaccttaccgttaccggtttccgggacgggttaacgggtaccgttaagggtaggaacgttacgttaaccgaaacggtaacgtggtcgtacgtcgacctaaccgttaagttccg

SEQ ID NO: 321314 - DNA, 693 bp, Homo sapiens
  misc_feature: GZ8MTXP01E0Q3O.3.12.B01.1.454.CMB.2.raw
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgaggggagagagccaccctctcctgcagggccagtcagagtgttgacagcaacttggcctggtaccagcagcaacctggccaggcctcccgaggcctcctcatctatgatgcactcccaccgagggcccaccggtactcccacgaccgacggttacgtacgtcggcgacggtgggtcggtagggacgaagtacgtctacctcttaccaccactacctagaccgacgtccgtcgtcgacgttacgtggtagggttacgttttgttacgttacgttttaatttacgttacgggttctacggtacctaacttaaactaaacgttaaccgttacggtacccggttccggtccgttaccgtaccgttttccgggggtaaccggggtaacggggttaaaccgggaaacggggttaagggacgggtaaacgttaaccgttaaaaccgggttaaacgttaagggttacggtaaccggttcgaccggttacccctaacgtttccgtttccg

SEQ ID NO: 321315 - DNA, 569 bp, Homo sapiens
  misc_feature: GZ8MTXP01EXWA6.3.12.B01.1.454.CMB.2.raw
  modified_base (199)..(199): a, c, t, g, unknown or other
  misc_feature (199)..(199): n is a, c, g, or t
  modified_base (292)..(292): a, c, t, g, unknown or other
  misc_feature (292)..(292): n is a, c, g, or t
  modified_base (327)..(327): a, c, t, g, unknown or other
  misc_feature (327)..(327): n is a, c, g, or t
  modified_base (363)..(363): a, c, t, g, unknown or other
  misc_feature (363)..(363): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgagggganagagccaccctctcctgcagggccagtcagagtgttgacagcaacttggcctggtaccagcagcaacctggccaggcctcccgaggcctcctnatctatgatgcatcccaccgagggcccaccggtancccagccaggttcagtggcaggtgggtctagggacnggtagttccaacttctaccaacctatccagcacgccctgctagtacgtgtaggtatttgacttagtttaattacgttggtactaagtactaattaactaaagttaacgtcggtacctcggtctcgtaccgtttcgggcgggtaacgggaccgaagggttggaagacttacgaaacgttacgtggtggctgacacgtaattcgttcg

SEQ ID NO: 321316 - DNA, 720 bp, Homo sapiens
  misc_feature: GZ8MTXP01A5DHT.3.12.B01.1.454.CMB.2.raw
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccacctgtctgtgtctccgaggggagagacgccaccctctcctgcagggccagtcagagtgttgacagctaacttggcctggtaccagcagcaacctggccaggcctcccgaggcctcctcatctatgatgcactccaccgagggcccaaccggtatccccgagccagggtttccaaggttcggacgtagggttcggggtactggggaacctgggtacgtttccaaccctttccgtaccaacccctaagttcccgaacgtccgaacggtcccgttcggacccgtaggttacgttagggtaacggttaagtttttcgggacctttaaggttttaactttaccgttaggttacgtaacgttacctaaactttaaacgaaacttaaacgttcggtacccgttcgggtacccttaccgttaacccgggttttccggggaaccgggtaaacgggggttaacccgtaaacggggttacgggaaagtaaccgttaacgaaaaccgttaccgtaagggtacgtcgtacggacccttaaccgtaacgttcgtttccg

SEQ ID NO: 321317 - DNA, 525 bp, Homo sapiens
  misc_feature: GZ8MTXP01AVR4Q.3.12.B01.1.454.CMB.2.raw
  modified_base (199)..(199): a, c, t, g, unknown or other
  misc_feature (199)..(199): n is a, c, g, or t
  modified_base (287)..(287): a, c, t, g, unknown or other
  misc_feature (287)..(287): n is a, c, g, or t
  modified_base (323)..(323): a, c, t, g, unknown or other
  misc_feature (323)..(323): n is a, c, g, or t
  modified_base (363)..(363): a, c, t, g, unknown or other
  misc_feature (363)..(363): n is a, c, g, or t
  modified_base (437)..(437): a, c, t, g, unknown or other
  misc_feature (437)..(437): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgagggganagagccaccctctcctgcagggccagtcagagtgttgacagcaacttggcctggtaccagcagcaactggccaggctcccgagcctcncatctatgatgcatcccacgagggcccaccggtacncccgagcctaggttcaggtggcaggtcgggtctagggacngtactcactctacacatcagcacgctagacgtaccgtagaagttatttgctaagtttattactgtacagctagngtagcaacgtcgcctctcgtacgtttcggcggaacgggaacgaggtggagacgtacaaacgttacttgtggctcgcacatcttgttcc

SEQ ID NO: 321318 - DNA, 804 bp, Homo sapiens
  misc_feature: GZ8MTXP01DW6PX.3.12.B01.1.454.CMB.2.raw
  modified_base (286)..(286): a, c, t, g, unknown or other
  misc_feature (286)..(286): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccacctgtctgtgtctccgaggggagagacgccaccctctcctgcagggccagtcagagtgttgacagcaacgttggctggtaccagcagcaactggccaggctccagcctccncatctatgatcgacactccaccgacgggccccaaccgggtctcccgagcccgtaagggttccaacggttcggggactacgggtcgggggtcccgtaagggggaactaaggtacgtttacccaccgttacctacccgaacctaacgtcccgaacgtaccgaacggtccccgttacggacccgttaaggttacccggtagggttaacgggtttacgtttttacgggtacccgttaaaggttttttaactttaacccggtttaggggttaactaacggttaacttaaacgtttaaacctaaaacgtttaaaccgttccggggtaccccgtttaaccgggtcctttacccggttaaccggttttcccgggggaaccgggggttaaacgggggttaaacccgggtaaaagggggttacgggaaacggtaaacgttaaaaccggttaaaacgggttaaaccggttaagggtaccgggtaaccgttacgggaacccgttaacccttaacggtttccttttcccgg

SEQ ID NO: 321319 - DNA, 599 bp, Homo sapiens
  misc_feature: GZ8MTXP01DAF79.3.12.B01.1.454.CMB.2.raw
  modified_base (197)..(197): a, c, t, g, unknown or other
  misc_feature (197)..(197): n is a, c, g, or t
  modified_base (291)..(291): a, c, t, g, unknown or other
  misc_feature (291)..(291): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctccagatgccactggagaaagtggggttgacgcagtttccagccacctgtctgtgtctcgagggganagacgcccaccctctcctgcgagggccagtcagtagtgttgacagctaacgttggcctggtaccagcagcaactgaccgagcctccagctcctnatcatgatcgacactacccaccgacggcccacggtactcccgagccgtagttcgaggtcggactagggtcgggtcgtaagggactgtacgttcactcacacatcacgcacgcctgcgtagtcgtagtacgttatttcgacttaagttactacgttggtactagtacctaaattaacaaagttacgtcggtaccctggtcctacgtacccggttgggaacggaacgggacaaggggttacgaacgtaacgttaacgaaacccggttagttcgggaaggtcctacggaccttaaccgttcgttccgttcg

SEQ ID NO: 321320 - DNA, 737 bp, Homo sapiens
  misc_feature: GZ8MTXP01DD87S.3.12.B01.1.454.CMB.2.raw
  modified_base (300)..(300): a, c, t, g, unknown or other
  misc_feature (300)..(300): n is a, c, g, or t
  modified_base (306)..(306): a, c, t, g, unknown or other
  misc_feature (306)..(306): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaagtggggttgacgcagtttccagcccaccctgtctgtgtctccgaggggagagacgccaccctctcctgcgacgggccagtcagtagtgttgacagctaacgttggcctggtaccagcagcaaccgtggccaggcctccgaggcctcctnatctangatgccactccccaaccggacgggacccctaacccggtactaccccgaacgccgtacggttcaacggttcggaccgtaaggggttcggggtacggtaacggggaaccgtaaggtaccgtttccaacccgttaccctcccaaaccgtacgtacccgaacgtaccgaaccggtcccgtacgaaccgttacggttacggttagggttaacggttttacgttttacgaaccgttttaaggttttaactttaacgttcggttaacgtaacgttaaccttaaacgttaaactaaaccgttaaccgtccggttacccgttcgtccgttaccgttccgggtttaccgggaaccggggtaacgggaaccggtaagggacggaagtaacgttaacgaaacgttacgtggtacgcgttacgaccttactcgttcgtttaacg

SEQ ID NO: 321321 - DNA, 689 bp, Homo sapiens
  misc_feature: GZ8MTXP01BBPFA.3.12.B01.1.454.CMB.2.raw
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgaggggagagacgccaccctctcctgccgagggccagtcagagtgttgacagctaacgttggcctggtaccagcagcaacctggccaggcctccgaggcctcctcatctatgatgctactccaccgacgggcccaaccggtactcccagccaggttcacggtcggcgtagggtggggtaccgtagggggaacctaagggtacgtttacccaccgttcctaccaacccgattccgaacggccaacgggtcccctggtaccgtaaacggttccgtagggttacggttattttggacctttaaggtttacttacgttgggttactaagtacctaaattaacctaaagtttaacccgtcggtaacccgttccggtccttaccgtacccggtttcggggaacgggtaacggggttaacccgtaaaggggttacggaaacgtaacgttaaacgaaaacggttacgtaaggcggtcgttacggaccttaccgtaacttcgtttcg

SEQ ID NO: 321322 - DNA, 688 bp, Homo sapiens
  misc_feature: GZ8MTXP01AE5MZ.3.12.B01.1.454.CMB.2.raw
  modified_base (344)..(344): a, c, t, g, unknown or other
  misc_feature (344)..(344): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggaagaaagtggggttgacgctagtttccagccaccctgtctgtgtctccgaggggagagacgcccaccctctcctgcagggccagtcagtagtgttagacagactaacgttcggcctggtaccagcaagccaaccgtggccaggcctcccgaggtcctcctcatctatgatcgcactcccacgacgggccaccggtacncccgagccgtaggttcaggtcggctaggggttcgggtcgtaacggggactaaggtacgtttcccaacgttccgtaccaacctacgtaccaacggccctaacggcccgttagaccgtaagttcgtaggtaaggtttattttcggactttaggttttaacttacgtcggggttcaaggtccgtaaggtccgtaacgcgtaaacgttccgggtcccttccgtacccgtaaccgggttccggggaacggggaaacggggttaacccggtaaaggggttacgggaaacgttaacgaaccgttaaaacggacgttgggtacgcgtacggaccttactaacgttcgttccg

SEQ ID NO: 321323 - DNA, 679 bp, Homo sapiens
  misc_feature: GZ8MTXP01AE84V.3.12.B01.1.454.CMB.2.raw
  modified_base (199)..(199): a, c, t, g, unknown or other
  misc_feature (199)..(199): n is a, c, g, or t
  modified_base (269)..(269): a, c, t, g, unknown or other
  misc_feature (269)..(269): n is a, c, g, or t
  modified_base (286)..(286): a, c, t, g, unknown or other
  misc_feature (286)..(286): n is a, c, g, or t
  modified_base (323)..(323): a, c, t, g, unknown or other
  misc_feature (323)..(323): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccacactgtctgtgtctccgagggganagacgccaccctctcctgcagggccagtcagagtgttgacagcaacgttggcctggtaccagcagcaacnggccagctccagctctnatctatgatgcactccaccgagggccctaccggtacncccgagccgtaggttccaggtggctaggtgggtctagggaactaggtacgtttccaccgttctaccgactactaccgagccaacggccctaggaccgtaggttccgtaggtaagggtttacgttttcggtacttaaggtttttaattaccgggttaggttacctaggtaaccttaaacgtttaaaccaaacgttaaaccggttccgggtaccccgtttccgggaccttcccggttaacgggtttaaccccggggacgggttaaacgggggtaacccgttaaaggggtagggtaacgttacgttaaccgaaaccgggtaacgtggtcggtcgtacggaccctaacttcgtttaaccg

SEQ ID NO: 321324 - DNA, 591 bp, Homo sapiens
  misc_feature: GZ8MTXP01BZ4F2.3.12.B01.1.454.CMB.2.raw
  modified_base (199)..(199): a, c, t, g, unknown or other
  misc_feature (199)..(199): n is a, c, g, or t
  modified_base (293)..(293): a, c, t, g, unknown or other
  misc_feature (293)..(293): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccacactgtctgtgtctccgagggganagagccaccctctcctgcgagggccagtcagagtgttgacagcaacttggcctggtaccagcagcaacgtggccaggcctcccgaggcctcctnatctatcgatcgacactcccaccgacgggacccaccggtactcccagccgtaggttcaggtggcgtaggtggggtactgggaacagtacgtcaccgtctcacgatcagcacgctgcgtagtcgtaggtaggttatttcgacttagtttaacttagtgtacgagtactaagttaactaactaccgtcggtccctacggtccttcgtaccggttcgggacgggttagggaccgagggtacgtaagaacgttacgaaacggtaacgtcggtaacggcgtacggaccctaacgttcgtaacg

SEQ ID NO: 321325 - DNA, 572 bp, Homo sapiens
  misc_feature: GZ8MTXP01CSLQH.3.12.B01.1.454.CMB.2.raw
  modified_base (289)..(289): a, c, t, g, unknown or other
  misc_feature (289)..(289): n is a, c, g, or t
  modified_base (374)..(374): a, c, t, g, unknown or other
  misc_feature (374)..(374): n is a, c, g, or t
  modified_base (389)..(389): a, c, t, g, unknown or other
  misc_feature (389)..(389): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgaggggagagagcccaccctctcctgcagggccagtcagagtgttgacagctaacttggcctggtaccagcagcaacctggccaggctcccagctccncatctatgatgcactccaccgagggcccaaccggtactccccgagccctaggttccaggtggcaggtcggggtcctagggggacnggtagttccacttcncaccctatccagcacgcctgcagtctaggtagtatttgactagtttacttactggtctagtctaattaacaaattaacgtggtacctcggtcttcgtaccgtttcgggcggaacgggaccgtagggttagaacgattaacgaaacgacgttaaggtacgtcgtcgaccaccgtaattcgttcg

SEQ ID NO: 321326 - DNA, 633 bp, Homo sapiens
  misc_feature: GZ8MTXP01EOORG.3.12.B01.1.454.CMB.2.raw
  modified_base (412)..(412): a, c, t, g, unknown or other
  misc_feature (412)..(412): n is a, c, g, or t
  modified_base (436)..(436): a, c, t, g, unknown or other
  misc_feature (436)..(436): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaagtggggttgacgcagtttccagccacctgtctgtgtctccgaggggagagagccaccctctcctgcagggccagtcagagtgttgacagcaacttggcctggtaccagcagcaacctggccaggcctcccaggcctcctcatctatgatgcactcccaccgaggggccccaaccggtactccccgagcccgtaaggttccaaggtcgggcagggtggggtccgtaagggggaccaaggtagtttccacctccgtacaaccntcagcagcctgcagtctgtaggtntttgcttagtttatacgtggtactagtactaattaactaagtaacgttcggacccgttcggtcttacgtaccgtttccggggaacgggtaacggggttaccgtaaaggggttacggaacggtaaacgttaaccggttaaaaacggttaacgttgggtcgggtaacgttcggaccgttacctaacgtttcgttaaccg

SEQ ID NO: 321327 - DNA, 609 bp, Homo sapiens
  misc_feature: GZ8MTXP01DO6O0.3.12.B01.1.454.CMB.2.raw
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgaggggagagagccaccctctcctgcagggccagtcagagtgttgacagctaacgttggcctggtaccagcagcaacctggccaggctcccaggcctcctcatctatgatgcactccaccgacgggccccaccggtactcccgacgccgtaggttccaggtggcgagggttcggggtccgtggggaacctggtacgttccaccttcctaccacacgtcacgcacgcctgctagtcgtgtaggtatttgatacgtttattaccttgggtactagtactaatttaacgaactaacgtcggtacctcggtcttacgtacgtttcgggaacggggtacggaccggtaagggttaggagtaacgttaacgaaacggttaaacgttgggtacggtcgtacggacgaccttaacttccgtttccg
